United States Patent 7,745,391 (HUMAN THROMBOSPONDIN POLYPEPTIDE) - sequence listing, part 276

SEQ ID NO: 833914 - protein, 181 aa, Homo sapiens
FKSEFLYLKHLMITAQRFTVQIEEKLLLKLLSFFGYDQAESEVEKYDENLHEKTAEQGGTPIRYYFENLKISIPQIKLSVFTSNKLPLDLKALKSTLGFPLIRFEDAVINLDPFTRVHPYETKEFIINDILKHFQEDILRARRKDRSSSSNSQTTYRTNSSSLWRTLTATACSSPPKLFTS

SEQ ID NO: 833915 - protein, 916 aa, Homo sapiens; identical to SEQ ID NO: 833910

SEQ ID NO: 833916 - protein, 230 aa, Homo sapiens
VVVGVRVSVGGLVGEVACACRDCIPETMAEGDNRSTNLLAAETASLEEQLQGWGEVMLMADKVLRWERAWFPPAIMGVVSLVFLIIYYLDPSVLSGVSCFVMFLCLADYLVPILAPRIFGSNKWTTEQQQRFHEICSNLVKTRRRAVGWWKRLFTLKEEKPKMYFMTMIVSLAAVAWVGQQVHNLLLTYLIVTSLLLLPGLNQHGIILKYIGMAKREINKLLKQKEKKNE

SEQ ID NO: 833917 - protein, 230 aa, Homo sapiens; identical to SEQ ID NO: 833916

SEQ ID NO: 833918 - protein, 230 aa, Homo sapiens; identical to SEQ ID NO: 833916

SEQ ID NO: 833919 - protein, 230 aa, Homo sapiens; identical to SEQ ID NO: 833916

SEQ ID NO: 833920 - protein, 230 aa, Homo sapiens; identical to SEQ ID NO: 833916

SEQ ID NO: 833921 - protein, 230 aa, Homo sapiens; identical to SEQ ID NO: 833916

SEQ ID NO: 833922 - protein, 288 aa, Homo sapiens
VTSRKHQINHRSKNNCLWTAAMRLTVLCAVCLLPGSLALPLPQEAGGMSELQWEQAQDYLKRFYLYDSETKNANSLEAKLKEMQKFFGLPITGMLNSRVIEIMQKPRCGVPDVAEYSLFPNSPKWTSKVVTYRIVSYTRDLPHITVDRLVSKALNMWGKEIPLHFRKVVWGTADIMIGFARGAHGDSYPFDGPGNTLAHAFAPGTGLGGDAHFDEDERWTDGSSLGINFLYAATHELGHSLGMGHSSDPNAVMYPTYGNGDPQNFKLSQDDIKGIQKLYGKRSNSRKK

SEQ ID NO: 833923 - protein, 159 aa, Homo sapiens
HCESHSCRPETIVLGPMVDLVSKALNMWGKEIPLHFRKVVWGTADIMIGFARGAHGDSYPFDGPGNTLAHAFAPGTGLGGDAHFDEDERWTDGSSLGINFLYAATHELGHSLGMGHSSDPNAVMYPTYGNGDPQNFKLSQDDIKGIQKLYGKRSNSRKK

SEQ ID NO: 833924 - protein, 136 aa, Homo sapiens
RLWKHRYPGFQGKVVVGCNCCHHDQALREVAHGDSYPFDGPGNTLAHAFAPGTGLGGDAHFDEDERWTDGSSLGINFLYAATHELGHSLGMGHSSDPNAVMYPTYGNGDPQNFKLSQDDIKGIQKLYGKRSNSRKK

SEQ ID NO: 833925 - protein, 288 aa, Homo sapiens; identical to SEQ ID NO: 833922

SEQ ID NO: 833926 - protein, 288 aa, Homo sapiens; identical to SEQ ID NO: 833922

SEQ ID NO: 833927 - protein, 270 aa, Homo sapiens
VTSRKHQINHRSKNNCLWTAAMRLTVLCAVCLLPGSLALPLPQEAGGMSELQWEQAQDYLKRFYLYDSETKNANSLEAKLKEMQKFFGLPITGMLNSRVIEIMQKPRCGVPDVAEYSLFPNSPKWTSKVVTYRIVSYTRDLPHITVDRLVSKALNMWGKEIPLHFRKVVWGTADIMIGFARGAHGDSYPFDGPGNTLAHAFAPGTGLGGDAHFDEDERWTDGSSLGINFLYAATHELGHSLGMGHSSDPNADDIKGIQKLYGKRSNSRKK

SEQ ID NO: 833928 - protein, 227 aa, Homo sapiens
GSRVRHVAPRGQSPSTPPNLSDNTCHFEDEKICGYTQDLTDNFDWTRQNALTQNPKRSPNTGPPTDISGTPEGYYMFIETSRPRELGDRARLVSPLYNASAKFYCVSFFYHMYGKHIGSLNLLVRSRNKGALDTHAWSLSGNKGNVWQQAHVPISPSGPFQIIFEGVRGPGYLGDIAIDDVTLKKGECPRKQTDPNKVVVMPGSGAPCQSSPQLWGPMAIFLLALQR

SEQ ID NO: 833929 - protein, 245 aa, Homo sapiens
GSRVRHVAPRGQSPSTPPNLSDNTCHFEDEKICGYTQDLTDNFDWTRQNALTQNPKRSPNTGPPTDISGTPEGYYMFIETSRPRELGDRARLVSPLYNASAKFYCVSFFYHMYGKHIGSLNLLVRSRNKGALDTHAWSLSGNKGNVWQQAHVPISPSGPFQIIFEGVRGPGYLGDIAIDDVTLKKGECPRKQTDPNKGARREGGGGAESGGSCAWRGFLSVEGGCLGLNRGSECLSDGNHVALTV

SEQ ID NO: 833930 - protein, 549 aa, Homo sapiens
HRGFERLTLPKRTMGSNKSKPKDASQRRRSLEPAENVHGAGGGAFPASQTPSKPASADGHRGPSAAFAPAAAEPKLFGGFNSSDTVTSPQRAGPLAGGVTTFVALYDYESRTETDLSFKKGERLQIVNNTEGDWWLAHSLSTGQTGYIPSNYVAPSDSIQAEEWYFGKITRRESERLLLNAENPRGTFLVRESETTKGAYCLSVSDFDNAKGLNVKHYKIRKLDSGGFYITSRTQFNSLQQLVAYYSKHADGLCHRLTTVCPTSKPQTQGLAKDAWEIPRESLRLEVKLGQGCFGEVWMGTWNGTTRVAIKTLKPGTMSPEAFLQEAQVMKKLRHEKLVQLYAVVSEEPIYIVTEYMSKGSLLDFLKGETGKYLRLPQLVDMAAQIASGMAYVERMNYVHRDLRAANILVGENLVCKVADFGLARLIEDNEYTARQGAKFPIKWTAPEAALYGRFTIKSDVWSFGILLTELTTKGRVPYPGMVNREVLDQVERGYRMPCPPECPESLHDLMCQCWRKEPEERPTFEYLQAFLEDYFTSTEPQYQPGENL

SEQ ID NO: 833931 - protein, 536 aa, Homo sapiens
MGSNKSKPKDASQRRRSLEPAENVHGAGGGAFPASQTPSKPASADGHRGPSAAFAPAAAEPKLFGGFNSSDTVTSPQRAGPLAGGVTTFVALYDYESRTETDLSFKKGERLQIVNNTEGDWWLAHSLSTGQTGYIPSNYVAPSDSIQAEEWYFGKITRRESERLLLNAENPRGTFLVRESETTKGAYCLSVSDFDNAKGLNVKHYKIRKLDSGGFYITSRTQFNSLQQLVAYYSKHADGLCHRLTTVCPTSKPQTQGLAKDAWEIPRESLRLEVKLGQGCFGEVWMGTWNGTTRVAIKTLKPGTMSPEAFLQEAQVMKKLRHEKLVQLYAVVSEEPIYIVTEYMSKGSLLDFLKGETGKYLRLPQLVDMAAQIASGMAYVERMNYVHRDLRAANILVGENLVCKVADFGLARLIEDNEYTARQGAKFPIKWTAPEAALYGRFTIKSDVWSFGILLTELTTKGRVPYPGMVNREVLDQVERGYRMPCPPECPESLHDLMCQCWRKEPEERPTFEYLQAFLEDYFTSTEPQYQPGENL

SEQ ID NO: 833932 - protein, 536 aa, Homo sapiens; identical to SEQ ID NO: 833931

SEQ ID NO: 833933 - protein, 536 aa, Homo sapiens; identical to SEQ ID NO: 833931

SEQ ID NO: 833934 - protein, 536 aa, Homo sapiens; identical to SEQ ID NO: 833931

SEQ ID NO: 833935 - protein, 536 aa, Homo sapiens; identical to SEQ ID NO: 833931

SEQ ID NO: 833936 - protein, 373 aa, Homo sapiens [sequence omitted]

SEQ ID NO: 833937 - protein, 180 aa, Homo sapiens
MGSNKSKPKDASQRRRSLEPAENVHGAGGGAFPASQTPSKPASADGHRGPSAAFAPAAAEPKLFGGFNSSDTVTSPQRAGPLAGGVTTFVALYDYESRTETDLSFKKGERLQIVNNTEGDWWLAHSLSTGQTGYIPSNYVAPSDSIQAEEWYFGKITRREVEVEVSQDCATTLQPGKQSK

SEQ ID NO: 833938 - protein, 100 aa, Homo sapiens
SPSFFLSCHSSWCLSNRAVMTGGQAALTFLVPAGAKFPIKWTAPEAALYGRFTIKSDVWSFGILLTELTTKGRVPYPGKKVLMACLWSLNPSALVALGKS

SEQ ID NO: 833939 - protein, 251 aa, Homo sapiens
MGTWNGTTRVAIKTLKPGTMSPEAFLQEAQVMKKLRHEKLVQLYAVVSEEPIYIVTEYMSKGSLLDFLKGETGKYLRLPQLVDMAAQIASGMAYVERMNYVHRDLRAANILVGENLVCKVADFGLARLIEDNEYTARQGAKFPIKWTAPEAALYGRFTIKSDVWSFGILLTELTTKGRVPYPGMVNREVLDQVERGYRMPCPPECPESLHDLMCQCWRKEPEERPTFEYLQAFLEDYFTSTEPQYQPGENL

SEQ ID NO: 833940 - protein, 592 aa, Homo sapiens
PPPPFLSRSVSPGPESIPAWEPERPGRRLPVPLDVPRSALPCVRLPVSPPARRPRTMGSNKSKPKDASQRRRSLEPAENVHGAGGGAFPASQTPSKPASADGHRGPSAAFAPAAAEPKLFGGFNSSDTVTSPQRAGPLAGGVTTFVALYDYESRTETDLSFKKGERLQIVNNTEGDWWLAHSLSTGQTGYIPSNYVAPSDSIQAEEWYFGKITRRESERLLLNAENPRGTFLVRESETTKGAYCLSVSDFDNAKGLNVKHYKIRKLDSGGFYITSRTQFNSLQQLVAYYSKHADGLCHRLTTVCPTSKPQTQGLAKDAWEIPRESLRLEVKLGQGCFGEVWMGTWNGTTRVAIKTLKPGTMSPEAFLQEAQVMKKLRHEKLVQLYAVVSEEPIYIVTEYMSKGSLLDFLKGETGKYLRLPQLVDMAAQIASGMAYVERMNYVHRDLRAANILVGENLVCKVADFGLARLIEDNEYTARQGAKFPIKWTAPEAALYGRFTIKSDVWSFGILLTELTTKGRVPYPGMVNREVLDQVERGYRMPCPPECPESLHDLMCQCWRKEPEERPTFEYLQAFLEDYFTSTEPQYQPGENL

SEQ ID NO: 833941 - protein, 596 aa, Homo sapiens
MGSNKSKPKDASQRRRSLEPAENVHGAGGGAFPASQTPSKPASADGHRGPSAAFAPAAAEPKLFGGFNSSDTVTSPQRAGPLAGGVTTFVALYDYESRTETDLSFKKGERLQIVNNTEGDWWLAHSLSTGQTGYIPSNYVAPSDSIQAEEWVPSLAASTRRPWTLPVQSASPGLGWEVWLSSAPAISREKHCEWAEAWTVSTILRPPTPRWYFGKITRRESERLLLNAENPRGTFLVRESETTKGAYCLSVSDFDNAKGLNVKHYKIRKLDSGGFYITSRTQFNSLQQLVAYYSKHADGLCHRLTTVCPTSKPQTQGLAKDAWEIPRESLRLEVKLGQGCFGEVWMGTWNGTTRVAIKTLKPGTMSPEAFLQEAQVMKKLRHEKLVQLYAVVSEEPIYIVTEYMSKGSLLDFLKGETGKYLRLPQLVDMAAQIASGMAYVERMNYVHRDLRAANILVGENLVCKVADFGLARLIEDNEYTARQGAKFPIKWTAPEAALYGRFTIKSDVWSFGILLTELTTKGRVPYPGMVNREVLDQVERGYRMPCPPECPESLHDLMCQCWRKEPEERPTFEYLQAFLEDYFTSTEPQYQPGENL

SEQ ID NO: 833942 - protein, 536 aa, Homo sapiens; identical to SEQ ID NO: 833931

SEQ ID NO: 833943 - protein, 408 aa, Homo sapiens
MGSNKSKPKDASQRRRSLEPAENVHGAGGGAFPASQTPSKPASADGHRGPSAAFAPAAAEPKLFGGFNSSDTVTSPQRAGPLAGGVTTFVALYDYESRTETDLSFKKGERLQIVNNTEGDWWLAHSLSTGQTGYIPSNYVAPSDSIQAEEWYFGKITRRESERLLLNAENPRGTFLVRESETTKGAYCLSVSDFDNAKGLNVKHYKIRKLDSGGFYITSRTQFNSLQQLVAYYSKHADGLCHRLTTVCPTSKPQTQGLAKDAWEIPRESLRLEVKLGQGCFGEVWMGTWNGTTRVAIKTLKPGTMSPEAFLQEAQVMKKLRHEKLVQLYAVVSEEPIYIVTEYMSKGSLLDFLKGETGKYLRLPQLVDMAAQVSQPLPPPHTLGPQAPRPIWCSQFWPLECPLQEACL

SEQ ID NO: 833944 - protein, 442 aa, Homo sapiens
MQERISYTPPESPVPSYASSTPLHVPVPRALRMEEDSIRLPAHLRLQPIYWSRDDVAQWLKWAENEFSLRPIDSNTFEMNGKALLLLTKEDFRYRSPHSGDVLYELLQHILKQRKPRILFSPFFHPGNSIHTQPEVILHQNHEEDNCVQRTPRPSVDNVHHNPPTIELLHRSRSPITTNHRPSPDPEQRPLRSPLDNMIRRLSPAERAQGPRPHQENNHQESYPLSVSPMENNHCPASSESHPKPSSPRQESTRVIQLMPSPIMHPLILNPRHSVDFKQSRLSEDGLHREGKPINLSHREDLAYMNHIMVSVSPPEEHAMPIGRIADCRLLWDYVYQLLSDSRYENFIRWEDKESKIFRIVDPNGLARLWGNHKNRTNMTYEKMSRALRHYYKLNIIRKEPGQRLLFRFMKTPDEIMSGRTDRLEHLESQELDEQIYQEDEC

SEQ ID NO: 833945 - protein, 106 aa, Homo sapiens
MQERISYTPPESPVPSYASSTPLHVPVPRALRMEEDSIRLPAHLRLQPIYWSRDDVAQWLKWAENEFSLRPIDSNTFEMNGKALLLLTKEDFRYRSPHSDLDSDVT

SEQ ID NO: 833946 - protein, 452 aa, Homo sapiens
MSETPAQCSIKQERISYTPPESPVPSYASSTPLHVPVPRALRMEEDSIRLPAHLRLQPIYWSRDDVAQWLKWAENEFSLRPIDSNTFEMNGKALLLLTKEDFRYRSPHSGDVLYELLQHILKQRKPRILFSPFFHPGNSIHTQPEVILHQNHEEDNCVQRTPRPSVDNVHHNPPTIELLHRSRSPITTNHRPSPDPEQRPLRSPLDNMIRRLSPAERAQGPRPHQENNHQESYPLSVSPMENNHCPASSESHPKPSSPRQESTRVIQLMPSPIMHPLILNPRHSVDFKQSRLSEDGLHREGKPINLSHREDLAYMNHIMVSVSPPEEHAMPIGRIADCRLLWDYVYQLLSDSRYENFIRWEDKESKIFRIVDPNGLARLWGNHKNRTNMTYEKMSRALRHYYKLNIIRKEPGQRLLFRFMKTPDEIMSGRTDRLEHLESQELDEQIYQEDEC

SEQ ID NO: 833947 - protein, 183 aa, Homo sapiens
MSETPAQCSIKQERISYTPPESPVPSYASSTPLHVPVPRALRMEEDSIRLPAHLRLQPIYWSRDDVAQWLKWAENEFSLRPIDSNTFEMNGKALLLLTKEDFRYRSPHSGDVLYELLQHILKQRKPRILFSPFFHPGNSIHTQPEVILHQNHEEEALQRPVASDFEPQGLSEAARWNSKENLL

SEQ ID NO: 833948 - protein, 191 aa, Homo sapiens
NKYGRRSKFGMKGPVAVISGEEDSASPLHHINHGITTPSSLDAGPDTVVIGMTRIPVIENPQYFRQGHNCHKPDTYCRLLWDYVYQLLSDSRYENFIRWEDKESKIFRIVDPNGLARLWGNHKNRTNMTYEKMSRALRHYYKLNIIRKEPGQRLLFRFMKTPDEIMSGRTDRLEHLESQELDEQIYQEDEC

SEQ ID NO: 833949 - protein, 211 aa, Homo sapiens
MTQEPFREELAYDRMPTLERGRQDPASYAPDAKPSDLQLSKRLPPCFSHKTWVFSVLMGCIPSAIVSFTVSRRNANVIPNFQILFVSTFAVTTTCLIWFGCKLVLNPSAININFNLILLLLLELLMAATVIIAARSSEEDCKKKKGSMSDSANILDEVPFPARVLKSYSVVEVIAGISAVLGGIIALNVDDSVSGPHLSVTFFWILVAGRE

SEQ ID NO: 833950 - protein, 358 aa, Homo sapiens
MTQEPFREELAYDRMPTLERGRQDPASYAPDAKPSDLQLSKRLPPCFSHKTWVFSVLMGSCLLVTSGFSLYLGNVFPAEMDYLRCAAGSCIPSAIVSFTVSRRNANVIPNFQILFVSTFAVTTTCLIWFGCKLVLNPSAININFNLILLLLLELLMAATVIIAARSSEEDCKKKKGSMSDSANILDEVPFPARVLKSYSVVEVIAGISAVLGGIIALNVDDSVSGPHLSVTFFWILVAVEVLIAISSLTSPLLFTASGYLSFSIMRIVEMFKDYPPAIKPSYDVLLLLLLLVLLLQAGLNTGTAIQCVRFKVSARLQGASWDTQNGPQERLAGEVARSPLKEFDKEKAWRAVVVQMAQ

SEQ ID NO: 833951 - protein, 347 aa, Homo sapiens
MTQEPFREELAYDRMPTLERGRQDPASYAPDAKPSDLQLSKRLPPCFSHKTWVFSVLMGCIPSAIVSFTVSRRNANVIPNFQILFVSTFAVTTTCLIWFGCKLVLNPSAININFNLILLLLLELLMAATVIIAARSSEEDCKKKKGSMSDSANILDEVPFPARVLKSYSVVEVIAGISAVLGGIIALNVDDSVSGPHLSVTFFWILVACFPSAIASHVAAECPSKCLVEVLIAISSLTSPLLFTASGYLSFSIMRIVEMFKDYPPAIKPSYDVLLLLLLLVLLLQAGLNTGTAIQCVRFKVSARLQGASWDTQNGPQERLAGEVARSPLKEFDKEKAWRAVVVQMAQ

SEQ ID NO: 833952 - protein, 179 aa, Homo sapiens
MVVEVIAGISAVLGGIIALNVDDSVSGPHLSVTFFWILVACFPSAIASHVAAECPSKCLVEVLIAISSLTSPLLFTASGYLSFSIMRIVEMFKDYPPAIKPSYDVLLLLLLLVLLLQAGLNTGTAIQCVRFKVSARLQGASWDTQNGPQERLAGEVARSPLKEFDKEKAWRAVVVQMAQ

SEQ ID NO: 833953 - protein, 377 aa, Homo sapiens
MTQEPFREELAYDRMPTLERGRQDPASYAPDAKPSDLQLSKRLPPCFSHKTWVFSVLMGSCLLVTSGFSLYLGNVFPAEMDYLRCAAGSCIPSAIVSFTVSRRNANVIPNFQILFVSTFAVTTTCLIWFGCKLVLNPSAININFNLILLLLLELLMAATVIIAARSSEEDCKKKKGSMSDSANILDEVPFPARVLKSYSVVEVIAGISAVLGGIIALNVDDSVSGPHLSVTFFWILVACFPSAIASHVAAECPSKCLVEVLIAISSLTSPLLFTASGYLSFSIMRIVEMFKDYPPAIKPSYDVLLLLLLLVLLLQAGLNTGTAIQCVRFKVSARLQGASWDTQNGPQERLAGEVARSPLKEFDKEKAWRAVVVQMAQ

SEQ ID NO: 833954 - protein, 377 aa, Homo sapiens; identical to SEQ ID NO: 833953

SEQ ID NO: 833955 - protein, 377 aa, Homo sapiens; identical to SEQ ID NO: 833953

SEQ ID NO: 833956 - protein, 241 aa, Homo sapiens
MTQEPFREELAYDRMPTLERGRQDPASYAPDAKPSDLQLSKRLPPCFSHKTWVFSVLMGSCLLVTSGFSLYLGNVFPAEMDYLRCAAGSCIPSAIVSFTVSRRNANVIPNFQILFVSTFAVTTTCLIWFGCKLVLNPSAININFNLILLLLLELLMAATVIIAARSSEEDCKKKKGSMSDSANILDEVPFPARVLKSYSVVEVIAGISAVLGGIIALNVDDSVSGPHLSVTFFWILVAGRE

SEQ ID NO: 833957 - protein, 43 aa, Homo sapiens
MTQEPFREELAYDRMPTLERGRQDPASYAPDAKPSDLQLSKRL

SEQ ID NO: 833958 - protein, 377 aa, Homo sapiens; identical to SEQ ID NO: 833953

SEQ ID NO: 833959 - protein, 377 aa, Homo sapiens; identical to SEQ ID NO: 833953

SEQ ID NO: 833960 - protein, 163 aa, Homo sapiens
ATETENSHGCPPKRVCDRENDSLQCFPSAIASHVAAECPSKCLVEVLIAISSLTSPLLFTASGYLSFSIMRIVEMFKDYPPAIKPSYDVLLLLLLLVLLLQAGLNTGTAIQCVRFKVSARLQGASWDTQNGPQERLAGEVARSPLKEFDKEKAWRAVVVQMAQ

SEQ ID NO: 833961 - protein, 377 aa, Homo sapiens; identical to SEQ ID NO: 833953

SEQ ID NO: 833962 - protein, 377 aa, Homo sapiens; identical to SEQ ID NO: 833953

SEQ ID NO: 833963 - protein, 275 aa, Homo sapiens
MTQEPFREELAYDRMPTLERGRQDPASYAPDAKPSDLQLSKRLPPCFSHKTWVFSVLMGSCLLVTSGFSLYLGNVFPAEMDYLRCAAGSCIPSAIVSFTVSRRNANVIPNFQILFVSTFAVTTTCLIWFGCKLVLNPSAININFNLILLLLLELLMAATVIIAARSSEEDCKKKKGSMSDSANILDEVPFPARVLKSYSVVEVIAGISAVLGGIIALNVDDSVSGPHLSVTFFWILVALERFCWLALSYFLILERLKNPEKWGLKELSLSVYIFV

SEQ ID NO: 833964 - protein, 163 aa, Homo sapiens; identical to SEQ ID NO: 833960

SEQ ID NO: 833965 - protein, 61 aa, Homo sapiens
MLGVAYEAPSLATGYGAYLAQPLLREVLEKQPVLSQTEARDLVERCMRVLYYRDAVLTPVS

SEQ ID NO: 833966 - protein, 335 aa, Homo sapiens
KLRRPPVCSKGWTVMAARRGALIVLEGVDRAGKSTQSRKLVEALCAAGHRAELLRFPERSTEIGKLLSSYLKKKSDVEDHSVHLLFSANRWEQVPLIKEKLSQGVTLVVDRYAFSGVAFTGAKENFSLDWCKQPDVGLPKPDLVLFLQLQLADAAKRGAFGHERYENGAFQERALRCFHQLMKDTTLNWKMVDASKSIEAVHEELRVLSEDAIRTATEKPLGELMEVTQGCPLETPLPAVPREVGDSRKAPSPAEIQTPQLQELFPGSRDLQAASSAPELGCTGDPRGGDLGSVDMSRAMEQSPALSPVLMALCCIFLLKFSDNSEQFHCDHCKW

SEQ ID NO: 833967 - protein, 152 aa, Homo sapiens
MLSMLRAAAWKGLCMGRRPFFPGCQARQEPTGNAHHGGSLLHMFFFYPINLCTFDDFDIIFASLIPRVETVSGAVVYARGPVAVRLSSHRVCLVSARGRAVCSIACSFRLGDECFDPARSSAKCIHAVVQQPLDHTALWFMFEITDFKCHVH

SEQ ID NO: 833968 - protein, 75 aa, Homo sapiens
RRRLRSGTAPNQQQPLRWPGNEKGRKMVAAKKTKKSLESINSRLQLVMKSGKYVLGYKQTLKMIRQGKAKIGHSR

SEQ ID NO: 833969 - protein, 93 aa, Homo sapiens
MRKILQSVHTWLSLIQVTLTIIEKRCQNRLVKSKTFSPSKISAGKPLNLGKVSRVDENLLAVKDEQEDKKTETHNEKERMRREMYGEEGRRGG

SEQ ID NO: 833970 - protein, 106 aa, Homo sapiens
MRGIKRCIEALLSASSRHGIPQKPQPLVSLTGTGLTLPHSGARNASLFAFGPNWGALPSRTVPQVGTKLRLVVARAQEAAGKKCTLPSFNLNCPQYLRAQTTECEG

SEQ ID NO: 833971 - protein, 73 aa, Homo sapiens
MYVTGAPVAYEPVPRTQFSLFPRGDRTGPVSPYNGEAIKFRNKPEFYPGFRHSWAQKDTRHTKTKTPTQQTRV

SEQ ID NO: 833972 - protein, 90 aa, Homo sapiens
TASNAARVTGGWDNLLAVIPGGSSTPLIPKSVCETVLMDFDALVQAQTGLGTAAALDAVTASNALGAVPLLRQEDGGRKEDEKVAGVDQL

SEQ ID NO: 833973 - protein, 74 aa, Homo sapiens
MYVPCVFILGPDPPAPARLAVGWLLACPPCMRFALSLQAWHIASLHTPRALGPQAWDPVTMRVFFAHSVRLQWE

SEQ ID NO: 833974 - protein, 83 aa, Homo sapiens
MNDRSSRRRTMKDDETSRSPFLDEAPLTHDLFAEPSGEIRDLGGWSRPGLMKGQTSAWSGESVRALEDREKDPGAVTISSSDE

SEQ ID NO: 833975 - protein, 61 aa, Homo sapiens; identical to SEQ ID NO: 833965

SEQ ID NO: 833976 - protein, 106 aa, Homo sapiens; identical to SEQ ID NO: 833970

SEQ ID NO: 833977 - protein, 269 aa, Homo sapiens
ARGVGKRARQLNDKSVEDGWGPAPGGGGARLRAAGRVRTAEAAGLVPALQWVICVSQPQKTSEMAANKSKGQSSLALHKVIMVGSGGVGKSALTLQFMYDEFVEDYEPTKADSYRKKVVLDGEEVQIDILDTAGQEDYAAIRDNYFRSGEGFLLVFSITEHESFTATAEFREQILRVKAEEDKIPLLVVGNKSDLEERRQVPVEEARSKAEEWGVQYVETSAKTRANVDKVFFDLMREIRTKKMSENKDKNGKKSSKNKKSFKERCCLL

SEQ ID NO: 833978 - protein, 206 aa, Homo sapiens
MAANKSKGQSSLALHKVIMVGSGGVGKSALTLQFMYDEFVEDYEPTKADSYRKKVVLDGEEVQIDILDTAGQEDYAAIRDNYFRSGEGFLLVFSITEHESFTATAEFREQILRVKAEEDKIPLLVVGNKSDLEERRQVPVEEARSKAEEWGVQYVETSAKTRANVDKVFFDLMREIRTKKMSENKDKNGKKSSKNKKSFKERCCLL

SEQ ID NO: 833979 - protein, 195 aa, Homo sapiens
MTRNVSKSLAYDKKKYTANKKVEGILEFVEDYEPTKADSYRKKVVLDGEEVQIDILDTAGQEDYAAIRDNYFRSGEGFLLVFSITEHESFTATAEFREQILRVKAEEDKIPLLVVGNKSDLEERRQVPVEEARSKAEEWGVQYVETSAKTRANVDKVFFDLMREIRTKKMSENKDKNGKKSSKNKKSFKERCCLL

SEQ ID NO: 833980 - protein, 113 aa, Homo sapiens
FGMRYQSEVGGGGTGPSLQWVICVSQPQKTSEMAANKSKGQSSLALHKVIMVGSGGVGKSALTLQFMYDEFVEDYEPTKADSYRKKVVLDGEEVQIDILDTAGQEDYAAIRDK

SEQ ID NO: 833981 - protein, 269 aa, Homo sapiens; identical to SEQ ID NO: 833977

SEQ ID NO: 833982 - protein, 269 aa, Homo sapiens; identical to SEQ ID NO: 833977

SEQ ID NO: 833983 - protein, 112 aa, Homo sapiens
ARGVGKRARQLNDKSVEDGWGPAPGGGGARLRAAGRVRTAEAAGLVPALQWVICVSQPQKTSEMAANKSKGQSSLALHKVNACVCLISITAHGGLVSLLLSVTHTLPKDVMS

SEQ ID NO: 833984 - protein, 404 aa, Homo sapiens
RDLSITESTSGSTYHTAVPWRGGAGAGRSRKGEAEQGRREPIGLAARGGGGGVNARDPNTRAGRTLQPRRSAAFRRGAGEPPPHLRTPRLRGPDPPASPAPPSQGERGDGCREARATSPSHFSFSPRAPPVFPLSPLITAGWLGEEGRWPRRSLGGRLPLSRQPPWEPEDGGGSSGRPRGGGAEIGGAERGSRERQRPVVAHQNRNQRQPHGHLSRPFLLEPARGACSRDPFLSASPRLPRSRSLGGAVGSVASGARAAQSPFSIPNSSSGPYGSQDSVHSSPEDGGGGRDRPVGGSPGGPRLVIGSLPAHLSPHMFGGFKCPVCSKFVSSDEMDLHLVMCLTKPRITYNEDVLSKDAGECAICLEELQQGDTIARLPCLCIYHKGCIDEWFEVNRSCPEHPSD

SEQ ID NO: 833985 - protein, 242 aa, Homo sapiens
MGAKQSGPAAANGRTRAYSGSDLPSSSSGGANGTAGGGGGARAAAAGRFPAQVPSAHQPSASGGAAAAAAAPAAPAAPRSRSLGGAVGSVASGARAAQSPFSIPNSSSGPYGSQDSVHSSPEDGGGGRDRPVGGSPGGPRLVIGSLPAHLSPHMFGGFKCPVCSKFVSSDEMDLHLVMCLTKPRITYNEDVLSKDAGECAICLEELQQGDTIARLPCLCIYHKGCIDEWFEVNRSCPEHPSD

SEQ ID NO: 833986 - protein, 157 aa, Homo sapiens
MGAKQSGPAAANGRTRAYSGSDLPSSSSGGANGTAGGGGGARAAAAGRFPAQVPSAHQPSASGGAAAAAAAPAAPAAPRSRSLGGAVGSVASGARAAQSPFSIPNSSSGPYGSQDSVHSSPEDGGGGRDRPVGGSPGGPRLVIGSLPAHLSPHMFGD

SEQ ID NO: 833987 - protein, 242 aa, Homo sapiens; identical to SEQ ID NO: 833985

SEQ ID NO: 833988 - protein, 242 aa, Homo sapiens; identical to SEQ ID NO: 833985

SEQ ID NO: 833989 - protein, 224 aa, Homo sapiens
MGAKQSGPAAANGRTRAYSGSDLPSSSSGGANGTAGGGGGARAAAAGRFPAQVPSAHQPSASGGAAAAAAAPAAPAAPRSRSLGGAVGSVASGARAAQSPFSIPNSSSGPYGSQDSVHSSPEDGGGGRDRPVGGSPGGPRLVIGSLPAHLSPHMFGGFKCPVCSKFVSSDEMDLHLVMCLTKPRITYNEDVLSKDAGECAICLEELQQGDTIARLPCLCIYHKG

SEQ ID NO: 833990 - protein, 154 aa, Homo sapiens
AAAAAPAAPAAPRSRSLGGAVGSVASGARAAQSPFSIPNSSSGPYGSQDSVHSSPEDGGGGRDRPVGGSPGGPRLVIGSLPAHLSPHMFGGTDPSPRTRARSSRGCTWAVAAGYFYPSPFLLLPGRRGLPPGPARVGLHPGRNPALNTGGAATA

SEQ ID NO: 833991 - protein, 115 aa, Homo sapiens
IKTQSLREVKRLILCQGVESRLIPMPFNFKIGRLIIGQNGILSTPAVSCIIRKIKAAGGIILTASHCPGGPGGEFGVKFNVANGVLNGALDVEKVDDEQEQNSSFQETYSSIWEM

SEQ ID NO: 833992 - protein, 331 aa, Homo sapiens
MRPALAVGLVFAGCCSNVIFLELLARKHPGCGNIVTFAQFLFIAVEGFLFEADLGRKPPAIPIRYYAIMVTMFFTVSVVNNYALNLNIAMPLHMIFRSGSLIANMILGIIILKKRYSIFKYTSIALVSVGIFICTFMSAKQVTSQSSLSENDGFQAFVWWLLGIGALTFALLMSARMGIFQETLYKRFGKHSKEALFYNHALPLPGFVFLASDIYDHAVLFNKSELYEIPVIGVTLPIMWFYLLMNIITQYVCIRGVFILTTECASLTVTLVVTLRKFVSLIFSILYFQNPFTLWHWLGTLFVFIGTLMYTEVWNNLGTTKSEPQKDSKKN

SEQ ID NO: 833993 - protein, 280 aa, Homo sapiens
MRPALAVGLVFAGCCSNVIFLELLARKHPGCGNIVTFAQFLFIAVEGFLFEADLGRKPPAIPIRYYAIMVTMFFTVSVVNNYALNLNIAMPLHMIFRSGSLIANMILGIIILKKRYSIFKYTSIALVSVGIFICTFMSAKQVTSQSSLSENDGFQAFVWWLLGIGALTFALLMSARMGIFQETLYKRFGKHSKEALFYNHALPLPGFVFLASDIYDHAVLFNKSELYEIPVIGVTLPIMWFYLLMNIITQSDSYLTGREMSIKCLSSFSGSRPCNFMLQR

SEQ ID NO: 833994 - protein, 212 aa, Homo sapiens
MVTMFFTVSVVNNYALNLNIAMPLHMIFRSGSLIANMILGIIILKKRYSIFKYTSIALVSVGIFICTFMSAKQVTSQSSLSENDGFQAFVWWLLGIGALTFALLMSARMGIFQETLYKRFGKHSKEALFYNHALPLPGFVFLASDIYDHAVLFNKSELYEIPVIGVTLPIMWFYLLMNIITQSDSYLTGREMSIKCLSSFSGSRPCNFMLQR

SEQ ID NO: 833995 - protein, 143 aa, Homo sapiens
MYIVPFCDVEVEYNDGFQAFVWWLLGIGALTFALLMSARMGIFQETLYKRFGKHSKEALFYNHALPLPGFVFLASDIYDHAVLFNKSELYEIPVIGVTLPIMWFYLLMNIITQSDSYLTGREMSIKCLSSFSGSRPCNFMLQR

SEQ ID NO: 833996 - protein, 257 aa, Homo sapiens
MRPALAVGLVFAGCCSNVIFLELLARKHPGCGNIVTFAQFLFIAVEGFLFEADLGRKPPAIPIRYYAIMVTMFFTVSVVNNYALNLNIAMPLHMIFRSGSLIANMILGIIILKKRYSIFKYTSIALVSVGIFICTFMSAKQVTSQSSLSENDGFQAFVWWLLGIGALTFALLMSARMGIFQETLYKRFGKHSKEALFYNHALPLPGFVFLASDIYDHAVLFNKSEPLHPVALAGHLVCLHWDLNVHRGVEQPRDHKK

SEQ ID NO: 833997 - protein, 280 aa, Homo sapiens; identical to SEQ ID NO: 833993

SEQ ID NO: 833998 - protein, 280 aa, Homo sapiens; identical to SEQ ID NO: 833993

SEQ ID NO: 833999 - protein, 280 aa, Homo sapiens; identical to SEQ ID NO: 833993

SEQ ID NO: 834000 - protein, 280 aa, Homo sapiens; identical to SEQ ID NO: 833993

SEQ ID NO: 834001 - protein, 331 aa, Homo sapiens; identical to SEQ ID NO: 833992

SEQ ID NO: 834002 - protein, 626 aa, Homo sapiens
MYQGHMQKSKEQGYGKLSSDEDLEIIVDQKQGKGSRAADKAVAMVMKEIPREESAEEKPLLTMTSQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEDYSLWNRLGATLANGDRSEEAVEAYTRALEIQPGFIRSRYNLGISCINLGAYREAVSNFLTALSLQRKSRNQQQVPHPAISGNIWAALRIALSLMDQPELFQAANLGDLDVLLRAFNLDP

SEQ ID NO: 834003 - protein, 434 aa, Homo sapiens
MAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEDYSLWNRLGATLANGDRSEEAVEAYTRALEIQPGFIRSRYNLGISCINLGAYREAVSNFLTALSLQRKSRNQQQVPHPAISGNIWAALRIALSLMDQPELFQAANLGDLDVLLRAFNLDP

SEQ ID NO: 834004 - protein, 434 aa, Homo sapiens; identical to SEQ ID NO: 834003

SEQ ID NO: 834005 - protein, 624 aa, Homo sapiens
MYQGHMQVVGVTLKKKWHCLQKSDLTLALGKGSRAADKAVAMVMKEIPREESAEEKPLLTMTSQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEDYSLWNRLGATLANGDRSEEAVEAYTRALEIQPGFIRSRYNLGISCINLGAYREAVSNFLTALSLQRKSRNQQQVPHPAISGNIWAALRIALSLMDQPELFQAANLGDLDVLLRAFNLDP

SEQ ID NO: 834006 - protein, 591 aa, Homo sapiens
MYQGHMQKSKEQGYGKLSSDEDLEIIVDQKQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEDYSLWNRLGATLANGDRSEEAVEAYTRALEIQPGFIRSRYNLGISCINLGAYREAVSNFLTALSLQRKSRNQQQVPHPAISGNIWAALRIALSLMDQPELFQAANLGDLDVLLRAFNLDP

SEQ ID NO: 834007 - protein, 141 aa, Homo sapiens
MIYLGYTFCGWIVLGPYHDKFENLNTVAECLFSLVNGDDMFATFAQIQQKSILVWLFSRLYLYSFISLFIYMILSLFIALITDSYDTIKKFQQNGFPETDLQEFLKECSSKEEYQKESSAFLSCICCRRRKRSDDHLIPIS

SEQ ID NO: 834008 - protein, 48 aa, Homo sapiens
PCVLSSSQHLGTSALGSQKAFIALVCCIRHYSKTATSLSQAGSGAPGP

SEQ ID NO: 834009 - protein, 827 aa, Homo sapiens
MRGCLRLALLCALPWLLLAASPGHPAKSPRQPPAPRRDPFDAARGADFDHVYSGVVNLSTENIYSFNYTSQPDQVTAVRVYVNSSSENLNYPVLVVVRQQKEVLSWQVPLLFQGLYQRSYNYQEVSRTLCPSEATNETGPLQQLIFVDVASMAPLGAQYKLLVTKLKHFQLRTNVAFHFTASPSQPQYFLYKFPKDVDSVIIKVVSEMAYPCSVVSVQNIMCPVYDLDHNVEFNGVYQSMTKKAAITLQKKDFPGEQFFVVFVIKPEDYACGGSFFIQEKENQTWNLQRKKNLEVTIVPSIKESVYVKSSLFSVFIFLSFYLGCLLVGFVHYLRFQRKSIDGSFGSNDGSGNMVASHPIAASTPEGSNYGTIDESSSSPGRQMSSSDGGPPGQSDTDSSVEESDFDTMPDIESDKNIIRTKMFLYLSDLSRKDRRIVSKKYKIYFWNIITIAVFYALPVIQLVITYQTVVNVTGNQDICYYNFLCAHPLGVLSAFNNILSNLGHVLLGFLFLLIVLRRDILHRRALEAKDIFAVEYGIPKHFGLFYAMGIALMMEGVLSACYHVCPNYSNFQFDTSFMYMIAGLCMLKLYQTRHPDINASAYSAYASFAVVIMVTVLGVVFGKNDVWFWVIFSAIHVLASLALSTQIYYMGRFKIDLGIFRRAAMVFYTDCIQQCSRPLYMDRMVLLVVGNLVNWSFALFGLIYRPRDFASYMLGIFICNLLLYLAFYIIMKLRSSEKVLPVPLFCIVATAVMWAAALYFFFQNLSSWEGTPAESREKNRECILLDFFDDHDIWHFLSATALFFSFLVLLTLDDDLDVVRRDQIPVF

SEQ ID NO: 834010 - protein, 445 aa, Homo sapiens [sequence omitted]

SEQ ID NO: 834011 - protein, 827 aa, Homo sapiens; identical to SEQ ID NO: 834009

SEQ ID NO: 834012 - protein, 827 aa, Homo sapiens; identical to SEQ ID NO: 834009

SEQ ID NO: 834013 - protein, 148 aa, Homo sapiens
WAAPFLSAETLTFPPTLLLLLHSRLSLCLSHFLPSPHPPQCTEEGNRVQTHAAPVLRREGKPRREAAMNVDHEVNLLVEEIHRLGSKNADGKLSVKFGVLFRDDKCANLFEALVGTLKAAKRRKIVTYPGELLLQGVHDDVDIILLQD

SEQ ID NO: 834014 - protein, 148 aa, Homo sapiens; identical to SEQ ID NO: 834013

SEQ ID NO: 834015 - protein, 148 aa, Homo sapiens; identical to SEQ ID NO: 834013

SEQ ID NO: 834016 - protein, 129 aa, Homo sapiens
WAAPFLSAETLTFPPTLLLLLHSRLSLCLSHFLPSPHPPQCTEEGNRVQTHAAPVLRREGKPRREAAMNVDHEVNLLVEEIHRLGSKNADGKLSVKFGVLFRDDKCANLFEALVGTLKADDVDIILLQD

SEQ ID NO: 834017 - protein, 148 aa, Homo sapiens; identical to SEQ ID NO: 834013

SEQ ID NO: 834018 - protein, 148 aa, Homo sapiens; identical to SEQ ID NO: 834013

SEQ ID NO: 834019 - protein, 303 aa, Homo sapiens
MSEAGEATTTTTTTLPQAPTEAAAAAPQDPAPKSPVGSGAPQAAAPAPAAHVAGNPGGDAAPAATGTAAAASLATAAGSEDAEKKVLATKVLGTVKWFNVRNGYGFINRNDTKEDVFVHQTAIKKNNPRKYLRSVGDGETVEFDVVEGEKGAEAANVTGPDGVPVEGSRYAADRRRYRRGYYGRRRGPPRNAGEIGEMKDGVPEGAQLQGPVHRNPTYRPRYRSRGPPRPRPAPAVGEAEDKENQQATSGPNQPSVRRGYRRPYNYRRRPRPPNAPSQDGKEAKAGEAPTENPAPPTQQSSAE

SEQ ID NO: 834020 - protein, 121 aa, Homo sapiens
SAVKKVLATKVLGTVKWFNVRNGYGFINRNDTKEDVFVHQTAIKKNNPRKYLRSVGDGETVEFDVVEGEKGAEAANVTGPDGVPVEGSRYAADRRRYRRGYYGRRRGPPRNVRCLCYLTSD

SEQ ID NO: 834021 - protein, 68 aa, Homo sapiens
DSIRIELGTDSILTGPNQPSVRRGYRRPYNYRRRPRPPNAPSQDGKEAKAGEAPTENPAPPTQQSSAE

SEQ ID NO: 834022 - protein, 372 aa, Homo sapiens
MSEAGEATTTTTTTLPQAPTEAAAAAPQDPAPKSPVGSGAPQAAAPAPAAHVAGNPGGDAAPAATGTAAAASLATAAGSEDAEKKVLATKVLGTVKWFNVRNGYGFINRNDTKEDVFVHQTAIKKNNPRKYLRSVGDGETVEFDVVEGEKGAEAANVTGPDGVPVEGSRYAADRRRYRRGYYGRRRGPPRNYAGEEEEEGSGSSEGFDPPATDRQFSGARNQLRRPQYRPQYRQRRFPPYHVGQTFDRRSRVLPHPNRIQAGEIGEMKDGVPEGAQLQGPVHRNPTYRPRYRSRGPPRPRPAPAVGEAEDKENQQATSGPNQPSVRRGYRRPYNYRRRPRPPNAPSQDGKEAKAGEAPTENPAPPTQQSSAE

SEQ ID NO: 834023 - protein, 372 aa, Homo sapiens; identical to SEQ ID NO: 834022

SEQ ID NO: 834024 - protein, 118 aa, Homo sapiens [sequence omitted]

SEQ ID NO: 834025 - protein, 118 aa, Homo sapiens [sequence omitted]

SEQ ID NO: 834026 - protein, 394 aa, Homo sapiens
MSEAGEATTTTTTTLPQAPTEAAAAAPQDPAPKSPVGSGAPQAAAPAPAAHVAGNPGGDAAPAATGTAAAASLATAAGSEDAEKKVLATKVLGTVKWFNVRNGYGFINRNDTKEDVFVHQHPVLLMWFLLSVCLEPIWLLAWTAIKKNNPRKYLRSVGDGETVEFDVVEGEKGAEAANVTGPDGVPVEGSRYAADRRRYRRGYYGRRRGPPRNYAGEEEEEGSGSSEGFDPPATDRQFSGARNQLRRPQYRPQYRQRRFPPYHVGQTFDRRSRVLPHPNRIQAGEIGEMKDGVPEGAQLQGPVHRNPTYRPRYRSRGPPRPRPAPAVGEAEDKENQQATSGPNQPSVRRGYRRPYNYRRRPRPPNAPSQDGKEAKAGEAPTENPAPPTQQSSAE

SEQ ID NO: 834027 - protein, 265 aa, Homo sapiens
MVQRQKWIWIYKSTAIKKNNPRKYLRSVGDGETVEFDVVEGEKGAEAANVTGPDGVPVEGSRYAADRRRYRRGYYGRRRGPPRNYAGEEEEEGSGSSEGFDPPATDRQFSGARNQLRRPQYRPQYRQRRFPPYHVGQTFDRRSRVLPHPNRIQAGEIGEMKDGVPEGAQLQGPVHRNPTYRPRYRSRGPPRPRPAPAVGEAEDKENQQATSGPNQPSVRRGYRRPYNYRRRPRPPNAPSQDGKEAKAGEAPTENPAPPTQQSSAE

SEQ ID NO: 834028 - protein, 266 aa, Homo sapiens [sequence omitted]

SEQ ID NO: 834029 - protein, 259 aa, Homo sapiens
MFLFSFQTAIKKNNPRKYLRSVGDGETVEFDVVEGEKGAEAANVTGPDGVPVEGSRYAADRRRYRRGYYGRRRGPPRNYAGEEEEEGSGSSEGFDPPATDRQFSGARNQLRRPQYRPQYRQRRFPPYHVGQTFDRRSRVLPHPNRIQAGEIGEMKDGVPEGAQLQGPVHRNPTYRPRYRSRGPPRPRPAPAVGEAEDKENQQATSGPNQPSVRRGYRRPYNYRRRPRPPNAPSQDGKEAKAGEAPTENPAPPTQQSSAE

SEQ ID NO: 834030 - protein, 182 aa, Homo sapiens
MYAGEEEEEGSGSSEGFDPPATDRQFSGARNQLRRPQYRPQYRQRRFPPYHVGQTFDRRSRVLPHPNRIQAGEIGEMKDGVPEGAQLQGPVHRNPTYRPRYRSRGPPRPRPAPAVGEAEDKENQQATSGPNQPSVRRGYRRPYNYRRRPRPPNAPSQDGKEAKAGEAPTENPAPPTQQSSAE

SEQ ID NO: 834031 - protein, 194 aa, Homo sapiens
MTPKKMYLYIQTAIKKNNPRKYLRSVGDGETVEFDVVEGEKGAEAANVTGPDGVPVEGSRYAADRRRYRRGYYGRRRGPPRNAGEIGEMKDGVPEGAQLQGPVHRNPTYRPRYRSRGPPRPRPAPAVGEAEDKENQQATSGPNQPSVRRGYRRPYNYRRRPRPPNAPSQDGKEAKAGEAPTENPAPPTQQSSAE

SEQ ID NO: 834032 - protein, 372 aa, Homo sapiens; identical to SEQ ID NO: 834022

SEQ ID NO: 834033 - protein, 372 aa, Homo sapiens; identical to SEQ ID NO: 834022

SEQ ID NO: 834034 - protein, 196 aa, Homo sapiens
MSEAGEATTTTTTTLPQAPTEAAAAAPQDPAPKSPVGSGAPQAAAPAPAAHVAGNPGGDAAPAATGTAAAASLATAAGSEDAEKKVLATKVLGTVKWFNVRNGYGFINRNDTKEDVFVHQTAIKKNNPRKYLRSVGDGETVEFDVVEGEKVRGNCGWVSKRPRQVKHQLRTLLHPPSRAVLSNTRLLRHLHHRQVT

SEQ ID NO: 834035 - protein, 141 aa, Homo sapiens
MSEAGEATTTTTTTLPQAPTEAAAAAPQDPAPKSPVGSGAPQAAAPAPAAHVAGNPGGDAAPAATGTAAAASLATAAGSEDAEKKVLATKVLGTVKWFNVRNGYGFINRNDTKEDVFVHQAKAGEAPTENPAPPTQQSSAE

SEQ ID NO: 834036 - protein, 372 aa, Homo sapiens; identical to SEQ ID NO: 834022

SEQ ID NO: 834037 - protein, 66 aa, Homo sapiens
ELVYGDLYESDVQAAVCVAVVQLETVDSKRRRPRPPNAPSQDGKEAKAGEAPTENPAPPTQQSSAE

SEQ ID NO: 834038 - protein, 372 aa, Homo sapiens; identical to SEQ ID NO: 834022

SEQ ID NO: 834039 - protein, 372 aa, Homo sapiens; identical to SEQ ID NO: 834022

SEQ ID NO: 834040 - protein, 303 aa, Homo sapiens; identical to SEQ ID NO: 834019

SEQ ID NO: 834041 - protein, 214 aa, Homo sapiens
MSEAGEATTTTTTTLPQAPTEAAAAAPQDPAPKSPVGSGAPQAAAPAPAAHVAGNPGGDAAPAATGTAAAASLATAAGSEDAEKKVLATKVLGTVKWFNVRNGYGFINRNDTKEDVFVHQTAIKKNNPRKYLRSVGDGETVEFDVVEGEKGAEAANVTGPDGVPVEGSRYAADRRRYRRGYYGRRRGPPRNLGRRTFPFSDNPLLGDRHCPCSC

SEQ ID NO: 834042 - protein, 131 aa, Homo sapiens
MSEAGEATTTTTTTLPQAPTEAAAAAPQDPAPKSPVGSGAPQAAAPAPAAHVAGNPGGDAAPAATGTAAAASLATAAGSEDAEKKVLATKVLGTVKWFNVRNGYGFINRNDTKEDVFVHQVRGIINTTFAM

SEQ ID NO: 834043 - protein, 83 aa, Homo sapiens
GNRARIPSVNGPPVEVVIRTEGVASPVSATARFLFFFLVFTVLVIYILKQEILIPHGENPNQRNLKYIVNAFFSVFVHFGCWC

SEQ ID NO: 834044 - protein, 372 aa, Homo sapiens; identical to SEQ ID NO: 834022

SEQ ID NO: 834045 - protein, 372 aa, Homo sapiens; identical to SEQ ID NO: 834022

SEQ ID NO: 834046 - protein, 303 aa, Homo sapiens; identical to SEQ ID NO: 834019

SEQ ID NO: 834047 - protein, 200 aa, Homo sapiens
MSEAGEATTTTTTTLPQAPTEAAAAAPQDPAPKSPVGSGAPQAAAPAPAAHVAGNPGGDAAPAATGTAAAASLATAAGSEDAEKKVLATKVLGTVKWFNVRNGYGFINRNDTKEDVFVHQTAIKKNNPRKYLRSVGDGETVEFDVVEGEKGAEAANVTGPDGVPVEGSRYAADRRRYRRGYYGRRRGPPRNISDVWFNRR

SEQ ID NO: 834048 - protein, 118 aa, Homo sapiens [sequence omitted]

SEQ ID NO: 834049 - protein, 292 aa, Homo sapiens
SAVKKVLATKVLGTVKWFNVRNGYGFINRNDTKEDVFVHQTAIKKNNPRKYLRSVGDGETVEFDVVEGEKGAEAANVTGPDGVPVEGSRYAADRRRYRRGYYGRRRGPPRNYAGEEEEEGSGSSEGFDPPATDRQFSGARNQLRRPQYRPQYRQRRFPPYHVGQTFDRRSRVLPHPNRIQAGEIGEMKDGVPEGAQLQGPVHRNPTYRPRYRSRGPPRPRPAPAVGEAEDKENQQATSGPNQPSVRRGYRRPYNYRRRPRPPNAPSQDGKEAKAGEAPTENPAPPTQQSSAE

SEQ ID NO: 834050 - protein, 372 aa, Homo sapiens
MSEAGEATTTTTTTLPQAPTEAAAAAPQDPAPKSPVGSGAPQAAAPAPAAHVAGNPGGDAAPAATGTAAAASLATAAGSEDAEKKVLATKVLGTVKWFNVRNGYGFINRNDTKEMYLYIQTAIKKNNPRKYLRSVGDGETVEFDVVEGEKGAEAANVTGPDGVPVEGSRYAADRRRYRRGYYGRRRGPPRNYAGEEEEEGSGSSEGFDPPATDRQFSGARNQLRRPQYRPQYRQRRFPPYHVGQTFDRRSRVLPHPNRIQAGEIGEMKDGVPEGAQLQGPVHRNPTYRPRYRSRGPPRPRPAPAVGEAEDKENQQATSGPNQPSVRRGYRRPYNYRRRPRPPNAPSQDGKEAKAGEAPTENPAPPTQQSSAE

SEQ ID NO: 834051 - protein, 372 aa, Homo sapiens; identical to SEQ ID NO: 834022

SEQ ID NO: 834052 - protein, 205 aa, Homo sapiens
GLRGEYFCEAYWRLGFEAQLGRPVYAGEEEEEGSGSSEGFDPPATDRQFSGARNQLRRPQYRPQYRQRRFPPYHVGQTFDRRSRVLPHPNRIQAGEIGEMKDGVPEGAQLQGPVHRNPTYRPRYRSRGPPRPRPAPAVGEAEDKENQQATSGPNQPSVRRGYRRPYNYRRRPRPPNAPSQDGKEAKAGEAPTENPAPPTQQSSAE

SEQ ID NO: 834053 - protein, 372 aa, Homo sapiens; identical to SEQ ID NO: 834022

SEQ ID NO: 834054 - protein, 372 aa, Homo sapiens; identical to SEQ ID NO: 834022

SEQ ID NO: 834055 - protein, 249 aa, Homo sapiens
MSEAGEATTTTTTTLPQAPTEAAAAAPQDPAPKSPVGSGAPQAAAPAPAAHVAGNPGGDAAPAATGTAAAASLATAAGSEDAEKKVLATKVLGTVKWFNVRNGYGFINRNDTKEDVFVHQTAIKKNNPRKYLRSVGDGETVEFDVVEGEKGAEAANVTGPDGVPVEGSRYAADRRRYRRGYYGRRRGPPRNAGEIGEMKDGVPEGAQLQGPVHRNPTYRPRYRSRGPPRPRPAPAVGEAEDKENQQATR

SEQ ID NO: 834056 - protein, 68 aa, Homo sapiens; identical to SEQ ID NO: 834021

SEQ ID NO: 834057 - protein, 163 aa, Homo sapiens
IPDTPSPTVSVITITSDTDEEEEQYTPPPSTVSKQKEKTSSAVSQVHDSPYSDSSSNTSPYSVQQLLGTNNANAFDTKGSLENHCTGNPRTIIVPPLKTQASEVLLECDSLVPVKQPVTTRRPYNYRRRPRPPNAPSQDGKEAKAGEAPTENPAPPTQQSSAE

SEQ ID NO: 834058 - protein, 79 aa, Homo sapiens
VRHGRQTNDGPVRSHKVPKVLCQTLITGIKIPHPHMGHLKMAKRPRQVKHQLRTLLHPPSRAVLSNTRLLRHLHHRQVT

SEQ ID NO: 834059 - protein, 300 aa, Homo sapiens
MSEAGEATTTTTTTLPQAPTEAAAAAPQDPAPKSPVGSGAPQAAAPAPAAHVAGNPGGDAAPAATGTAAAASLATAAGSEDAEKKVLATKVLGTVKWFNVRNGYGFINRNDTKEDVFVHQTAIKKNNPRKYLRSVGDGETVEFDVVEGEKGAEAANVTGPDGVPVEGSRYAADRRRYRRGYYGRRRGPPRNYAGEEEEEGSGSSEGFDPPATDRQFSGARNQLRRPQYRPQYRQRRFPPYHVGQTFDRRSRVLPHPNRIQAGEIGEMKDGVPEGAQLQGPVHRNPTYRPRYRRHLSQPQK

SEQ ID NO: 834060 - protein, 156 aa, Homo sapiens
MSEAGEATTTTTTTLPQAPTEAAAAAPQDPAPKSPVGSGAPQAAAPAPAAHVAGNPGGDAAPAATGTAAAASLATAAGSEDAEKKVLATKVLGTVKWFNVRNGYGFINRNDTKEDVFVHQHPVLLMWFLLSVCLEPIWLLPGLPSRRITHGNICAV

SEQ ID NO: 834061 - protein, 163 aa, Homo sapiens
ARPEGRGRRAARGCKAGGRRLPGPAWAAASAMPLLVEGRRVRLPQSAGDLVRAHPPLEVSGARRGASGRARGEAAGRASAPLTRHRLETWRCWHIRSPGRRLASSPLGVGEFLPSLDFSGLPRRPLSDKGGDGGPERLGDLPKVAQHCGSGTRRDPHSPTGRL

SEQ ID NO: 834062 - protein, 307 aa, Homo sapiens
RAARGAGAAGGPGLQSGGPPPPWACLGGRLRDAAARRGAASAAAAVSRGPRPSPPAFGGSISILGSDDATTCHIVVLRHTGNGATCLTHCDGTDTKAEVPLIMNSIKSFSDHAQCGRLEVHLVGGFSDDRQLSQKLTHQLLSEFDRQEDDIHLVTLCVTELNDREENENHFPVIYGIAVNIKTAEIYRASFQDRGPEEQLRAARTLAGGPMISIYDAETEQLRIGPYSWTPFPHVDFWLHQDDKQILENLSTSPLAEPPHFVEHIRSTLMFLKKHPSPAHTLFPGNKALLYKKNEDGLWEKISSPGS

SEQ ID NO: 834063 - protein, 205 aa, Homo sapiens
MNSIKSFSDHAQCGRLEVHLVGGFSDDRQLSQKLTHQLLSEFDRQEDDIHLVTLCVTELNDREENENHFPVIYGIAVNIKTAEIYRASFQDRGPEEQLRAARTLAGGPMISIYDAETEQLRIGPYSWTPFPHVDFWLHQDDKQILENLSTSPLAEPPHFVEHIRSTLMFLKKHPSPAHTLFPGNKALLYKKNEDGLWEKISSPGS

SEQ ID NO: 834064 - protein, 311 aa, Homo sapiens
MPLLVDVREMLSRDPVAASEHCCVFPVEERARLLRGQSVQQVGPQGLLYVQQRELAVTSPKDGSISILGSDDATTCHIVVLRHTGNGATCLTHCDGTDTKAEVPLIMNSIKSFSDHAQCGRLEVHLVGGFSDDRQLSQKLTHQLLSEFDRQEDDIHLVTLCVTELNDREENENHFPVIYGIAVNIKTAEIYRASFQDRGPEEQLRAARTLAGGPMISIYDAETEQLRIGPYSWTPFPHVDFWLHQDDKQILENLSTSPLAEPPHFVEHIRSTLMFLKKHPSPAHTLFPGNKALLYKKNEDGLWEKISSPGS

SEQ ID NO: 834065 - protein, 285 aa, Homo sapiens
RAARGAGAAGGPGLQSGGPPPPWACLGGRLRDAAARRGAASAAAAVSRGPRPSPPAFGGNGATCLTHCDGTDTKAEVPLIMNSIKSFSDHAQCGRLEVHLVGGFSDDRQLSQKLTHQLLSEFDRQEDDIHLVTLCVTELNDREENENHFPVIYGIAVNIKTAEIYRASFQDRGPEEQLRAARTLAGGPMISIYDAETEQLRIGPYSWTPFPHVDFWLHQDDKQILENLSTSPLAEPPHFVEHIRSTLMFLKKHPSPAHTLFPGNKALLYKKNEDGLWEKISSPGS

SEQ ID NO: 834066 - protein, 117 aa, Homo sapiens
RAARGAGAAGGPGLQSGGPPPPWACLGGRLRDAAARRGAASAAAAVSRGPRPSPPAFGGSISILGSDDATTCHIVVLRHTGNGATCLTHCDGTDTKAEVPLIMNSIKSFSDHAQCGR

SEQ ID NO: 834067 - protein, 106 aa, Homo sapiens
ARPEGRGRRAARGCKAGGRRLPGPAWAAASAMPLLVEGRRVRLPQSAGDLVRAHPPLEVSGARRGASGRARGEAAGRASAPLTRHRLETWRCWHIRSPGRRLASSP

SEQ ID NO: 834068 - protein, 341 aa, Homo sapiens
ARPEGRGRRAARGCKAGGRRLPGPAWAAASAMPLLVEGRRVRLPQSAGDLVRAHPPLEERARLLRGQSVQQVGPQGLLYVQQRELAVTSPKDGSISILGSDDATTCHIVVLRHTGNGATCLTHCDGTDTKAEVPLIMNSIKSFSDHAQCGRLEVHLVGGFSDDRQLSQKLTHQLLSEFDRQEDDIHLVTLCVTELNDREENENHFPVIYGIAVNIKTAEIYRASFQDRGPEEQLRAARTLAGGPMISIYDAETEQLRIGPYSWTPFPHVDFWLHQDDKQILENLSTSPLAEPPHFVEHIRSTLMFLKKHPSPAHTLFPGNKALLYKKNEDGLWEKISSPGS

SEQ ID NO: 834069 - protein, 391 aa, Homo sapiens
ARPEGRGRRAARGCKAGGRRLPGPAWAAASAMPLLVEGRRVRLPQSAGDLVRAHPPLEVSGARRGASGRARGEAAGRASAPLTRHRLETWRCWHIRSPGRRLASSPLGERARLLRGQSVQQVGPQGLLYVQQRELAVTSPKDGSISILGSDDATTCHIVVLRHTGNGATCLTHCDGTDTKAEVPLIMNSIKSFSDHAQCGRLEVHLVGGFSDDRQLSQKLTHQLLSEFDRQEDDIHLVTLCVTELNDREENENHFPVIYGIAVNIKTAEIYRASFQDRGPEEQLRAARTLAGGPMISIYDAETEQLRIGPYSWTPFPHVDFWLHQDDKQILENLSTSPLAEPPHFVEHIRSTLMFLKKHPSPAHTLFPGNKALLYKKNEDGLWEKISSPGS

SEQ ID NO: 834070 - protein, 262 aa, Homo sapiens
GGTCFLSLTRVFWVTAPFWGSDGATTCNIVVMMHTCNGATCLTHCDGTDTKAEVPLIMNSIKSFSDHAQCGRLEVHLVGGFSDDRQLSQKLTHQLLSEFDRQEDDIHLVTLCVTELNDREENENHFPVIYGIAVNIKTAEIYRASFQDRGPEEQLRAARTLAGGPMISIYDAETEQLRIGPYSWTPFPHVDFWLHQDDKQILENLSTSPLAEPPHFVEHIRSTLMFLKKHPSPAHTLFPGNKALLYKKNEDGLWEKISSPGS

SEQ ID NO: 834071 - protein, 273 aa, Homo sapiens
MRTLAGGPMISIYDAETEQLRIGPYSWTPFPHVNFWLHQDDKQILENLSTSPLAEPPHFVEHIRSTLIMNSIKSFSDHAQCGRLEVHLVGGFSDDRQLSQKLTHQLLSEFDRQEDDIHLVTLCVTELNDREENENHFPVIYGIAVNIKTAEIYRASFQDRGPEEQLRAARTLAGGPMISIYDAETEQLRIGPYSWTPFPHVDFWLHQDDKQILENLSTSPLAEPPHFVEHIRSTLMFLKKHPSPAHTLFPGNKALLYKKNEDGLWEKISSPGS

SEQ ID NO: 834072 - protein, 131 aa, Homo sapiens
RQEDDIHLVTLCVTGKSCHLPKAKMWVSGPFCPQSCSGPKHRHTLLSLLGHHLFRLFLWWDGLPLPLALVHHLPSLSSSAAPSSPRKEGTGSQRSCHPCGRQGAQRRWGGSGDRFCSCQFVQYKPPCLGTG

SEQ ID NO: 834073 - protein, 911 aa, Homo sapiens
MADGGGPKEAPSLRSSPGPAPRVPRAVGPSGGGGETPRTAALALRFDKPIKQAFYNTGAVLFVCLCCGAAVLVYFILEAFLRPLLWAVLCGTFLHPFKSSLTRLGRHWLQRLHRAHTPIVLAALLLPLCFVDYGVEALGEQALRRRRLLLLLGAGGPLLYGLYCLGSYLGVQVLLVHAATLICRGLDYFSSLWIWTLVVGYVLTVSFKWNASTERYLRAVSIPVWIILLFHLASLAGSWRIPVFLVIVFLMSVGTLYEKQNGKESSGAELPGQVISMAASTLANLAISITGYESSSEDQPSTQPAEAVDRGESAPTLSTSPSPSSPSPTSPSPTLGRRRPEIGTFLRKKKTSDIYFVSLVWAIVVMQIWLNLWIVQLLPVPIAVWILKKLVIHFGVVDFLEKRYHVWWGIIESFLKERQGALAPWPIVGLGKFLLKVDSKLWHWLNKKMIIWLEKMLDKIISIFIIFLLVIGTLLLALLLTAKVHQESVHMIEVTSNLINETLANHPEWANWLPEAQVVQRALNSAANNVYQYGREWITHKLHKILGDKVNNTAVIEKQVLELWDRLYHSWFVKNVTHSGRHKGQKLHVSRQNSWLGDILDWQDIVSFVHENIETFLSILESLWIVMSRNVSLLFTTVTTLLTILFYSGTALLNFVLSLIIFLTTLFYLLSSSDEYYKPVKWVISLTPLSQPGPSSNIIGQSVEEAIRGVFDASLKMAGFYGLYTWLTHTMFGINIVFIPSALAAILGAVPFLGTYWAAVPAVLDLWLTQGLGCKAILLLIFHLLPTYFVDTAIYSDISGGGHPYLTGLAVAGGAYYLGLEGAIIGPILLCILVVASNIYSAMLVSPTNSVPTPNQTPWPAQPQRTFRDISERSEIFSKVDVVSSAVIFLRKFKFDSEFSSAVAFCPSSCA

SEQ ID NO: 834074 - protein, 118 aa, Homo sapiens
MEAYPDNFGLLSNIIYFLLQRPSRCNSHCSHPKENPSLPFAVPLIEVTEVYFQYKFDFELRFDIELYCLHNSLKMYPPGLTYRMPGQERTCCGLLCILKHSLRVQSWWFAHLTVVKMA

SEQ ID NO: 834075 - protein, 881 aa, Homo sapiens
PLGGGCGGGTMADGGGPKEAPSLRSSPGPAPRVPRAVGPSGGGGETPRTAALALRFDKPIKQAFYNTGAVLFVCLCCGAAVLVYFILEAFLRPLLWAVLCGTFLHPFKSSLTRLGRHWLQRLHRAHTPIVLAALLLPLCFVDYGVEALGEQALRRRRLLLLLGAGGPLLYGLYCLGSYLGVQVLLVHAATLICRGLDYFSSLWIWTLVVGYVLTVSFKWNASTERYLRAVSIPVWIILLFHLASLAGSWRIPVFLVIVFLMSVGTLYEKQNGKESSGAELPGQVISMAASTLANLAISITGYESSSEDQPSTQPAEAVDRGESAPTLSTSPSPSSPSPTSPSPTLGRRRPEIGTFLRKKKTSDIYFVSLVWAIVVMQIWLNLWIVQLLPVPIAVWILKKLVIHFGVVDFLEKRYHVWWGIIESFLKERQGALAPWPIVGLGKFLLKVDSKMIIWLEKMLDKIISIFIIFLLVIGTLLLALLLTAKVHQESVHMIEVTSNLINETLANHPEWANWLPEAQVVQRALNSAANNVYQYGREWITHKLHKILGDKVNNTAVIEKQVLELWDRLYHSWFVKNVTHSGRHKGQKLHVSRQNSWLGDILDWQDIVSFVHENIETFLSILESLWIVMSRNVSLLFTTVTTLLTILFYSGTALLNFVLSLIIFLTTLFYLLSSSDEYYKPVKWVISLTPLSQPGPSSNIIGQSVEEAIRGVFDASLKMAGFYGLYTWLTHTMFGINIVFIPSALAAILGAVPFLGTYWAAVPAVLDLWLTQGLGCKAILLLIFHLLPTYFVDTAIYSDISGGGHPYLTGLAVAGGAYYLGLEGAIIGPILLCILVVASNIYSAMLVSPTNSVPTPNQTPWPAQPQRTFRDISEDLKSSVG

SEQ ID NO: 834076 - protein, 867 aa, Homo sapiens
PLGGGCGGGTMADGGGPKEAPSLRSSPGPAPRVPRAVGPSGGGGETPRTAALALRFDKPIKQAFYNTGAVLFVCLCCGAAVLVYFILEAFLRPLLWAVLCGTFLHPFKSSLTRLGRHWLQRLHRAHTPIVLAALLLPLCFVDYGVEALGEQALRRRRLLLLLGAGGPLLYGLYCLGSYLGVQVLLVHAATLICRGLDYFSSLWIWTLVVGYVLTVSFKWNASTERYLRAVSIPVWIILLFHLASLAGSWRIPVFLVIVFLMSVGTLYEKQNGKESSGAELPGQVISMAASTLANLAISITGYESSSEDQPSTQPAEAVDRGESAPTLSTSPSPSSPSPTSPSPTLGRRRPEIGTFLRKKKTSDIYFVSLVWAIVVMQIWLNLWIVQLLPVPIAVWILKKLVIHFGVVDFLEKRYHVWWGIIESFLKERQGALAPWPIVGLGKFLLKVDSKMIIWLEKMLDKIISIFIIFLLVIGTLLLALLLTAKVHQESVHMIEVTSNLINETLANHPEWANWLPEAQVVQRALNSAANNVYQYGREWITHKLHKILGDKVNNTAVIEKQVLELWDRLYHSWFVKNVTHSGRHKGQKLHVSRQNSWLGDILDWQDIVSFVHENIETFLSILESLWIVMSRNVSLLFTTVTTLLTILFYSGTALLNFVLSLIIFLTTLFYLLSSSDEYYKPVKWVISLTPLSQPGPSSNIIGQSVEEAIRGVFDASLKMAGFYGLYTWLTHTMFGINIVFIPSALAAILGAVPFLGTYWAAVPAVLDLWLTQGLGCKAILLLIFHLLPTYFVDTAIYSDISGGGHPYLTGLAVAGGAYYLGLEGAIIGPILLCILVVASNIYSAMLVSPTNSVPTPNQTPWPAQPQR

SEQ ID NO: 834077 - protein, 123 aa, Homo sapiens
PNEWLCIPISSCGLMRCVVFFFSFSEAVDRGESAPTLSTSPSPSSPSPTSPSPTLGRRRPEIGTFLRKKKTSDIYFVSLVWAIVVMQIWLNLWIVQLLPVPIAGRYLVKYDLVLSLKIDFFLF

SEQ ID NO: 834078 - protein, 881 aa, Homo sapiens; identical to SEQ ID NO: 834075

SEQ ID NO: 834079 - protein, 881 aa, Homo sapiens; identical to SEQ ID NO: 834075

SEQ ID NO: 834080 - protein, 881 aa, Homo sapiens; identical to SEQ ID NO: 834075

SEQ ID NO: 834081 - protein, 144 aa, Homo sapiens
HPFKSSLTRLGRHWLQRLHRAHTPIVLAALLLPLCFVDYGVEALGEQALRRRRLLLLLGAGGPLLYGLYCLGSYLGVQVLLVHAATLICRGLDYFSSLWVSERQSAPVPRPWSRRSGVQSCSCSSRCRGDEGPHLCCSDRPSPL

SEQ ID NO: 834082 - protein, 271 aa, Homo sapiens
MSYNFVLYLAAFRADVDAATLARIDLERRIESLNEEIAFLKKVHEEEIRELQAQLQEQQVQVEMDMSKPDLTAALRDIRAQYETIAAKNISEAEEWYKSKVSDLTQAANKNNDALRQAKQEMMEYRHQIQSYTCEIDALKGTNDSLMRQMRELEDRFASEASGYQDNIARLEEEIRHLKDEMARHLREYQDLLNVKMALDVEIATYRKLLEGEESRINLPIQTYSALNFRETSPEQRGSEVHTKKTVMIKTIETRDGEVVSEATQQQHEVL

SEQ ID NO: 834083 - protein, 179 aa, Homo sapiens
RSEPVSPAQSQFLPLRASFSRSEPVSPAQSQFLPLRASFYTCEIDALKGTNDSLMRQMRELEDRFASEASGYQDNIARLEEEIRHLKDEMARHLREYQDLLNVKMALDVEIATYRKLLEGEESRINLPIQTYSALNFRETSPEQRGSEVHTKKTVMIKTIETRDGEVVSEATQQQHEVL

SEQ ID NO: 834084 - protein, 403 aa, Homo sapiens
RGGEAGADVRRDTNSADGWGPCLPSPHPLSGRPPARRLLRAPASLARAVTMSQAYSSSQRFLEQQNAALAAEVNRLKGREPTRVAELYEEELRELRRQVEVLTNQRARVDVERDNLLDDLQRLKAKLQEEIQLKEEAENNLAAFRADVDAATLARIDLERRIESLNEEIAFLKKVHEEEIRELQAQLQEQQVQVEMDMSKPDLTAALRDIRAQYETIAAKNISEAEEWYKSKVSDLTQAANKNNDALRQAKQEMMEYRHQIQSYTCEIDALKGTNDSLMRQMRELEDRFASEASGYQDNIARLEEEIRHLKDEMARHLREYQDLLNVKMALDVEIATYRKLLEGEESRINLPIQTYSALNFRETSPEQRGSEVHTKKTVMIKTIETRDGEVVSEATQQQHEVL

SEQ ID NO: 834085 - protein, 179 aa, Homo sapiens; identical to SEQ ID NO: 834083

SEQ ID NO: 834086 - protein, 71 aa, Homo sapiens
EPVPFKRRCWRERRARINLPIQTYSALNFRETSPEQRGSEVHTKKTVMIKTIETRDGEVVSEATQQQHEVL

SEQ ID NO: 834087 - protein, 520 aa, Homo sapiens
RGGEAGADVRRDTNSADGWGPCLPSPHPLSGRPPARRLLRAPASLARAVTMSQAYSSSQRVSSYRRTFGGAPGFPLGSPLSSPVFPRAGFGSKGSSSSVTSRVYQVSRTSGGAGGLGSLRASRLGTTRTPSSYGAGELLDFSLADAVNQEFLTTRTNEKVELQELNDRFANYIEKVRFLEQQNAALAAEVNRLKGREPTRVAELYEEELRELRRQVEVLTNQRARVDVERDNLLDDLQRLKAKLQEEIQLKEEAENNLAAFRADVDAATLARIDLERRIESLNEEIAFLKKVHEEEIRELQAQLQEQQVQVEMDMSKPDLTAALRDIRAQYETIAAKNISEAEEWYKSKVSDLTQAANKNNDALRQAKQEMMEYRHQIQSYTCEIDALKGTNDSLMRQMRELEDRFASEASGYQDNIARLEEEIRHLKDEMARHLREYQDLLNVKMALDVEIATYRKLLEGEESRINLPIQTYSALNFRETSPEQRGSEVHTKKTVMIKTIETRDGEVVSEATQQQHEVL

SEQ ID NO: 834088 - protein, 144 aa, Homo sapiens
MLEKERRGEEAESGPAFFHPRTPHPASVLPSQPLTPPHWPSLVVPNSDIAHPCLVTGHAPATSADPSCEPWLLAVSEPGSCAGWSPGGSGGPVPPTSVTSGTSLWLWRQPQSRVLGYCRARTEPRRPPQPLAQERESQAGSQGD

SEQ ID NO: 834089 - protein, 131 aa, Homo sapiens
TLSSPLLLQHLSHFLSFSQPLTPPHWPSLVVPNSDIAHPCLVTGHAPATSADPSCEPWLLAVSEPGSCAGWSPGGSGGPVPPTSVTSGTSLWLWRQPQSRVLGYCRARTEPRRPPQPLAQERESQAGSQGD

SEQ ID NO: 834090 - protein, 520 aa, Homo sapiens; identical to SEQ ID NO: 834087

SEQ ID NO: 834091 - protein, 520 aa, Homo sapiens; identical to SEQ ID NO: 834087

SEQ ID NO: 834092 - protein, 487 aa, Homo sapiens
RGGEAGADVRRDTNSADGWGPCLPSPHPLSGRPPARRLLRAPASLARAVTMSQAYSSSQRVSSYRRTFGGAPGFPLGSPLSSPVFPRAGFGSKGSSSSVTSRVYQVSRTSGGAGGLGSLRASRLGTTRTPSSYGAGELLDFSLADAVNQEFLTTRTNEKVELQELNDRFANYIEKVRFLEQQNAALAAEVNRLKGREPTRVAELYEEELRELRRQVEVLTNQRARVDVERDNLLDDLQRLKAKLQEEIQLKEEAENNLAAFRADVDAATLARIDLERRIESLNEEIAFLKKVHEEEIRELQAQLQEQQVQVEMDMSKPDLTAALRDIRAQYETIAAKNISEAEEWYKSKVSDLTQAANKNNDALRQAKQEMMEYRHQIQSYTCEIDALKGTNDSLMRQMRELEDRFASEASGYQDNIARLEEEIRHLKDEMARHLREYQDLLNVKMALDVEIATYRKLLEGEESRINLPIQTYSALNFRGECLLAGG

SEQ ID NO: 834093 - protein, 520 aa, Homo sapiens; identical to SEQ ID NO: 834087

SEQ ID NO: 834094 - protein, 520 aa, Homo sapiens; identical to SEQ ID NO: 834087

SEQ ID NO: 834095 - protein, 316 aa, Homo sapiens
RVGLDGEIDPALLSLQQLPVGGNLHIQCHLHVEQVLVLAQMAGHLILEVPDFLLQARNVVLVATGLTGKWCSNSRICLNEEIAFLKKVHEEEIRELQAQLQEQQVQVEMDMSKPDLTAALRDIRAQYETIAAKNISEAEEWYKSKVSDLTQAANKNNDALRQAKQEMMEYRHQIQSYTCEIDALKGTNDSLMRQMRELEDRFASEASGYQDNIARLEEEIRHLKDEMARHLREYQDLLNVKMALDVEIATYRKLLEGEESRINLPIQTYSALNFRETSPEQRGSEVHTKKTVMIKTIETRDGEVVSEATQQQHEVL

SEQ ID NO: 834096 - protein, 520 aa, Homo sapiens; identical to SEQ ID NO: 834087

SEQ ID NO: 834097 - protein, 120 aa, Homo sapiens
TDTHTPDKSHTLNTHTPRMHTPRVHTHITIHRAQSFYLLLIPSRRFLPHPHISNLLPVSLAFPSSLGMVIRRVQHAEEPKTSPEQRGSEVHTKKTVMIKTIETRDGEVVSEATQQQHEVL

SEQ ID NO: 834098 - protein, 520 aa, Homo sapiens; identical to SEQ ID NO: 834087

SEQ ID NO: 834099 - protein, 276 aa, Homo sapiens
RGGEAGADVRRDTNSADGWGPCLPSPHPLSGRPPARRLLRAPASLARAVTMSQAYSSSQRVSSYRRTFGGAPGFPLGSPLSSPVFPRAGFGSKGSSSSVTSRVYQVSRTSGGAGGLGSLRASRLGTTRTPSSYGAGELLDFSLADAVNQEFLTTRTNEKVELQELNDRFANYIEKVRFLEQQNAALAAEVNRLKGREPTRVAELYEEELRELRRQVEVLTNQRARVDVERDNLLDDLQRLKAKLQRRSSGRKNQNHWVPSSGRDAVPSAWLGAMDL

SEQ ID NO: 834100 - protein, 228 aa, Homo sapiens
MSYAEKPDEITKDEWMEKLNNLHVQRADMNRLIMNYLVTEGFKEAAEKFRMESGIEPSVDLETLDERIKIREMILKGQIQEAIALINSLHPELLDTNRYLYFHLQQQHLIELIRQRETEAALEFAQTQLAEQGEESRECLTEMERTLALLAFDSPEESPFGDLLHTMQRQKVWSEVNQAVLDYENRESTPKLAKLLKLLLWAQNELDQKKVKYPKMTDLSKGVIEEPK

SEQ ID NO: 834101 - protein, 228 aa, Homo sapiens; identical to SEQ ID NO: 834100

SEQ ID NO: 834102 - protein, 228 aa, Homo sapiens; identical to SEQ ID NO: 834100

SEQ ID NO: 834103 - protein, 228 aa, Homo sapiens; identical to SEQ ID NO: 834100

SEQ ID NO: 834104 - protein, 228 aa, Homo sapiens; identical to SEQ ID NO: 834100

SEQ ID NO: 834105 - protein, 180 aa, Homo sapiens
RLLCKCSGPLAAEGFGLPRRPVLLGRIPLRIQEAIALINSLHPELLDTNRYLYFHLQQQHLIELIRQRETEAALEFAQTQLAEQGEESRECLTEMERTLALLAFDSPEESPFGDLLHTMQRQKVWSEVNQAVLDYENRESTPKLAKLLKLLLWAQNELDQKKVKYPKMTDLSKGVIEEPK

SEQ ID NO: 834106 - protein, 228 aa, Homo sapiens; identical to SEQ ID NO: 834100

SEQ ID NO: 834107 - protein, 123 aa, Homo sapiens [sequence omitted]

SEQ ID NO: 834108 - protein, 69 aa, Homo sapiens
RARYPFWGLCPIQSQSLKLYGSKSSDHNGSYSRDPPPQIRTRVQTPLGTSGRKATSFVVLLVPVILKYL

SEQ ID NO: 834109 - protein, 135 aa, Homo sapiens
IPHGILQGSGAPEPWRIPHGIPLPALSGLCGVRRSPSSRFSFFPPQQRNWRKDIKLSAVDLSAEIFPESMVVLNYLHVSSIFNSGVGLFLISSQKCSALGEGTSPLACHFPGVLYHFDGTLWSAENALSWHASRL

SEQ ID NO: 834110 - protein, 135 aa, Homo sapiens; identical to SEQ ID NO: 834109

SEQ ID NO: 834111 - protein, 325 aa, Homo sapiens
MASSSGSKAEFIVGGKYKLVRKIGSGSFGDIYLAINITNGEEVAVKLESQKARHPQLLYESKLYKILQGGVGIPHIRWYGQEKDYNVLVMDLLGPSLEDLFNFCSRRFTMKTVLMLADQMISRIEYVHTKNFIHRDIKPDNFLMGIGRHCNKLFLIDFGLAKKYRDNRTRQHIPYREDKNLTGTARYASINAHLGIEQSRRDDMESLGYVLMYFNRTSLPWQGLKAATKKQKYEKISEKKMSTPVEVLCKGFPAEFAMYLNYCRGLRFEEAPDYMYLRQLFRILFRTLNHQYDYTFDWTMLKQKAAQQAASSSGQGQQAQTPTGF

SEQ ID NO: 834112 - protein, 337 aa, Homo sapiens
MASSSGSKAEFIVGGKYKLVRKIGSGSFGDIYLAINITNGEEVAVKLESQKARHPQLLYESKLYKILQGGVGIPHIRWYGQEKDYNVLVMDLLGPSLEDLFNFCSRRFTMKTVLMLADQMISRIEYVHTKNFIHRDIKPDNFLMGIGRHCNKLFLIDFGLAKKYRDNRTRQHIPYREDKNLTGTARYASINAHLGIEQSRRDDMESLGYVLMYFNRTSLPWQGLKAATKKQKYEKISEKKMSTPVEVLCKGFPAEFAMYLNYCRGLRFEEAPDYMYLRQLFRILFRTLNHQYDYTFDWTMLKQKAAQQAASSSGQGQQAQTPTGKQTDKTKSNMKGF

SEQ ID NO: 834113 - protein, 325 aa, Homo sapiens; identical to SEQ ID NO: 834111

SEQ ID NO: 834114 - protein, 325 aa, Homo sapiens; identical to SEQ ID NO: 834111

SEQ ID NO: 834115 - protein, 337 aa, Homo sapiens; identical to SEQ ID NO: 834112

SEQ ID NO: 834116 - protein, 353 aa, Homo sapiens
MASSSGSKAEFIVGGKYKLVRKIGSGSFGDIYLAINITNGEEVAVKLESQKARHPQLLYESKLYKILQGGVGIPHIRWYGQEKDYNVLVMDLLGPSLEDLFNFCSRRFTMKTVLMLADQMISRIEYVHTKNFIHRDIKPDNFLMGIGRHCNKCLESPVGKRKRSMTVSTSQDPSFSGLNQLFLIDFGLAKKYRDNRTRQHIPYREDKNLTGTARYASINAHLGIEQSRRDDMESLGYVLMYFNRTSLPWQGLKAATKKQKYEKISEKKMSTPVEVLCKGFPAEFAMYLNYCRGLRFEEAPDYMYLRQLFRILFRTLNHQYDYTFDWTMLKQKAAQQAASSSGQGQQAQTPTGF

SEQ ID NO: 834117 - protein, 337 aa, Homo sapiens; identical to SEQ ID NO: 834112

SEQ ID NO: 834118 - protein, 337 aa, Homo sapiens; identical to SEQ ID NO: 834112

SEQ ID NO: 834119 - protein, 337 aa, Homo sapiens; identical to SEQ ID NO: 834112

SEQ ID NO: 834120 - protein, 337 aa, Homo sapiens; identical to SEQ ID NO: 834112

SEQ ID NO: 834121 - protein, 216 aa, Homo sapiens
MKTVLMLADQMISRIEYVHTKNFIHRDIKPDNFLMGIGRHCNKLFLIDFGLAKKYRDNRTRQHIPYREDKNLTGTARYASINAHLGIEQSRRDDMESLGYVLMYFNRTSLPWQGLKAATKKQKYEKISEKKMSTPVEVLCKGFPAEFAMYLNYCRGLRFEEAPDYMYLRQLFRILFRTLNHQYDYTFDWTMLKQKAAQQAASSSGQGQQAQTPTGF

SEQ ID NO: 834122 - protein, 325 aa, Homo sapiens; identical to SEQ ID NO: 834111

SEQ ID NO: 834123 - protein, 236 aa, Homo sapiens
MDLLGPSLEDLFNFCSRRFTMKTVLMLADQMISRIEYVHTKNFIHRDIKPDNFLMGIGRHCNKLFLIDFGLAKKYRDNRTRQHIPYREDKNLTGTARYASINAHLGIEQSRRDDMESLGYVLMYFNRTSLPWQGLKAATKKQKYEKISEKKMSTPVEVLCKGFPAEFAMYLNYCRGLRFEEAPDYMYLRQLFRILFRTLNHQYDYTFDWTMLKQKAAQQAASSSGQGQQAQTPTGF

SEQ ID NO: 834124 - protein, 110 aa, Homo sapiens
MASSSGSKAEFIVGGKYKLVRKIGSGSFGDIYLAINITNGEEVAVKLESQKARHPQLLYESKLYKILQETTGQGNTYHTEKIKTSLALPDMLASMHILVLSRVAEMTWNH

SEQ ID NO: 834125 - protein, 336 aa, Homo sapiens
MASSSGSKAEFIVGGKYKLVRKIGSGSFGDIYLAINITNGEEVAVKLESQKARHPQLLYESKLYKILQGGVGIPHIRWYGQEKDYNVLVMDLLGPSLEDLFNFCSRRFTMKTVLMLADQMISRIEYVHTKNFIHRDIKPDNFLMGIGRHCNKLFLIDFGLAKKYRDNRTRQHIPYREDKNLTGTARYASINAHLGIEQSRRDDMESLGYVLMYFNRTSLPWQGLKAATKKQKYEKISEKKMSTPVEVLCKGFPAEFAMYLNYCRGLRFEEAPDYMYLRQLFRILFRTLNHQYDYTFDWTMLKQKAAQQAASSSGQGQQAQTPTGKQTDKTKSNMKG

SEQ ID NO: 834126 - protein, 361 aa, Homo sapiens
MASSSGSKAEFIVGGKYKLVRKIGSGSFGDIYLAINITNGEEVAVKLESQKARHPQLLYESKLYKILQGGVGIPHIRWYGQEKDYNVLVMDLLGPSLEDLFNFCSRRFTMKTVLMLADQMISRIEYVHTKNFIHRDIKPDNFLMGIGRHCNKLFLIDFGLAKKYRDNRTRQHIPYREDKNLTGTARYASINAHLGIEQSRRDDMESLGYVLMYFNRTSLPWQGLKAATKKQKYEKISEKKMSTPVEVLCKGFPAEFAMYLNYCRGLRFEEAPDYMYLRQLFRILFRTLNHQYDYTFDWTMLKQKAAQQAAFNKMLKAAAGEFADNPCSSVKRGNMVRAARALLSAVTRLLILADMADVYKL

SEQ ID NO: 834127 - protein, 259 aa, Homo sapiens
MASSSGSKAEFIVGGKYKLVRKIGSGSFGDIYLAINITNGEEVAVKLESQKARHPQLLYESKLYKILQGGVGIPHIRWYGQEKDYNVLVMDLLGPSLEDLFNFCSRRFTMKTVLMLADQMISRIEYVHTKNFIHRDIKPDNFLMGIGRHCNKLFLIDFGLAKKYRDNRTRQHIPYREDKNLTGTARYASINAHLGIEQSRRDDMESLGYVLMYFNRTSLPWQGLKAATKKQKYEKISEKKMSTPVEVLCKGFPAEFAMY

SEQ ID NO: 834128 - protein, 243 aa, Homo sapiens
MASSSGSKAEFIVGGKYKLVRKIGSGSFGDIYLAINITNGEEVAVKLESQKARHPQLLYESKLYKILQGGVGIPHIRWYGQEKDYNVLVMDLLGPSLEDLFNFCSRRFTMKTVLMLADQMISRIEYVHTKNFIHRDIKPDNFLMGIGRHCNKLFLIDFGLAKKYRDNRTRQHIPYREDKNLTGTARYASINAHLGIEQSRRDDMESLGYVLMYFNRTSLPWQGLKLHQGTKYVRLCKECPALE

SEQ ID NO: 834129 - protein, 127 aa, Homo sapiens [sequence omitted]

SEQ ID NO: 834130 - protein, 103 aa, Homo sapiens
MASSSGSKAEFIVGGKYKLVRKIGSGSFGDIYLAINITNGEEVAVKLESQKARHPQLLYESKLYKILQGGVGIPHIRKNPVHIGDPLREARNGEWVEAGNETS

SEQ ID NO: 834131 - protein, 56 aa, Homo sapiens
MASSSGSKAEFIVGGKYKLMGSIDCAYLLPSSMSDETPYQGKPFRTCSFPSSIYNA

SEQ ID NO: 834132 - protein, 117 aa, Homo sapiens
MASSSGSKAEFIVGGKYKLVRKIGSGSFGDIYLAINITNGEEVAVKLESQKARHPQLLYESKLYKILQGGVGIPHIRWYGQEKDYNVLVMDLLGPSLEDLFNFCSRRFTMKKLDLNV

SEQ ID NO: 834133 - protein, 325 aa, Homo sapiens; identical to SEQ ID NO: 834111

SEQ ID NO: 834134 - protein, 325 aa, Homo sapiens; identical to SEQ ID NO: 834111

SEQ ID NO: 834135 - protein, 325 aa, Homo sapiens; identical to SEQ ID NO: 834111

SEQ ID NO: 834136 - protein, 325 aa, Homo sapiens; identical to SEQ ID NO: 834111

SEQ ID NO: 834137 - protein, 122 aa, Homo sapiens [sequence omitted]

SEQ ID NO: 834138 - protein, 182 aa, Homo sapiens
PQQHDMRLQLDEMLRSAEERRRKKAEELAARQREDKNLTGTARYASINAHLGIEQSRRDDMESLGYVLMYFNRTSLPWQGLKAATKKQKYEKISEKKMSTPVEVLCKGFPAEFAMYLNYCRGLRFEEAPDYMYLRQLFRILFRTLNHQYDYTFDWTMLKQKAAQQAASSSGQGQQAQTPTGF

SEQ ID NO: 834139 - protein, 292 aa, Homo sapiens
MASSSGSKAEFIVGGKYKLVRKIGSGSFGDIYLAINITNGEEVAVKLESQKARHPQLLYESKLYKILQGGVGIPHIRWYGQEKDYNVLVMDLLGPSLEDLFNFCSRRFTMKTVLMLADQMISRIEYVHTKNFIHRDIKPDNFLMGIGRHCNKLFLIDFGLAKKYRDNRTRQHIPYREDKNLTGTARYASINAHLGIEQSRRDDMESLGYVLMYFNRTSLPWQGLKAATKKQKYEKISEKKMSTPVEVLCKGFPAEFAMYLNYCRGLRFEEAPDYMYLRQLFRILFRSVFKVF

SEQ ID NO: 834140 - protein, 233 aa, Homo sapiens
MASSSGSKAEFIVGGKYKLVRKIGSGSFGDIYLAINITNGEEVAVKLESQKARHPQLLYESKLYKILQGGVGIPHIRWYGQEKDYNVLVMDLLGPSLEDLFNFCSRRFTMKTVLMLADQMISRIEYVHTKNFIHRDIKPDNFLMGIGRHCNKLFLIDFGLAKKYRDNRTRQHIPYREDKNLTGTARYASINAHLGIEQRLQQRNKNMKRLVKRRCPRLLKFYVRGFLQNLRCT

SEQ ID NO: 834141 - protein, 171 aa, Homo sapiens
MASSSGSKAEFIVGGKYKLVRKIGSGSFGDIYLAINITNGEEVAVKLESQKARHPQLLYESKLYKILQGGVGIPHIRWYGQEKDYNVLVMDLLGPSLEDLFNFCSRRFTMKTVLMLADQMISRIEYVHTKNFIHRDIKPDNFLMGIGRHCNKLFLFWFGQKVLRHGRDVPN

SEQ ID NO: 834142 - protein, 142 aa, Homo sapiens
MASSSGSKAEFIVGGKYKLVRKIGSGSFGDIYLAINITNGEEVAVKLESQKARHPQLLYESKLYKILQGGVGIPHIRDGQDFNVWSRRVTKTVYVADQMISIAYVQYKNSQSITRYYGMGVTDKYLMIGCKVRHSRTIIRSL

SEQ ID NO: 834143 - protein, 86 aa, Homo sapiens
QHQPEKQSSSLHSPAQFTQEQQAASPRGCTAANLLKTSSRHVATCSPALRVQDRGAETTEEALNMQNDCLGQRTKGKGPRCGRCKG

SEQ ID NO: 834144 - protein, 722 aa, Homo sapiens
KARYEAGWLIRQREIPETLAWVNLTDLTYLNLSRNQLSLLPPYICQLPLRVLIVSNNKLGALPPDIGTLGSLRQLDVSSNELQSLPSELCGLSSLRDLNVRRNQLSTLPEELGDLPLVRLDFSCNRVSRIPVSFCRLRHLQVILLDSNPLQSPPAQVCLKGKLHIFKYLSTEAGQRGSALGDLAPSRPPSFSPWYSPRWGGRKPWDTECPFPAPGTPCFLAGGWGAVVQHQADQIRLAGPSPAEDLFPGHRYDGGLDSGFHSVDSGSKRWSGNEVRASCPWVIEGVSPGRAPLNWGPPNCRVPGRSWSCPLPSLCPASREGLAQQRPELESTQDPQVLSPHVQRGHLPSLPLPLQSTDEFSELSFRISELAREPRGPRERKEDGSADGDPVQIDFIDSHVPGEDEERGTVEEQRPPELSPGAGDRERAPSSRREEPAGEERRRPDTLQLWQERERRQQQQSGAWGAPRKDSLLKPGLRAVVGGAAAVSTQAMHNGSPKSSASQAGAAAGQGAPAPAPASQEPLPIAGPATAPAPRPLGSIQRPNSFLFRSSSQSGSGPSSPDSVLRPRRYPQVPDEKDLMTQLRQVLESRLQRPLPEDLAEALASGVILCQLANQLRPRSVPFIHVPSPAVPKLSALKARKNVESFLEACRKMGVPEADLCSPSDLLQGTARGLRTALEAVKRVGGKALPPLWPPSGLGGFVVFYVVLMLLLYVTYTRLLGS

SEQ ID NO: 834145 - protein, 210 aa, Homo sapiens
MPVSPAPVAVSLVPAPATAPAPRPLGSIQRPNSFLFRSSSQSGSGPSSPDSVLRPRRYPQVPDEKDLMTQLRQVLESRLQRPLPEDLAEALASGVILCQLANQLRPRSVPFIHVPSPAVPKLSALKARKNVESFLEACRKMGVPEADLCSPSDLLQGTARGLRTALEAVKRVGGKALPPLWPPSGLGGFVVFYVVLMLLLYVTYTRLLGS

SEQ ID NO: 834146 - protein, 143 aa, Homo sapiens
MTQLRQVLESRLQRPLPEDLAEALASGVILCQLANQLRPRSVPFIHVPSPAVPKLSALKARKNVESFLEACRKMGVPEADLCSPSDLLQGTARGLRTALEAVKRVGGKALPPLWPPSGLGGFVVFYVVLMLLLYVTYTRLLGS

SEQ ID NO: 834147 - protein, 722 aa, Homo sapiens; identical to SEQ ID NO: 834144

SEQ ID NO: 834148 - protein, 722 aa, Homo sapiens; identical to SEQ ID NO: 834144

SEQ ID NO: 834149 - protein, 722 aa, Homo sapiens; identical to SEQ ID NO: 834144

SEQ ID NO: 834150 - protein, 722 aa, Homo sapiens; identical to SEQ ID NO: 834144

SEQ ID NO: 834151 - protein, 316 aa, Homo sapiens
MGQVRGSDGAVGGQRLGASMRSPRALRRLLHCPCWRLGPSVSLAPGTLGLQGRVRGGGVAAASVPAPPAHSPHPVALPGSGESSCCCPTTCQARPLSSPPEPDPRSPQVAWEVAPSRMTPLAPWDPKYEAKAGPRPVWGANCSSGASFSGRTLCHPSFWPLYEAASGRGLRPVAPATGHWNGQQAPPDAGFPVVCCEDVFLSDPLLPRGQRVPLYLSKAPQQMMGSLKLLPPPPIMSARVLPRPSPSRGPSTAWLSGPELIALTGLLQMSQGEPRPSSSAVGPPDHTSDPPSPCGSPSSSQGADLSLPQTPDTHCP

SEQ ID NO: 834152 - protein, 316 aa, Homo sapiens; identical to SEQ ID NO: 834151

SEQ ID NO: 834153 - protein, 316 aa, Homo sapiens; identical to SEQ ID NO: 834151

SEQ ID NO: 834154 - protein, 316 aa, Homo sapiens; identical to SEQ ID NO: 834151

SEQ ID NO: 834155 - protein, 316 aa, Homo sapiens; identical to SEQ ID NO: 834151

SEQ ID NO: 834156 - protein, 829 aa, Homo sapiens
MAAAVAAPLAAGGEEAAATTSVPGSPGLPGRRSAERALEEAVATGTLNLSNRRLKHFPRGAARSYDLSDITQADLSRNRFPEVPEAACQLVSLEGLSLYHNCLRCLNPALGNLTALTYLNLSRNQLSLLPPYICQLPLRVLIVSNNKLGALPPDIGTLGSLRQLDVSSNELQSLPSELCGLSSLRDLNVRRNQLSTLPEELGDLPLVRLDFSCNRVSRIPVSFCRLRHLQVILLDSNPLQSPPAQVCLKGKLHIFKYLSTEAGQRGSALGDLAPSRPPSFSPCPAEDLFPGHRYDGGLDSGFHSVDSGSKRWSGNESTDEFSELSFRISELAREPRGPRERKEDGSADGDPVQIDFIDSHVPGEDEERGTVEEQRPPELSPGAGDRERAPSSRREEPAGEERRRPDTLQLWQERERRQQQQSGAWGAPRKDSLLKPGLRAVVGGAAAVSTQAMHNGSPKSSASQAGAAAGQGAPAPAPASQEPLPIAGPATAPAPRPLGSIQRPNSFLFRSSSQSGSGPSSPDSVLRPRRYPQVPDEKDLMTQLRQVLESRLQRPLPEDLAEALASGVILCQLANQLRPRSVPFIHVPSPAVPKLSALKARKNVESFLEACRKMGVPEADLCSPSDLLQGTARGLRTALEAVKRVGGKALPPLWPPSGLGGFVVFYVVLMLLLYVTYTHPRSPQVAWEVAPSRMTPLAPWDPKYEAKAGPRPVWVSWGQTCGTGWGAQGAVRWPEAPVLCPPHPRGPTVAQEPRSQAGRCVTPHSGRCMKQPRAGVSGPWPLPQGTGMDSRRPQMQGSRWCAVKMSSSRTLCCPGGSVFPCTCPRPPSR

SEQ ID NO: 834157 - protein, 210 aa, Homo sapiens; identical to SEQ ID NO: 834145

SEQ ID NO: 834158 - protein, 722 aa, Homo sapiens; identical to SEQ ID NO: 834144

SEQ ID NO: 834159 - protein, 855 aa, Homo sapiens
KARYEAGWLIRQREIPETLAWVNLTDLTYLNLSRNQLSLLPPYICQLPLRVLIVSNNKLGALPPDIGTLGSLRQLDVSSNELQSLPSELCGLSSLRDLNVRRNQLSTLPEELGDLPLVRLDFSCNRVSRIPVSFCRLRHLQVILLDSNPLQSPPAQVCLKGKLHIFKYLSTEAGQRGSALGDLAPSRPPSFSPWYSPRWGGRKPWDTECPFPAPGTPCFLAGGWGAVVQHQADQIRLAGPSPAEDLFPGHRYDGGLDSGFHSVDSGSKRWSGNEVRASCPWVIEGVSPGRAPLNWGPPNCRVPGRSWSCPLPSLCPASREGLAQQRPELESTQDPQVLSPHVQRGHLPSLPLPLQSTDEFSELSFRISELAREPRGPRERKEDGSADGDPVQIDFIDSHVPGEDEERGTVEEQRPPELSPGAGDRERAPSSRREEPAGEERRRPDTLQLWQERERRQQQQSGAWGAPRKDSLLKPGLRAVVGGAAAVSTQAMHNGSPKSSASQAGAAAGQGAPAPAPASQEPLPIAGPATAPAPRPLGSIQRPNSFLFRSSSQSGSGPSSPDSVLRPRRYPQVPDEKDLMTQLRQVLESRLQRPLPEDLAEALASGVILCQLANQLRPRSVPFIHVPSPAVPKLSALKARKNVESFLEACRKMGVPEVWGLLSKEWWHAGLSRACGMDGGLPFAADVCSQMKAQAAPALPSMPPALHAPCPDVTCPTHPLPCRPHLVLHVTCPAHALPCTPPALHSPCPARQHVGVVLAPAREGRGGRDCPAAAADVCPLSLSTCSPLPQADLCSPSDLLQGTARGLRTALEAVKRVGGKALPPLWPPSGLGGFVVFYVVLMLLLYVTYTRLLGS

SEQ ID NO: 834160 - protein, 276 aa, Homo sapiens
MTQLRQVLESRLQRPLPEDLAEALASGVILCQLANQLRPRSVPFIHVPSPAVPKLSALKARKNVESFLEACRKMGVPEVWGLLSKEWWHAGLSRACGMDGGLPFAADVCSQMKAQAAPALPSMPPALHAPCPDVTCPTHPLPCRPHLVLHVTCPAHALPCTPPALHSPCPARQHVGVVLAPAREGRGGRDCPAAAADVCPLSLSTCSPLPQADLCSPSDLLQGTARGLRTALEAVKRVGGKALPPLWPPSGLGGFVVFYVVLMLLLYVTYTRLLGS

SEQ ID NO: 834161 - protein, 781 aa, Homo sapiens
KARYEAGWLIRQREIPETLAWVNLTDLTYLNLSRNQLSLLPPYICQLPLRVLIVSNNKLGALPPDIGTLGSLRQLDVSSNELQSLPSELCGLSSLRDLNVRRNQLSTLPEELGDLPLVRLDFSCNRVSRIPVSFCRLRHLQVILLDSNPLQSPPAQVCLKGKLHIFKYLSTEAGQRGSALGDLAPSRPPSFSPWYSPRWGGRKPWDTECPFPAPGTPCFLAGGWGAVVQHQADQIRLAGPSPAEDLFPGHRYDGGLDSGFHSVDSGSKRWSGNEVRASCPWVIEGVSPGRAPLNWGPPNCRVPGRSWSCPLPSLCPASREGLAQQRPELESTQDPQVLSPHVQRGHLPSLPLPLQSTDEFSELSFRISELAREPRGPRERKEDGSADGDPVQIDFIDSHVPGEDEERGTVEEQRPPELSPGAGDRERAPSSRREEPAGEERRRPDTLQLWQERERRQQQQSGAWGAPRKDSLLKPGLRAVVGGAAAVSTQAMHNGSPKSSASQAGAAAGQGAPAPAPASQEPLPIAGPATAPAPRPLGSIQRPNSFLFRSSSQSGSGPSSPDSVLRPRRYPQVPDEKDLMTQLRQVLESRLQRPLPEDLAEALASGVILCQLANQLRPRSVPFIHVPSPAVPKLSALKARKNVESFLEACRKMGVPEADLCSPSDLLQGTARGLRTALEAVKRVGGKALPPLWPPSGLGGFVVFYVVLMLLLYVTYTPTSPHLSVLTVPSCPRRPCPCPLYPVRGGRSWSLPLPPVPSPSPPNSCYGGAKLSLFCREDLYL

SEQ ID NO: 834162 - protein, 316 aa, Homo sapiens; identical to SEQ ID NO: 834151

SEQ ID NO: 834163 - protein, 691 aa, Homo sapiens
KARYEAGWLIRQREIPETLAWVNLTDLTYLNLSRNQLSLLPPYICQLPLRVLIVSNNKLGALPPDIGTLGSLRQLDVSSNELQSLPSELCGLSSLRDLNVRRNQLSTLPEELGDLPLVRLDFSCNRVSRIPVSFCRLRHLQVILLDSNPLQSPPAQVCLKGKLHIFKYLSTEAGQRGSALGDLAPSRPPSFSPWYSPRWGGRKPWDTECPFPAPGTPCFLAGGWGAVVQHQADQIRLAGPSPAEDLFPGHRYDGGLDSGFHSVDSGSKRWSGNEVRASCPWVIEGVSPGRAPLNWGPPNCRVPGRSWSCPLPSLCPASREGLAQQRPELESTQDPQVLSPHVQRGHLPSLPLPLQSTDEFSELSFRISELAREPRGPRERKEDGSADGDPVQIDFIDSHVPGEDEERGTVEEQRPPELSPGAGDRERAPSSRREEPAGEERRRPDTLQLWQERERRQQQQSGAWGAPRKDSLLKPGLRAVVGGAAAVSTQAMHNGSPKSSASQAGAAAGQGAPAPAPASQEPLPIAGPATAPAPRPLGSIQRPNSFLFRSSSQSGSGPSSPDSVLRPRRYPQVPDEKDLMTQLRQVLESRLQRPLPEDLAEALASGVILCQLANQLRPRSVPFIHVPSPAVPKLSALKARKNVESFLEACRKMGVPEESLCQPHHILEEEGAPGRGLPYIAAVVHALLDRP

SEQ ID NO: 834164 - protein, 661 aa, Homo sapiens
KARYEAGWLIRQREIPETLAWVNLTDLTYLNLSRNQLSLLPPYICQLPLRVLIVSNNKLGALPPDIGTLGSLRQLDVSSNELQSLPSELCGLSSLRDLNVRRNQLSTLPEELGDLPLVRLDFSCNRVSRIPVSFCRLRHLQVILLDSNPLQSPPAQVCLKGKLHIFKYLSTEAGQRGSALGDLAPSRPPSFSPWYSPRWGGRKPWDTECPFPAPGTPCFLAGGWGAVVQHQADQIRLAGPSPAEDLFPGHRYDGGLDSGFHSVDSGSKRWSGNEVRASCPWVIEGVSPGRAPLNWGPPNCRVPGRSWSCPLPSLCPASREGLAQQRPELESTQDPQVLSPHVQRGHLPSLPLPLQSTDEFSELSFRISELAREPRGPRERKEDGSADGDPVQIDFIDSHVPGEDEERGTVEEQRPPELSPGAGDRERAPSSSCGRSGNGGSSSRAGRGGPRGRIGGTQGRPGLLLDTEPWKWGHRAPLSRSALGLADPTSPCSSLLKPGLRAVVGGAAAVSTQAMHNGSPKSSASQAGAAAGQGAPAPAPASQEPLPIAGPATAPAPRPLGSIQRPNSFLFRSSSQSGSGPSSPDSVLRPRRYPQVPDEKDLMTQLRQVLESRLQRPLPEDLAEALASGVILCQLANQLRPRSVPFIHVPSPAVVSWGWGR

SEQ ID NO: 834165 - protein, 148 aa, Homo sapiens
MAESDWDTVTVLRKKGPTAAQAKSKQAILAAQRRGEDVETSKKWAAGQNKQHSITKNTAKLDRETEELHHDRVTLEVGKVIQQGRQSKGLTQKDLATKINEKPQVIADYESGRAIPNNQVLGKIERAIGLKLRGKDIGKPIEKGPRAK

SEQ ID NO: 834166 - protein, 141 aa, Homo sapiens
MAESDWDTVTVLRKKGPTAAQAKSKQAILAAQRRGEDVETSKKWAAGQNKQHSITKNTAKLDRETEELHHDRVTLEVGKVIQQGRQSKGLTQKDLATKINEKPQVIADYESGRAIPNNQVLGKIERAIDVGTRSARVLRAQ

SEQ ID NO: 834167 - protein, 118 aa, Homo sapiens
DSTDPLFCPAPGQIQVAILAAQRRGEDVETSKKWAAGQNKQHSITKNTAKLDRETEELHHDRVTLEVGKVIQQGRQSKGLTQKDLATKINEKPQVIADYESGPGPKLGGNPEAFRKFP

SEQ ID NO: 834168 - protein, 350 aa, Homo sapiens
MYQIKRREGSTHQLEGESYYNRQKRQAERDEAHKKTNKGEARREENTRDKRREQNIQRQKRDTHKRRTRGRKKATSGSGRENTSNQRRENKTSDEREREDTRHKQSRRRREARKVREETHEHHDRREARDVKADRSGARERRESYGRQTAERSRADSSDNRDASETRTKRYSNKQPQEAGTTKSETDKNEEKVERKSTKQQDRETSRKETEEQNEEKQRERKNEKAEEERRGRKTRTDKRGQREEEIREGEEARRRRRDREGKRRERERESKETRGEAEKSKKTGEDGKENGREEETETTRGETRETGRTPTQQKENERREGRTTRDEEERQRKAKTTERERDKEENEKE

SEQ ID NO: 834169 - protein, 139 aa, Homo sapiens
MAESDWDTVTVLRKKGPTAAQAKSKQAILAAQRRGEDVETSKKWAAGQNKQHSITKNTAKLDRETEELHHDRVTLEVGKVIQQGRQSKGLTQKDLATKINEKPQVIADYESGRAIPNNQVLGKIERAIGECPSTLRRVR

SEQ ID NO: 834170 - protein, 194 aa, Homo sapiens
MAESDWDTVTVLRKKGPTAAQAKSKQAILAAQRRGEDVETSKKWAAGQNKQHSITKNTAKLDRETEELHHDRVTLEVGKVIQQGRQSKGLTQKDLATKINEKPQVIADYESGRAIPNNQVLGKIERAIGLRKPLRASGVRVPSPCQFPSACAVGDGSLSLSTAGPGPVSMGPEASSTEDPGSGSSGEGCSCSAV

SEQ ID NO: 834171 - protein, 139 aa, Homo sapiens; identical to SEQ ID NO: 834169

SEQ ID NO: 834172 - protein, 350 aa, Homo sapiens
MYQIKRREGSTHQLEGESYYNRQKRQAERDEAHKKTNKGEARREENTRDKRREQNIQRQKRDTHKRRTRGRKKATSGSGRENTSNQRRENKTSDEREREDTRHKQSRRRREARKVREETHEHHDRREARDVKADRSGARERRESYGRQTAERSRADSSDNRDASETENEAISNKQPQEAGTTKSQTDKNEEKVERKSTKQQDRETSRKETEEQNEEKQRERKNEKAERRKKRKKKRTDKRGQREEEIREGEEARRRRRDREGKRRERERESKETRGEAEKSKKTGEDGKENGREEETETTRGETRETGRTPTQQKENERREGRTTRDEEERQRKAKTTERERDKEENEKE

SEQ ID NO: 834173 - protein, 118 aa, Homo sapiens
MAESDWDTVTVLRKKGPTAAQAKSKQAILAAQRRGEDVETSKKWAAGQNKQHSITKNTAKLDRETEELHHDRVTLEVGKVIQQGRQSKGLTQKDLATKINEKPQVIADYKASKSVRSS

SEQ ID NO: 834174 - protein, 147 aa, Homo sapiens
MRADGPYPITRCLAKSSGPLVSVPPPFAGSAEQGGYPLPAGVGESGTRGKKMALGVPCSLNSGALLLQVVQTEGWWGLCRPQETPKSKWSPSPFPLPVPVSLCCWRWFSEPEHSGSGPCQHGAGSQFHRGPRLRFFRRGVFMLCCLR

SEQ ID NO: 834175 - protein, 148 aa, Homo sapiens; identical to SEQ ID NO: 834165

SEQ ID NO: 834176 - protein, 148 aa, Homo sapiens; identical to SEQ ID NO: 834165

SEQ ID NO: 834177 - protein, 134 aa, Homo sapiens
MAESDWDTVTVLRKKGPTAAQAKSKQAILAAQRRGEDVETSKKWAAGQNKQHSITKNTAKLDRETEELHHDRVTLEVGKVIQQGRQSKGLTQKDLATKINEKPRRSRASLGSQHTSTPGSHINGPLDFAKHLGR

SEQ ID NO: 834178 - protein, 95 aa, Homo sapiens
MAESDWDTVTVLRKKGPTAAQAKSKQAILAAQRRGEDVETSKKCGFLPDKQQSITRHAKLTGDRELTYRYLSGSDHSRRQGYERTARNISKVRYN

SEQ ID NO: 834179 - protein, 140 aa, Homo sapiens
LIRDRVSGLRAAQAKSKQAILAAQRRGEDVETSKKWAAGQNKQHSITKNTAKLDRETEELHHDRVTLEVGKVIQQGRQSKGLTQKDLATKINEKPQVIADYESGRAIPNNQVLGKIERAIGLKLRGKDIGKPIEKGPRAK

SEQ ID NO: 834180 - protein, 138 aa, Homo sapiens
DSTDPLFCPAPGQIQVAILAAQRRGEDVETSKKWAAGQNKQHSITKNTAKLDRETEELHHDRVTLEVGKVIQQGRQSKGLTQKDLATKINEKPQVIADYESGRAIPNNQVLGKIERAIGLKLRGKDIGKPIEKGPRAK

SEQ ID NO: 834181 - protein, 163 aa, Homo sapiens
MGAMAKPDCIITCDGKNLTIKTEEHFENNTVFLYPGRSRKQAILAAQRRGEDVETSKKWAAGQNKQHSITKNTAKLDRETEELHHDRVTLEVGKVIQQGRQSKGLTQKDLATKINEKPQVIADYESGRAIPNNQVLGKIERAIGLKLRGKDIGKPIEKGPRAK

SEQ ID NO: 834182 - protein, 111 aa, Homo sapiens
MAESDWDTVTVLRKKGPTAAQAKSKQAILAAQRRGEDVETSKKWAAGQNKQHSITKNTAKLDRETEELHHDRVTLEVGKVIQQGRQSKGLTQKDLATADNKFTQVIRSNES

SEQ ID NO: 834183 - protein, 1460 aa, Homo sapiens
MVKLDIHTLAHHLKQERLYVNSEKQLIQRLNADVLKTAEKLYRTAWIAKQQRINLDRLIITSAEASPAECCQHAKILEDTQFVDGYKQLGFQETAYGEFLSRLRENPRLIASSLVAGEKLNQENTQSVIYTVFTSLYGNCIMQEDESYLLQVLRYLIEFELKESDNPRRLLRRGTCAFSILFKLFSEGLFSAKLFLTATLHEPIMQLLVEDEDHLETDPNKLIERFSPSQQEKLFGEKGSDRFRQKVQEMVESNEAKLVALVNKFIGYLKQNTYCFPHSLRWIVSQMYKTLSCVDRLEVGEVRAMCTDLLLACFICPAVVNPEQYGIISDAPINEVARFNLMQVGRLLQQLAMTGSEEGDPRTKSSLGKFDKSCVAAFLDVVIGGRAVETPPLSSVNLLEGLSRTVVYITYSQLITLVNFMKSVMSGDQLREDRMALDNLLANLPPAKPGKSSSLEMTPYNTPQLSPATTPANKKNRLPIATRSRSRTNMLMDLHMDHEGSSQETIQEVQPEEVLVISLGTGPQLTPGMMSENEVLNMQLSDGGQGDVPVDENKLHGKPDKTLRFSLCSDNLEGISEGPSNRSNSVSSLDLEGESVSELGAGPSGSNGVEALQLLEHEQATTQDNLDDKLRKFEIRDMMGLTDDRDISETVSETWSTDVLGSDFDPNIDEDRLQEIAGAAAENMLGSLLCLPGSGSVLLDPCTGSTISETTSEAWSVEVLPSDSEAPDLKQEERLQELESCSGLGSTSDDTDVREVSSRPSTPGLSVVSGISATSEDIPNKIEDLRSECSSDFGGKDSVTSPDMDEITHGAHQLTSPPSQSESLLAMFDPLSSHEGASAVVRPKVHYARPSHPPPDPPILEGAVGGNEARLPNFGSHVLTPAEMEAFKQRHSYPERLVRSRSSDIVSSVRRPMSDPSWNRRPGNEERELPPAAAIGATSLVAAPHSSSSSPSKDSSRGETEERKDSDDEKSDRNRPWWRKRFVSAMPKAPIPFRKKEKQEKDKDDLGPDRFSTLTDDPSPRLSAQAQVAEDILDKYRNAIKRTSPSDGAMANYESTEVMGDGESAHDSPRDEALQNISADDLPDSASQAAHPQDSAFSYRDAKKKLRLALCSADSVAFPVLTHSTRNGLPDHTDPEDNEIVCFLKVQIAEAINLQDKNLMAQLQETMRCVCRFDNRTCRKLLASIAEDYRKRAPYIAYLTRCRQGLQTTQAHLERLLQRVLRDKEVANRYFTTVCVRLLLESKEKKIREFIQDFQKLTAADDKTAQVEDFLQFLYGAMAQDVIWQNASEEQLQDAQLAIERSVMNRIFKLAFYPNQDGDILRDQVLHEHIQRLSKVVTANHRALQIPEVYLREAPWPSAQSEIRTISAYKTPRDKVQCILRMCSTIMNLLSLANEDSVPGADDFVPVLVFVLIKANPPCLLSTVQYISSFYASCLSGEESYWWMQFTAAVEFIKTIDDRK

SEQ ID NO: 834184 - protein, 1460 aa, Homo sapiens; identical to SEQ ID NO: 834183

SEQ ID NO: 834185 - protein, 1433 aa, Homo sapiens
MVKLDIHTLAHHLKQERLYVNSEKQLIQRLNADVLKTAEKLYRTAWIAKQQRINLDRLIITSAEASPAECCQHAKILEDTQFVDGYKQLGFQETAYGEFLSRLRENPRLIASSLVAGEKLNQENTQSVIYTVFTSLYGNCIMQEDESYLLQVLRYLIEFELKESDNPRRLLRRGTCAFSILFKLFSEGLFSAKLFLTATLHEPIMQLLVEDEDHLETDPNKLIERFSPSQQEKLFGEKGSDRFRQKVQEMVESNEAKLVALVNKFIGYLKQNTYCFPHSLRWIVSQMYKTLSCVDRLEVGEVRAMCTDLLLACFICPAVVNPEQYGIISDAPINEVARFNLMQVGRLLQQLAMTGSEEGDPRTKSSLGKFDKSCVAAFLDVVIGGRAVETPPLSSVNLLEGLSRTVVYITYSQLITLVNFMKSVMSGDQLREDRMALDNLLANLPPAKPGKSSSLEMTPYNTPQLSPATTPANKKNRLPIATRSRSRTNMLMDLHMDHEGSSQETIQEVQPEEVLVISLGTGPQLTPGMMSENEVLNMQLSDGGQGDVPVDENKLHGKPDKTLRFSLCSDNLEGISEGPSNRSNSVSSLDLEGESVSELGAGPSGSNGVEALQLLEHEQATTQDNLDDKLRKFEIRDMMGLTDDRDISETVSETWSTDVLGSDFDPNIDEDRLQEIAGAAAENMLGSLLCLPGSGSVLLDPCTGSTISETTSEAWSVEVLPSDSEAPDLKQEERLQELESCSGLGSTSDDTDVREVSSRPSTPGLSVVSGISATSEDIPNKIEDLRSECSSDFGGKDSVTSPDMDEITHGAHQLTSPPSQSESLLAMFDPLSSHEGASAVVRPKVHYARPSHPPPDPPILEGAVGGNEARLPNFGSHVLTPAEMEAFKQRHSYPERLVRSRSSDIVSSVRRPMSDPSWNRRPGNEERELPPAAAIGATSLVAAPHSSSSSPSKDSSRGETEERKDSDDEKSDRNRPWWRKRFVSAMPKDDPSPRLSAQAQVAEDILDKYRNAIKRTSPSDGAMANYESTEVMGDGESAHDSPRDEALQNISADDLPDSASQAAHPQDSAFSYRDAKKKLRLALCSADSVAFPVLTHSTRNGLPDHTDPEDNEIVCFLKVQIAEAINLQDKNLMAQLQETMRCVCRFDNRTCRKLLASIAEDYRKRAPYIAYLTRCRQGLQTTQAHLERLLQRVLRDKEVANRYFTTVCVRLLLESKEKKIREFIQDFQKLTAADDKTAQVEDFLQFLYGAMAQDVIWQNASEEQLQDAQLAIERSVMNRIFKLAFYPNQDGDILRDQVLHEHIQRLSKVVTANHRALQIPEVYLREAPWPSAQSEIRTISAYKTPRDKVQCILRMCSTIMNLLSLANEDSVPGADDFVPVLVFVLIKANPPCLLSTVQYISSFYASCLSGEESYWWMQFTAAVEFIKTIDDRK

SEQ ID NO: 834186 - protein, 1487 aa, Homo sapiens
MVKLDIHTLAHHLKQERLYVNSEKQLIQRLNADVLKTAEKLYRTAWIAKQQRINLDRLIITSAEASPAECCQHAKILEDTQFVDGYKQLGFQETAYGEFLSRLRENPRLIASSLVAGEKLNQENTQSVIYTVFTSLYGNCIMQEDESYLLQVLRYLIEFELKESDNPRRLLRRGTCAFSILFKLFSEGLFSAKLFLTATLHEPIMQLLVEDEDHLETDPNKLIERFSPSQQEKLFGEKGSDRFRQKVQEMVESNEAKLVALVNKFIGYLKQNTYCFPHSLRWIVSQMYKTLSCVDRLEVGEVRAMCTDLLLACFICPAVVNPEQYGIISDAPINEVARFNLMQVGRLLQQLAMTGSEEGDPRTKSSLGKFDKSCVAAFLDVVIGGRAVETPPLSSVNLLEGLSRTVVYITYSQLITLVNFMKSVMSGDQLREDRMALDNLLANLPPAKPGKSSSLEMTPYNTPQLSPATTPANKKNRLPIATRSRSRTNMLMDLHMDHEGSSQETIQEVQPEEVLVISLGTGPQLTPGMMSENEVLNMQLSDGGQGDVPVDENKLHGKPDKTLRFSLCSDNLEGISEGPSNRSNSVSSLDLEGESVSELGAGPSGSNGVEALQLLEHEQATTQDNLDDKLRKFEIRDMMGLTDDRDISETVSETWSTDVLGSDFDPNIDEDRLQEIAGAAAENMLGSLLCLPGSGSVLLDPCTGSTISETTSEAWSVEVLPSDSEAPDLKQEERLQELESCSGLGSTSDDTDVREVSSRPSTPGLSVVSGISATSEDIPNKIEDLRSECSSDFGGKDSVTSPDMDEITHDFLYILQPKQHFQHIEAEADMRIQLSSSAHQLTSPPSQSESLLAMFDPLSSHEGASAVVRPKVHYARPSHPPPDPPILEGAVGGNEARLPNFGSHVLTPAEMEAFKQRHSYPERLVRSRSSDIVSSVRRPMSDPSWNRRPGNEERELPPAAAIGATSLVAAPHSSSSSPSKDSSRGETEERKDSDDEKSDRNRPWWRKRFVSAMPKAPIPFRKKEKQEKDKDDLGPDRFSTLTDDPSPRLSAQAQVAEDILDKYRNAIKRTSPSDGAMANYESTEVMGDGESAHDSPRDEALQNISADDLPDSASQAAHPQDSAFSYRDAKKKLRLALCSADSVAFPVLTHSTRNGLPDHTDPEDNEIVCFLKVQIAEAINLQDKNLMAQLQETMRCVCRFDNRTCRKLLASIAEDYRKRAPYIAYLTRCRQGLQTTQAHLERLLQRVLRDKEVANRYFTTVCVRLLLESKEKKIREFIQDFQKLTAADDKTAQVEDFLQFLYGAMAQDVIWQNASEEQLQDAQLAIERSVMNRIFKLAFYPNQDGDILRDQVLHEHIQRLSKVVTANHRALQIPEVYLREAPWPSAQSEIRTISAYKTPRDKVQCILRMCSTIMNLLSLANEDSVPGADDFVPVLVFVLIKANPPCLLSTVQYISSFYASCLSGEESYWWMQFTAAVEFIKTIDDRK

SEQ ID NO: 834187 - protein, 1487 aa, Homo sapiens; identical to SEQ ID NO: 834186

SEQ ID NO: 834188 - protein, 1433 aa, Homo sapiens; identical to SEQ ID NO: 834185

SEQ ID NO: 834189 - protein, 1487 aa, Homo sapiens; identical to SEQ ID NO: 834186

SEQ ID NO: 834190 - protein, 1286 aa, Homo sapiens
MVKLDIHTLAHHLKQERLYVNSEKQLIQRLNADVLKTAEKLYRTAWIAKQQRINLDRLIITSAEASPAECCQHAKILEDTQFVDGYKQLGFQETAYGEFLSRLRENPRLIASSLVAGEKLNQENTQSVIYTVFTSLYGNCIMQEDESYLLQVLRYLIEFELKESDNPRRLLRRGTCAFSILFKLFSEGLFSAKLFLTATLHEPIMQLLVEDEDHLETDPNKLIERFSPSQQEKLFGEKGSDRFRQKVQEMVESNEAKLVALVNKFIGYLKQNTYCFPHSLRWIVSQMYKTLSCVDRLEVGEVRAMCTDLLLACFICPAVVNPEQYGIISDAPINEVARFNLMQVGRLLQQLAMTGSEEGDPRTKSSLGKFDKSCVAAFLDVVIGGRAVETPPLSSVNLLEGLSRTVVYITYSQLITLVNFMKSVMSGDQLREDRMALDNLLANLPPAKPGKSSSLEMTPYNTPQLSPATTPANKKNRLPIATRSRSRTNMLMDLHMDHEGSSQETIQEVQPEEVLVISLGTGPQLTPGMMSENEVLNMQLSDGGQGDVPVDENKLHGKPDKTLRFSLCSDNLEGISEGPSNRSNSVSSLDLEGESVSELGAGPSGSNGVEALQLLEHEQATTQDNLDDKLRKFEIRDMMGLTDDRDISETVSETWSTDVLGSDFDPNIDEDRLQEIAGAAAENMLGSLLCLPGSGSVLLDPCTGSTISETTSEAWSVEVLPSDSEAPDLKQEERLQELESCSGLGSTSDDTDVREVSSRPSTPGLSVVSGISATSEDIPNKIEDLRSECSSDFGGKDSVTSPDMDEITHDFLYILQPKQHFQHIEAEADMRIQLSSSAHQLTSPPSQSESLLAMFDPLSSHEGASAVVRPKVHYARPSHPPPDPPILEGAVGGNEARLPNFGSHVLTPAEMEAFKQRHSYPERLVRSRSSDIVSSVRRPMSDPSWNRRPGNEERELPPAAAIGATSLVAAPHSSSSSPSKDSSRGETEERKDSDDEKSDRNRPWWRKRFVSAMPKAPIPFRKKEKQEKDKDDLGPDRFSTLTDDPSPRLSAQAQVAEDILDKYRNAIKRTSPSDGAMANYESTEVMGDGESAHDSPRDEALQNISADDLPDSASQAAHPQDSAFSYRDAKKKLRLALCSADSVAFPVLTHSTRNGLPDHTDPEDNEIVCFLKVQIAEAINLQDKNLMAQLQETMRCVCRFDNRTCRKLLASIAEDYRKRAPYIAYLTRCRQGLQTTQAHLERLLQRVLRDKEVANRYFTTVCVRLLLESKEKKIREFIQGNSIPLV

SEQ ID NO: 834191 - protein, 105 aa, Homo sapiens
MTPLGLALSPRLECSDTISLIFVFFVETGFRHVGQAGLELLASSDPPTSASQSAGIIGVSHRAQPQNYMYIYLNVSNILLSFSILGKISATVIAFFCFFFIKTCL

SEQ ID NO: 834192 - protein, 1487 aa, Homo sapiens; identical to SEQ ID NO: 834186

SEQ ID NO: 834193 - protein, 982 aa, Homo sapiens
MVKLDIHTLAHHLKQERLYVNSEKQLIQRLNADVLKTAEKLYRTAWIAKQQRINLDRLIITSAEASPAECCQHAKILEDTQFVDGYKQLGFQETAYGEFLSRLRENPRLIASSLVAGEKLNQENTQSVIYTVFTSLYGNCIMQEDESYLLQVLRYLIEFELKESDNPRRLLRRGTCAFSILFKLFSEGLFSAKLFLTATLHEPIMQLLVEDEDHLETDPNKLIERFSPSQQEKLFGEKGSDRFRQKVQEMVESNEAKLVALVNKFIGYLKQNTYCFPHSLRWIVSQMYKTLSCVDRLEVGEVRAMCTDLLLACFICPAVVNPEQYGIISDAPINEVARFNLMQVGRLLQQLAMTGSEEGDPRTKSSLGKFDKSCVAAFLDVVIGGRAVETPPLSSVNLLEGLSRTVVYITYSQLITLVNFMKSVMSGDQLREDRMALDNLLANLPPAKPGKSSSLEMTPYNTPQLSPATTPANKKNRLPIATRSRSRTNMLMDLHMDHEGSSQETIQEVQPEEVLVISLGTGPQLTPGMMSENEVLNMQLSDGGQGDVPVDENKLHGKPDKTLRFSLCSDNLEGISEGPSNRSNSVSSLDLEGESVSELGAGPSGSNGVEALQLLEHEQATTQDNLDDKLRKFEIRDMMGLTDDRDISETVSETWSTDVLGSDFDPNIDEDRLQEIAGAAAENMLGSLLCLPGSGSVLLDPCTGSTISETTSEAWSVEVLPSDSEAPDLKQEERLQELESCSGLGSTSDDTDVREVSSRPSTPGLSVVSGISATSEDIPNKIEDLRSECSSDFGGKDSVTSPDMDEITHGASAVVRPKVHYARPSHPPPDPPILEGAVGGNEARLPNFGSHVLTPAEMEAFKQRHSYPERLVRSRSSDIVSSVRRPMSDPSWNRRPGNEERELPPAAAIGATSLVAAPHSSSSSPSKDSSRGETEERKDSDDEKSDRNRPWWRKRFVSAMPKAWHHLSWQKHLFLKEESIQE

SEQ ID NO: 834194 - protein, 1487 aa, Homo sapiens; identical to SEQ ID NO: 834186

SEQ ID NO: 834195 - protein, 657 aa, Homo sapiens
MDEITHGAHQLTSPPSQSESLLAMFDPLSSHEGASAVVRPKVHYARPSHPPPDPPILEGAVGGNEARLPNFGSHVLTPAEMEAFKQRHSYPERLVRSRSSDIVSSVRRPMSDPSWNRRPGNEERELPPAAAIGATSLVAAPHSSSSSPSKDSSRGETEERKDSDDEKSDRNRPWWRKRFVSAMPKAPIPFRKKEKQEKDKDDLGPDRFSTLTDDPSPRLSAQAQVAEDILDKYRNAIKRTSPSDGAMANYESTEVMGDGESAHDSPRDEALQNISADDLPDSASQAAHPQDSAFSYRDAKKKLRLALCSADSVAFPVLTHSTRNGLPDHTDPEDNEIVCFLKVQIAEAINLQDKNLMAQLQETMRCVCRFDNRTCRKLLASIAEDYRKRAPYIAYLTRCRQGLQTTQAHLERLLQRVLRDKEVANRYFTTVCVRLLLESKEKKIREFIQDFQKLTAADDKTAQVEDFLQFLYGAMAQDVIWQNASEEQLQDAQLAIERSVMNRIFKLAFYPNQDGDILRDQVLHEHIQRLSKVVTANHRALQIPEVYLREAPWPSAQSEIRTISAYKTPRDKVQCILRMCSTIMNLLSLANEDSVPGADDFVPVLVFVLIKANPPCLLSTVQYISSFYASCLSGEESYWWMQFTAAVEFIKTIDDRK

SEQ ID NO: 834196 - protein, 493 aa, Homo sapiens
MVPLNIEICALFKSYLLICLWDYATGVILTSEVVQTQGANSLTLLSLADDPSPRLSAQAQVAEDILDKYRNAIKRTSPSDGAMANYESTEVMGDGESAHDSPRDEALQNISADDLPDSASQAAHPQDSAFSYRDAKKKLRLALCSADSVAFPVLTHSTRNGLPDHTDPEDNEIVCFLKVQIAEAINLQDKNLMAQLQETMRCVCRFDNRTCRKLLASIAEDYRKRAPYIAYLTRCRQGLQTTQAHLERLLQRVLRDKEVANRYFTTVCVRLLLESKEKKIREFIQDFQKLTAADDKTAQVEDFLQFLYGAMAQDVIWQNASEEQLQDAQLAIERSVMNRIFKLAFYPNQDGDILRDQVLHEHIQRLSKVVTANHRALQIPEVYLREAPWPSAQSEIRTISAYKTPRDKVQCILRMCSTIMNLLSLANEDSVPGADDFVPVLVFVLIKANPPCLLSTVQYISSFYASCLSGEESYWWMQFTAAVEFIKTIDDRK

SEQ ID NO: 834197 - protein, 183 aa, Homo sapiens
MAQDVIWQNASEEQLQDAQLAIERSVMNRIFKLAFYPNQDGDILRDQVLHEHIQRLSKVVTANHRALQIPEVYLREAPWPSAQSEIRTISAYKTPRDKVQCILRMCSTIMNLLSLANEDSVPGADDFVPVLVFVLIKANPPCLLSTVQYISSFYASCLSGEESYWWMQFTAAVEFIKTIDDRK

SEQ ID NO: 834198 - protein, 1316 aa, Homo sapiens
MVKLDIHTLAHHLKQERLYVNSEKQLIQRLNADVLKTAEKLYRTAWIAKQQRINLDRLIITSAEASPAECCQHAKILEDTQFVDGYKQLGFQETAYGEFLSRLRENPRLIASSLVAGEKLNQENTQSVIYTVFTSLYGNCIMQEDESYLLQVLRYLIEFELKESDNPRRLLRRGTCAFSILFKLFSEGLFSAKLFLTATLHEPIMQLLVEDEDHLETDPNKLIERFSPSQQEKLFGEKGSDRFRQKVQEMVESNEAKLVALVNKFIGYLKQNTYCFPHSLRWIVSQMYKTLSCVDRLEVGEVRAMCTDLLLACFICPAVVNPEQYGIISDAPINEVARFNLMQVGRLLQQLAMTGSEEGDPRTKSSLGKFDKSCVAAFLDVVIGGRAVETPPLSSVNLLEGLSRTVVYITYSQLITLVNFMKSVMSGDQLREDRMALDNLLANLPPAKPGKSSSLEMTPYNTPQLSPATTPANKKNRLPIATRSRSRTNMLMDLHMDHEGSSQETIQEVQPEEVLVISLGTGPQLTPGMMSENEVLNMQLSDGGQGDVPVDENKLHGKPDKTLRFSLCSDNLEGISEGPSNRSNSVSSLDLEGESVSELGAGPSGSNGVEALQLLEHEQATTQDNLDDKLRKFEIRDMMGLTDDRDISETVSETWSTDVLGSDFDPNIDEDRLQEIAGAAAENMLGSLLCLPGSGSVLLDPCTGSTISETTSEAWSVEVLPSDSEAPDLKQEERLQELESCSGLGSTSDDTDVREVSSRPSTPGLSVVSGISATSEDIPNKIEDLRSECSSDFGGKDSVTSPDMDEITHDFLYILQPKQHFQHIEAEADMRIQLSSSAHQLTSPPSQSESLLAMFDPLSSHEGASAVVRPKVHYARPSHPPPDPPILEGAVGGNEARLPNFGSHVLTPAEMEAFKQRHSYPERLVRSRSSDIVSSVRRPMSDPSWNRRPGNEERELPPAAAIGATSLVAAPHSSSSSPSKDSSRGETEERKDSDDEKSDRNRPWWRKRFVSAMPKAPIPFRKKEKQEKDKDDLGPDRFSTLTDDPSPRLSAQAQVAEDILDKYRNAIKRTSPSDGAMANYESTEVMGDGESAHDSPRDEALQNISADDLPDSASQAAHPQDSAFSYRDAKKKLRLALCSADSVAFPVLTHSTRNGLPDHTDPEDNEIVCFLKVQIAEAINLQDKNLMAQLQETMRCVCRFDNRTCRKLLASIAEDYRKRAPYIAYLTRCRQGLQTTQAHLERLLQRVLRDKEVANRYFTTVCVRLLLESKEKKIREFIQDFQKLTAADDKTAQSFFMVQWPRMSYGKTRVKNSFKI

SEQ ID NO: 834199 - protein, 442 aa, Homo sapiens
MLVHTYSSMDRHDGVPSHSSRLSQLGSVSQGPYSSAPPLSHTPSSDFQPPYFPPPYQPLPYHQSQDPYSHVNDPYSLNPLHQPQQHPWGQRQRQEVGSEAGSLLPQPRAALPQLSGLDPRRDYHSVRRPDVLLHSAHHGLDAGMGDSLSLHGLGHPGMEDVQSVEDANNSGMNLLDQSVIKKVPVPPKSVTSLMMNKDGFLGGMSVNTGEVFCSVPGRLSLLSSTSKYKVTVGEVQRRLSPPECLNASLLGGVLRRAKSKNGGRSLRERLEKIGLNLPAGRRKAANVTLLTSLVEGEAVHLARDFGYICETEFPAKAVSEYLNRQHTDPSDLHSRKNMLLATKQLCKEFTDLLAQDRTPIGNSRPSPILEPGIQSCLTHFSLITHGFGAPAICAALTALQNYLTEALKGMDKMFLNNTTTNRHTSGEGPGSKTGDKEEKHRK

SEQ ID NO: 834200 - protein, 501 aa, Homo sapiens
MWPSESTWGSKFQILASLVPGRAYKSRASPFVTCIFFLPLCTLCLSLPLSLFLCLLLWLSSPSSLRSQDRHDGVPSHSSRLSQLGSVSQGPYSSAPPLSHTPSSDFQPPYFPPPYQPLPYHQSQDPYSHVNDPYSLNPLHQPQQHPWGQRQRQEVGSEAGSLLPQPRAALPQLSGLDPRRDYHSVRRPDVLLHSAHHGLDAGMGDSLSLHGLGHPGMEDVQSVEDANNSGMNLLDQSVIKKVPVPPKSVTSLMMNKDGFLGGMSVNTGEVFCSVPGRLSLLSSTSKYKVTVGEVQRRLSPPECLNASLLGGVLRRAKSKNGGRSLRERLEKIGLNLPAGRRKAANVTLLTSLVEGEAVHLARDFGYICETEFPAKAVSEYLNRQHTDPSDLHSRKNMLLATKQLCKEFTDLLAQDRTPIGNSRPSPILEPGIQSCLTHFSLITHGFGAPAICAALTALQNYLTEALKGMDKMFLNNTTTNRHTSGEGPGSKTGDKEEKHRK

SEQ ID NO: 834201 - protein, 263 aa, Homo sapiens
MLWKLVENVKYEDIYEDRHDGVPSHSSRLSQLGSVSQGPYSSAPPLSHTPSSDFQPPYFPPPYQPLPYHQSQDPYSHVNDPYSLNPLHQPQQHPWGQRQRQEVGSEAGSLLPQPRAALPQLSGLDPRRDYHSVRRPDVLLHSAHHGLDAGMGDSLSLHGLGHPGMEDVQSVEDANNSGMNLLDQSVIKKVPVPPKSVTSLMMNKDGFLGGMSVNTGEVFCSVPGRLSLLSSTSKYKVTVGEVQRRLSPPECLNASLLGGVLRR

SEQ ID NO: 834202 - protein, 108 aa, Homo sapiens
LGVCPVASHRDTFYQPVIRIENLVTFMAIFSLFLVPVPPKSVTSLMMNKDGFLGGMSVNTGEVFCSVPGRLSLLSSTSKYKVTVGEVQRRLSPPECLNASLLGGVLRR

SEQ ID NO: 834203 - protein, 449 aa, Homo sapiens
MLWKLVENVKYEDIYEDRHDGVPSHSSRLSQLGSVSQGPYSSAPPLSHTPSSDFQPPYFPPPYQPLPYHQSQDPYSHVNDPYSLNPLHQPQQHPWGQRQRQEVGSEAGSLLPQPRAALPQLSGLDPRRDYHSVRRPDVLLHSAHHGLDAGMGDSLSLHGLGHPGMEDVQSVEDANNSGMNLLDQSVIKKVPVPPKSVTSLMMNKDGFLGGMSVNTGEVFCSVPGRLSLLSSTSKYKVTVGEVQRRLSPPECLNASLLGGVLRRAKSKNGGRSLRERLEKIGLNLPAGRRKAANVTLLTSLVEGEAVHLARDFGYICETEFPAKAVSEYLNRQHTDPSDLHSRKNMLLATKQLCKEFTDLLAQDRTPIGNSRPSPILEPGIQSCLTHFSLITHGFGAPAICAALTALQNYLTEALKGMDKMFLNNTTTNRHTSGEGPGSKTGDKEEKHRK

SEQ ID NO: 834204 - protein, 458 aa, Homo sapiens
MLWKLVENVKYEDIYEMLVHTYSSMDRHDGVPSHSSRLSQLGSVSQGPYSSAPPLSHTPSSDFQPPYFPPPYQPLPYHQSQDPYSHVNDPYSLNPLHQPQQHPWGQRQRQEVGSEAGSLLPQPRAALPQLSGLDPRRDYHSVRRPDVLLHSAHHGLDAGMGDSLSLHGLGHPGMEDVQSVEDANNSGMNLLDQSVIKKVPVPPKSVTSLMMNKDGFLGGMSVNTGEVFCSVPGRLSLLSSTSKYKVTVGEVQRRLSPPECLNASLLGGVLRRAKSKNGGRSLRERLEKIGLNLPAGRRKAANVTLLTSLVEGEAVHLARDFGYICETEFPAKAVSEYLNRQHTDPSDLHSRKNMLLATKQLCKEFTDLLAQDRTPIGNSRPSPILEPGIQSCLTHFSLITHGFGAPAICAALTALQNYLTEALKGMDKMFLNNTTTNRHTSGEGPGSKTGDKEEKHRK

SEQ ID NO: 834205 - protein, 294 aa, Homo sapiens
LGVCPVASHRDTFYQPVIRIENLVTFMAIFSLFLVPVPPKSVTSLMMNKDGFLGGMSVNTGEVFCSVPGRLSLLSSTSKYKVTVGEVQRRLSPPECLNASLLGGVLRRAKSKNGGRSLRERLEKIGLNLPAGRRKAANVTLLTSLVEGEAVHLARDFGYICETEFPAKAVSEYLNRQHTDPSDLHSRKNMLLATKQLCKEFTDLLAQDRTPIGNSRPSPILEPGIQSCLTHFSLITHGFGAPAICAALTALQNYLTEALKGMDKMFLNNTTTNRHTSGEGPGSKTGDKEEKHRK

SEQ ID NO: 834206 - protein, 395 aa, Homo sapiens
MNGPVDGLCDHSLSEGVFMFTSESVGEGHPDKICDQISDAVLDAHLKQDPNAKVACETVCKTGMVLLCGEITSMAMVDYQRVVRDTIKHIGYDDSAKGFDFKTCNVLVALEQQSPDIAQCVHLDRNEEDVGAGDQGLMFGYATDETEECMPLTIILAHKLNARMADLRRSGLLPWLRPDSKTQVTVQYMQDNGAVIPVRIHTIVISVQHNEDITLEEMRRALKEQVIRAVVPAKYLDEDTVYHLQPSGRFVIGGPQGDAGVTGRKIIVDTYGGWGAHGGGAFSGKDYTKVDRSAAYAARWVAKSLVKAGLCRRVLVQVSYAIGVAEPLSISIFTYGTSQKTERELLDVVHKNFDLRPGVIVRDLDLKKPIYQKTACYGHFGRSEFPWEVPRKLVF

SEQ ID NO: 834207 - protein, 395 aa, Homo sapiens; identical to SEQ ID NO: 834206

SEQ ID NO: 834208 - protein, 91 aa, Homo sapiens
TEASIPDAAPCWKVSYAIGVAEPLSISIFTYGTSQKTERELLDVVHKNFDLRPGVIVRDLDLKKPIYQKTACYGHFGRSEFPWEVPRKLVF

SEQ ID NO: 834209 - protein, 152 aa, Homo sapiens
MALLLILISLPLQGDAGVTGRKIIVDTYGGWGAHGGGAFSGKDYTKVDRSAAYAARWVAKSLVKAGLCRRVLVQVSYAIGVAEPLSISIFTYGTSQKTERELLDVVHKNFDLRPGVIVRDLDLKKPIYQKTACYGHFGRSEFPWEVPRKLVF

SEQ ID NO: 834210 - protein, 395 aa, Homo sapiens; identical to SEQ ID NO: 834206

SEQ ID NO: 834211 - protein, 164 aa, Homo sapiens
KALGSGCDPREPLAHLLHLLMKLWQGDAGVTGRKIIVDTYGGWGAHGGGAFSGKDYTKVDRSAAYAARWVAKSLVKAGLCRRVLVQVSYAIGVAEPLSISIFTYGTSQKTERELLDVVHKNFDLRPGVIVRDLDLKKPIYQKTACYGHFGRSEFPWEVPRKLVF

SEQ ID NO: 834212 - protein, 395 aa, Homo sapiens; identical to SEQ ID NO: 834206

SEQ ID NO: 834213 - protein, 395 aa, Homo sapiens; identical to SEQ ID NO: 834206

SEQ ID NO: 834214 - protein, 719 aa, Homo sapiens
MFGKKKKKIEISGPSNFEHRVHTGFDPQEQKFTGLPQQWHSLLADTANRPKPMVDPSCITPIQLAPMKTIVRGNKPCKETSINGLLEDFDNISVTRSNSLRKESPPTPDQGASSHGPGHAEENGFITFSQYSSESDTTADYTTEKYREKSLYGDDLDPYYRGSHAAKQNGHVMKMKHGEAYYSEVKPLKSDFARFSADYHSHLDSLSKPSEYSDLKWEYQRASSSSPLDYSFQFTPSRTAGTSGCSKESLAYSESEWGPSLDDYDRRPKSSYLNQTSPQPTMRQRSRSGSGLQEPMMPFGASAFKTHPQGHSYNSYTYPRLSEPTMCIPKVDYDRAQMVLSPPLSGSDTYPRGPAKLPQSQSKSGYSSSSHQYPSGYHKATLYHHPSLQSSSQYISTASYLSSLSLSSSTYPPPSWGSSSDQQPSRVSHEQFRAALQLVVSPGDPREYLANFIKIGEGSTGIVCIATEKHTGKQVAVKKMDLRKQQRRELLFNEVVIMRDYHHDNVVDMYSSYLVGDELWVVMEFLEGGALTDIVTHTRMNEEQIATVCLSVLRALSYLHNQGVIHRDIKSDSILLTSDGRIKLSDFGFCAQVSKEVPKRKSLVGTPYWMAPEVISRLPYGTEVDIWSLGIMVIEMIDGEPPYFNEPPLQAMRRIRDSLPPRVKDLHKVSSVLRGFLDLMLVREPSQRATAQELLGHPFLKLAGPPSCIVPLMRQYRHH

SEQ ID NO: 834215 - protein, 719 aa, Homo sapiens; identical to SEQ ID NO: 834214

SEQ ID NO: 834216 - protein, 719 aa, Homo sapiens; identical to SEQ ID NO: 834214

SEQ ID NO: 834217 - protein, 719 aa, Homo sapiens; identical to SEQ ID NO: 834214

SEQ ID NO: 834218 - protein, 206 aa, Homo sapiens
SPGAGLAAPDLESQPHRGSPPPEAEIAPGAATVAVTATAMPKAPKQQPPEPEWIGDGESTSPSDKVVKKGKKDKKIKKTFFEELAVEDKQAGEEEKVLKEKEQQQQQQQQQQKKKRDTRKGRRKKDVDDDGEEKELMERLKKLSVPTSDEEDEVPAPKPRGGKKTKGGNVFAALIQDQSEEEEEEEKHPPKPAKPEKNRINKAVSE

SEQ ID NO: 834219 - protein, 252 aa, Homo sapiens
SPGAGLAAPDLESQPHRGSPPPEAEIAPGAATVAVTATAMPKAPKQQPPEPEWIGDGESTSPSDKVVKKGKKDKKIKKTFFEELAVEDKQAGEEEKVLKEKEQQQQQQQQQQKKKRDTRKGRRKKDVDDDGEEKELMERLKKLSVPTSDEEDEVPAPKPAEEERVVCFAPVQRVREETTLAASGERHSVLRHTCSTFSLCTFCLCHHVRIISIIISIWGSVHLCSCSALSLLSLLSRLAAHLSLSQLSLVLC

SEQ ID NO: 834220 - protein, 883 aa, Homo sapiens
PGGGVGRASLESQPHRGSPPPEAEIAPGAATVAVTATAMPKAPKQQPPEPEWIGDGESTSPSDKVVKKGKKDKKIKKTFFEELAVEDKQAGEEEKVLKEKEQQQQQQQQQQKKKRDTRKGRRKKDVDDDGEEKELMERLKKLSVPTSDEEDEVPAPKPRGGKKTKGGNVFAALIQDQSEEEEEEEKHPPKPAKPEKNRINKAVSEEQQPALKGKKGKEEKSKGKAKPQNKFAALDNEEEDKEEEIIKEKEPPKQGKEKAKKAEQGSEEEGEGEEEEEEGGESKADDPYAHLSKKEKKKLKKQMEYERQVASLKAANAAENDFSVSQAEMSSRQAMLENASDIKLEKFSISAHGKELFVNADLYIVAGRRYGLVGPNGKGKTTLLKHIANRALSIPPNIDVLLCEQEVVADETPAVQAVLRADTKRLKLLEEERRLQGQLEQGDDTAAERLEKVYEELRATGAAAAEAKARRILAGLGFDPEMQNRPTQKFSGGWRMRVSLARALFMEPTLLMLDEPTNHLDLNAVIWLNNYLQGWRKTLLIVSHDQGFLDDVCTDIIHLDAQRLHYYRGNYMTFKKMYQQKQKELLKQYEKQEKKLKELKAGGKSTKQAEKQTKEALTRKQQKCRRKNQDEESQEAPELLKRPKEYTVRFTFPDPPPLSPPVLGLHGVTFGYQGQKPLFKNLDFGIDMDSRICIVGPNGVGKSTLLLLLTGKLTPTHGEMRKNHRLKIGFFNQQYAEQLRMEETPTEYLQRGFNLPYQDARKCLGRFGLESHAHTIQICKLSGGQKARVVFAELACREPDVLILDEPTNNLDIESIDALGEAINEYKGAVIVVSHDARLITETNCQLWVVEEQSVSQIDGDFEDYKREVLEALGEVMVSRPRE

SEQ ID NO: 834221 - protein, 883 aa, Homo sapiens; identical to SEQ ID NO: 834220

SEQ ID NO: 834222 - protein, 727 aa, Homo sapiens
CLRIIGFLSPNPSRKEKAKDQSEEEEEEEKHPPKPAKPEKNRINKAVSEEQQPALKGKKGKEEKSKGKAKPQNKFAALDNEEEDKEEEIIKEKEPPKQGKEKAKKAEQGSEEEGEGEEEEEEGGESKADDPYAHLSKKEKKKLKKQMEYERQVASLKAANAAENDFSVSQAEMSSRQAMLENASDIKLEKFSISAHGKELFVNADLYIVAGRRYGLVGPNGKGKTTLLKHIANRALSIPPNIDVLLCEQEVVADETPAVQAVLRADTKRLKLLEEERRLQGQLEQGDDTAAERLEKVYEELRATGAAAAEAKARRILAGLGFDPEMQNRPTQKFSGGWRMRVSLARALFMEPTLLMLDEPTNHLDLNAVIWLNNYLQGWRKTLLIVSHDQGFLDDVCTDIIHLDAQRLHYYRGNYMTFKKMYQQKQKELLKQYEKQEKKLKELKAGGKSTKQAEKQTKEALTRKQQKCRRKNQDEESQEAPELLKRPKEYTVRFTFPDPPPLSPPVLGLHGVTFGYQGQKPLFKNLDFGIDMDSRICIVGPNGVGKSTLLLLLTGKLTPTHGEMRKNHRLKIGFFNQQYAEQLRMEETPTEYLQRGFNLPYQDARKCLGRFGLESHAHTIQICKLSGGQKARVVFAELACREPDVLILDEPTNNLDIESIDALGEAINEYKGAVIVVSHDARLITETNCQLWVVEEQSVSQIDGDFEDYKREVLEALGEVMVSRPRE

SEQ ID NO: 834223 - protein, 581 aa, Homo sapiens [sequence omitted]

SEQ ID NO: 834224 - protein, 521 aa, Homo sapiens
ASSRVAKLLGLDLVHKGKTTLLKHIANRALSIPPNIDVLLCEQEVVADETPAVQAVLRADTKRLKLLEEERRLQGQLEQGDDTAAERLEKVYEELRATGAAAAEAKARRILAGLGFDPEMQNRPTQKFSGGWRMRVSLARALFMEPTLLMLDEPTNHLDLNAVIWLNNYLQGWRKTLLIVSHDQGFLDDVCTDIIHLDAQRLHYYRGNYMTFKKMYQQKQKELLKQYEKQEKKLKELKAGGKSTKQAEKQTKEALTRKQQKCRRKNQDEESQEAPELLKRPKEYTVRFTFPDPPPLSPPVLGLHGVTFGYQGQKPLFKNLDFGIDMDSRICIVGPNGVGKSTLLLLLTGKLTPTHGEMRKNHRLKIGFFNQQYAEQLRMEETPTEYLQRGFNLPYQDARKCLGRFGLESHAHTIQICKLSGGQKARVVFAELACREPDVLILDEPTNNLDIESIDALGEAINEYKGAVIVVSHDARLITETNCQLWVVEEQSVSQIDGDFEDYKREVLEALGEVMVSRPRE

SEQ ID NO: 834225 - protein, 791 aa, Homo sapiens
PGGGVGRASLESQPHRGSPPPEAEIAPGAATVAVTATAMPKAPKQQPPEPEWIGDGESTSPSDKVVKKGKKDKKIKKTFFEELAVEDKQAGEEEKVLKEKEQQQQQQQQQQKKKRDTRKGRRKKDVDDDGEEKELMERLKKLSVPTSDEEDEVPAPKPRGGKKTKGGNVFAALIQDQSEEEEEEEKHPPKPAKPEKNRINKAVSEEQQPALKGKKGKEEKSKGKAKPQNKFAALDNEEEDKEEEIIKEKEPPKQGKEKAKKAEQGSEEEGEGEEEEEEGGESKADDPYAHLSKKEKKKLKKQMEYERQVASLKAANAAENDFSVSQAEMSSRQAMLENASDIKLEKFSISAHGKELFVNADLYIVAGRRYGLVGPNGKGKTTLLKHIANRALSIPPNIDVLLCEQEVVADETPAVQAVLRADTKRLKLLEEERRLQGQLEQGDDTAAERLEKVYEELRATGAAAAEAKARRILAGLGFDPEMQNRPTQKFSGGWRMRVSLARALFMEPTLLMLDEPTNHLDLNAVIWLNNYLQGWRKTLLIVSHDQGFLDDVCTDIIHLDAQRLHYYRGNYMTFKKMYQQKQKELLKQYEKQEKKLKELKAGGKSTKQAEKQTKEALTRKQQKCRRKNQDEESQEAPELLKRPKEYTVRFTFPDPPPLSPPVLGLHGVTFGYQGQKPLFKNLDFGIDMDSRICIVGPNGVGKSTLLLLLTGKLTPTHGEMRKNHRLKIGFFNQQYAEQLRMEETPTEYLQRGFNLPYQDARKCLGRFGLESHAHTIQICKLSGGQKARVCS

SEQ ID NO: 834226 - protein, 140 aa, Homo sapiens
GNPCEYLQGYNRPSREPSLRLGRSALKNHAHTIQIGKLLGVQKGAIVVAELACGKPEVLIWDEPTNNLDIESIDALGEAINEYKGAVIVVSHDARLITETNCQLWVVEEQSVSQIDGDFEDYKREVLEALGEVMVSRPRE

SEQ ID NO: 834227 - protein, 695 aa, Homo sapiens
SPGAGLAAPDLESQPHRGSPPPEAEIAPGAATVAVTATAMPKAPKQQPPEPEWIGDGESTSPSDKVVKKGKKDKKIKKTFFEELAVEDKQAGEEEKVLKEKEQQQQQQQQQQKKKRDTRKGRRKKDVDDDGEEKELMERLKKLSVPTSDEEDEVPAPKPRGGKKTKGGNVFAALIQDQSEEEEEEEKHPPKPAKPEKNRINKAVSEEQQPALKGKKGKEEKSKGKAKPQNKFAALDNEEEDKEEEIIKEKEPPKQGKEKAKKAEQGSEEEGEGEEEEEEGGESKADDPYAHLSKKEKKKLKKQMEYERQVASLKAANAAENDFSVSQAEMSSRQAMLENASDIKLEKFSISAHGKELFVNADLYIVAGRRYGLVGPNGKGKTTLLKHIANRALSIPPNIDVLLCEQEVVADETPAVQAVLRADTKRLKLLEEERRLQGQLEQGDDTAAERLEKVYEELRATGAAAAEAKARRILAGLGFDPEMQNRPTQKFSGGWRMRVSLARALFMDAHHCVMLEWSAGANAAVGSAQRCSSGVNRRTSRVWREDLVVSTICPVHQRLSRSDVLQLNIHPPSDGPKLVVHSLIVGRTLTSVTLAQNRYVTQQQCMEEERAANSYDEAKQQSSCMDAEMARSGRVSYPTCNGGETNTTERGKAPDTLGKSRPGHSVLDGNHEPRGLNGNVRMGRAPPEGIHDRRS

SEQ ID NO: 834228 - protein, 308 aa, Homo sapiens
SPGAGLAAPDLESQPHRGSPPPEAEIAPGAATVAVTATAMPKAPKQQPPEPEWIGDGESTSPSDKVVKKGKKDKKIKKTFFEELAVEDKQAGEEEKVLKEKEQQQQQQQQQQKKKRDTRKGRRKKDVDDDGEEKELMERLKKLSVPTSDEEDEVPAPKPRGGKKTKGGNVFAALIQDQSEEEEEEEKHPPKPAKPEKNRINKAVSEEQQPALKGKKGKEEKSKGKAKPQNKFAALDNEEEDKEEEIIKEKEPPKQGLRAPGGLRGPGGLRAPGGLRAPGGLRAPGGLRAPGGLRAPGGLRAPGGLRAP

SEQ ID NO: 834229 - protein, 229 aa, Homo sapiens
SPGAGLAAPDLESQPHRGSPPPEAEIAPGAATVAVTATAMPKAPKQQPPEPEWIGDGESTSPSDKVVKKGKKDKKIKKTFFEELAVEDKQAGEEEKVLKEKEQQQQQQQQQQKKKRDTRKGRRKKDVDDDGEEKELMERLKKLSVPTSDEEDEVPAPKPRGGKKTKGGNVFAALIQDQSEEEEEEEKHPPKPAKPEKNRINKVTVVARSVTLTPFNTFWPWWSNFPLLN

SEQ ID NO: 834230 - protein, 845 aa, Homo sapiens
PGGGVGRASLESQPHRGSPPPEAEIAPGAATVAVTATAMPKAPKQQPPEPEWIGDGESTSPSDKVVKKGKKDKKIKKTFFEELAVEDKQAGEEEKVLKEKEQQQQQQQQQQKKKRDTRKGRRKKDVDDDGEEKELMERLKKLSVPTSDEEDEVPAPKPRGGKKTKGGNVFAALIQDQSEEEEEEEKHPPKPAKPEKNRINKAVSEEQQPALKGKKGKEEKSKGKAKPQNKFAALDNEEEDKEEEIIKEKEPPKQGKEKAKKAEQMEYERQVASLKAANAAENDFSVSQAEMSSRQAMLENASDIKLEKFSISAHGKELFVNADLYIVAGRRYGLVGPNGKGKTTLLKHIANRALSIPPNIDVLLCEQEVVADETPAVQAVLRADTKRLKLLEEERRLQGQLEQGDDTAAERLEKVYEELRATGAAAAEAKARRILAGLGFDPEMQNRPTQKFSGGWRMRVSLARALFMEPTLLMLDEPTNHLDLNAVIWLNNYLQGWRKTLLIVSHDQGFLDDVCTDIIHLDAQRLHYYRGNYMTFKKMYQQKQKELLKQYEKQEKKLKELKAGGKSTKQAEKQTKEALTRKQQKCRRKNQDEESQEAPELLKRPKEYTVRFTFPDPPPLSPPVLGLHGVTFGYQGQKPLFKNLDFGIDMDSRICIVGPNGVGKSTLLLLLTGKLTPTHGEMRKNHRLKIGFFNQQYAEQLRMEETPTEYLQRGFNLPYQDARKCLGRFGLESHAHTIQICKLSGGQKARVVFAELACREPDVLILDEPTNNLDIESIDALGEAINEYKGAVIVVSHDARLITETNCQLWVVEEQSVSQIDGDFEDYKREVLEALGEVMVSRPRE

SEQ ID NO: 834231 - protein, 127 aa, Homo sapiens
SPGAGLAAPDLESQPHRGSPPPEAEIAPGAATVAVTATAMPKAPKQQPPEPEWIGDGESTSPSDKVVKKGKKDKKIKKTFFEELAVEDKQAGEEEKVLKEKEQQQQQQQQQQKKKRDTRSSGGPSPY

SEQ ID NO: 834232 - protein, 883 aa, Homo sapiens; identical to SEQ ID NO: 834220

SEQ ID NO: 834233 - protein, 748 aa, Homo sapiens
MERLKKLSVPTSDEEDEVPAPKPRGGKKTKGGNVFAALIQDQSEEEEEEEKHPPKPAKPEKNRINKAVSEEQQPALKGKKGKEEKSKGKAKPQNKFAALDNEEEDKEEEIIKEKEPPKQGKEKAKKAEQGSEEEGEGEEEEEEGGESKADDPYAHLSKKEKKKLKKQMEYERQVASLKAANAAENDFSVSQAEMSSRQAMLENASDIKLEKFSISAHGKELFVNADLYIVAGRRYGLVGPNGKGKTTLLKHIANRALSIPPNIDVLLCEQEVVADETPAVQAVLRADTKRLKLLEEERRLQGQLEQGDDTAAERLEKVYEELRATGAAAAEAKARRILAGLGFDPEMQNRPTQKFSGGWRMRVSLARALFMEPTLLMLDEPTNHLDLNAVIWLNNYLQGWRKTLLIVSHDQGFLDDVCTDIIHLDAQRLHYYRGNYMTFKKMYQQKQKELLKQYEKQEKKLKELKAGGKSTKQAEKQTKEALTRKQQKCRRKNQDEESQEAPELLKRPKEYTVRFTFPDPPPLSPPVLGLHGVTFGYQGQKPLFKNLDFGIDMDSRICIVGPNGVGKSTLLLLLTGKLTPTHGEMRKNHRLKIGFFNQQYAEQLRMEETPTEYLQRGFNLPYQDARKCLGRFGLESHAHTIQICKLSGGQKARVVFAELACREPDVLILDEPTNNLDIESIDALGEAINEYKGAVIVVSHDARLITETNCQLWVVEEQSVSQIDGDFEDYKREVLEALGEVMVSRPRE

SEQ ID NO: 834234 - protein, 883 aa, Homo sapiens; identical to SEQ ID NO: 834220

SEQ ID NO: 834235 - protein, 883 aa, Homo sapiens; identical to SEQ ID NO: 834220

SEQ ID NO: 834236 - protein, 175 aa, Homo sapiens
VDSAADLTHGEIRKNHRLKIGFFNQQYAEQLRMEETPTEYLQRGFNLPYQDARKCLGRFGLESHAHTIQICKLSGGQKARVVFAELACREPDVLILDEPTNNLDIESIDALGEAINEYKGAVIVVSHDARLITETNCQLWVVEEQSVSQIDGDFEDYKREVLEALGEVMVSRPRE

SEQ ID NO: 834237 - protein, 405 aa, Homo sapiens
SPGAGLAAPDLESQPHRGSPPPEAEIAPGAATVAVTATAMPKAPKQQPPEPEWIGDGESTSPSDKVVKKGKKDKKIKKTFFEELAVEDKQAGEEEKVLKEKEQQQQQQQQQQKKKRDTRKGRRKKDVDDDGEEKELMERLKKLSVPTSDEEDEVPAPKPRGGKKTKGGNVFAALIQDQSEEEEEEEKHPPKPAKPEKNRINKAVSEEQQPALKGKKGKEEKSKGKAKPQNKFAALDNEEEDKEEEIIKEKEPPKQGKEKAKKAEQVQRKNGDLPEHKRPSAPVDFSKIDPSKPESILKMTKKGKTLMMFVTVSGSPTEKETEEITSLWQGSLFNANYDVQRFIVGSDRAIFMLRDGSYAWEIKDFWSVKTGVPDVTLEGQVYPPVKSERGTANENNYNIVQDKGQ

SEQ ID NO: 834238 - protein, 231 aa, Homo sapiens
SPGAGLAAPDLESQPHRGSPPPEAEIAPGAATVAVTATAMPKAPKQQPPEPEWIGDGESTSPSDKVVKKGKKDKKIKKTFFEELAVEDKQAGEEEKVLKEKEQQQQQQQQQQKKKRDTRKGRRKKDVDDDGEEKELMERLKKLSVPTSDEEDEVPAPKPRGGKKTKGGNVFAALIQDQSEEEEEEEKHPPKPAKPEKNRINKAVSEEQQPALKGKKGKKGHNVEVAVAPRS

SEQ ID NO: 834239 - protein, 304 aa, Homo sapiens
MGVFCLGPWGLGRKLRTPGKGPLQLLSRLCGDHLQAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQDPYHGPNQAHGLCFSVQRPVPPPPSLENIYKELSTDIEDFVHPGHGDLSGWAKQGVLLLNAVLTVRAHQANSHKERGWEQFTDAVVSWLNQNSNGLVFLLWGSYAQKKGSAIDRKRHHVLQTAHPSPLSVYRGFFGCRHFSKTNELLQKSGKKPIDWKEL

SEQ ID NO: 834240 - protein, 344 aa, Homo sapiens
THIKARYEAGCVQASLAGSRVARVRCLLSSRMIGQKTLYSFFSPSPARKRHAPSPEPAVQGTGVAGVPEESGDAAAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQDPYHGPNQAHGLCFSVQRPVPPPPSLENIYKELSTDIEDFVHPGHGDLSGWAKQGVLLLNAVLTVRAHQANSHKERGWEQFTDAVVSWLNQNSNGLVFLLWGSYAQKKGSAIDRKRHHVLQTAHPSPLSVYRGFFGCRHFSKTNELLQKSGKKPIDWKEL

SEQ ID NO: 834241 - protein, 344 aa, Homo sapiens; identical to SEQ ID NO: 834240

SEQ ID NO: 834242 - protein, 344 aa, Homo sapiens; identical to SEQ ID NO: 834240

SEQ ID NO: 834243 - protein, 328 aa, Homo sapiens
THIKARYEAGCVQASLAGSRVARVRCLLSSRMIGQKTLYSFFSPSPARKRHAPSPEPAVQGTGVAGVPEESGDAAAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQDPYHGPNQAHGLCFSVQRPVPPPPSLENIYKELSTDIEDFVHPGHGDLSGWAKQGVLLLNAVLTVRAHQANSHKERGWEQFTDAVVSWLNQNSNGLVFLLWGSYAQKKGSAIDRKRHHVLQTAHPSPLSVYRGFFGCRHFQAQP

SEQ ID NO: 834244 - protein, 344 aa, Homo sapiens; identical to SEQ ID NO: 834240

SEQ ID NO: 834245 - protein, 76 aa, Homo sapiens
LCQACGVRRIARRVSSWLTFLIRVQAPSLIFLALSIYKAHPSPLSVYRGFFGCRHFSKTNELLQKSGKKPIDWKEL

SEQ ID NO: 834246 - protein, 264 aa, Homo sapiens
MGVFCLGPWGLGRKLRTPGKGPLQLLSRLCGDHLQAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQDPYHGPNQAHGLCFSVQRPVPPPPSLENIYKELSTDIEDFVHPGHGDLSGWAKQGVLLLNAVLTVRAHQANSHKERGWEQFTDAVVSWLNQNSNGLVFLLWGSYAQTPLQRVFDVTLSRP

SEQ ID NO: 834247 - protein, 251 aa, Homo sapiens
GQYPPYVARLGVRTASLAGSRVARVRCLLSSRMIGQKTLYSFFSPSPARKRHAPSPEPAVQGTGVAGVPEESGDAAAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQDPYHGPNQAHGLCFSVQRPVPPPPSLENIYKELSTDIEDFVHPGHGDLSGWAKQGVSFSSCLTVVP

SEQ ID NO: 834248 - protein, 345 aa, Homo sapiens
GQYPPYVARLGVRTASLAGSRVARVRCLLSSRMIGQKTLYSFFSPSPARKRHAPSPEPAVQGTGVAGVPEESGDAAAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQDPYHGPNQAHGLCFSVQRPVPPPPSLENIYKELSTDIEDFVHPGHGDLSGWAKQGVLLLNAVLTVRAHQANSHKERGWEQFTDAVVSWLNQNSNGLVFLLWGSYAQKKGSAIDRKRHHVLQTAHPSPLSVYRGFFGCRHFSKTNELLQKSGKKPIDWKEL

SEQ ID NO: 834249 - protein, 352 aa, Homo sapiens
SGGYAVGRVWRGRGTSVQGSQSPRRSSGSHRAPPSPSPRSSLEPNSQFPDRAQPWALTVRFCWDLFHKWASSALSRLCGDHLQAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQDPYHGPNQAHGLCFSVQRPVPPPPSLENIYKELSTDIEDFVHPGHGDLSGWAKQGVLLLNAVLTVRAHQANSHKERGWEQFTDAVVSWLNQNSNGLVFLLWGSYAQKKGSAIDRKRHHVLQTAHPSPLSVYRGFFGCRHFSKTNELLQKSGKKPIDWKEL

SEQ ID NO: 834250 - protein, 164 aa, Homo sapiens
MGVFCLGPWGLGRKLRTPGKGPLQLLSRLCGDHLQAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDLTGSALVFKGLFRLRPVWRTFIKSCLQT

SEQ ID NO: 834251 - protein, 344 aa, Homo sapiens; identical to SEQ ID NO: 834240

SEQ ID NO: 834252 - protein, 344 aa, Homo sapiens; identical to SEQ ID NO: 834240

SEQ ID NO: 834253 - protein, 250 aa, Homo sapiens
THIKARYEAGCVQASLAGSRVARVRCLLSSRMIGQKTLYSFFSPSPARKRHAPSPEPAVQGTGVAGVPEESGDAAAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQDPYHGPNQAHGLCFSVQRPVPPPPSLENIYKELSTDIEDFVHPGHGDLSGWAKQGVSFSSCLTVVP

SEQ ID NO: 834254 - protein, 783 aa, Homo sapiens
AAAMDEQAGPGVFFSNNHPGAGGAKGLGPLAEAAAAGDGAAAAGAARAQYSLPGILHFLQHEWARFEVERAQWEVERAELQAQIAFLQGERKGQENLKKDLVRRIKMLEYALKQERAKYHKLKYGTELNQGDMKPPSYDSDEGNETEVQPQQNSQLMWKQGRQLLRQYLQEVGYTDTILDVKSKRVRALLGFSSDVTDREDDKNQDSVVNGTEAEVKETAMIAKSELTDSASVLDNFKFLESAAADFSDEDEDDDVDGREKSVIDTSTIVRKKALPDSGEDRDTKEALKEFDFLVTSEEGDNESRSAGDGTDWEKEDQCLMPEAWNVDQGVITKLKEQYKKERKGKKGVKRPNRSKLQDMLANLRDVDELPSLQPSVGSPSRPSSSRLPEHEINRADEVEALTFPPSSGKSFIMGADEALESELGLGELAGLTVANEADSLTYDIANNKDALRKTWNPKFTLRSHFDGIRALAFHPIEPVLITASEDHTLKMWNLQKTAPAKKSTSLDVEPIYTFRAHKGPVLCVVMSSNGEQCYSGGTDGLIQGWNTTNPNIDPYDSYDPSVLRGPLLGHTDAVWGLAYSAAHQRLLSCSADGTLRLWNTTEVAPALSVFNDTKELGIPASVDLVSSDPSHMVASFSKGYTSIFNMETQQRILTLESNVDTTANSSCQINRVISHPTLSISITAHEDRHIKFYDNNTGKLIHSMVAHLEAVTSLAVDPNGLYLMSGSHDCSIRLWNLESKTCIQEFTAHRKKFEESIHDVAFHPSKCYIASAGADALAKVFV

SEQ ID NO: 834255 - protein, 783 aa, Homo sapiens; identical to SEQ ID NO: 834254

SEQ ID NO: 834256 - protein, 783 aa, Homo sapiens; identical to SEQ ID NO: 834254

SEQ ID NO: 834257 - protein, 783 aa, Homo sapiens; identical to SEQ ID NO: 834254

SEQ ID NO: 834258 - protein, 463 aa, Homo sapiens
MPEAWNVDQGVITKLKEQYKKERKGKKGVKRPNRSKLQDMLANLRDVDELPSLQPSVGSPSRPSSSRLPEHEINRADEVEALTFPPSSGKSFIMGADEALESELGLGELAGLTVANEADSLTYDIANNKDALRKTWNPKFTLRSHFDGIRALAFHPIEPVLITASEDHTLKMWNLQKTAPAKKSTSLDVEPIYTFRAHKGPVLCVVMSSNGEQCYSGGTDGLIQGWNTTNPNIDPYDSYDPSVLRGPLLGHTDAVWGLAYSAAHQRLLSCSADGTLRLWNTTEVAPALSVFNDTKELGIPASVDLVSSDPSHMVASFSKGYTSIFNMETQQRILTLESNVDTTANSSCQINRVISHPTLSISITAHEDRHIKFYDNNTGKLIHSMVAHLEAVTSLAVDPNGLYLMSGSHDCSIRLWNLESKTCIQEFTAHRKKFEESIHDVAFHPSKCYIASAGADALAKVFV

SEQ ID NO: 834259 - protein, 1134 aa, Homo sapiens
MSQPPPPPPPLPPPPPPPEAPQTPSSLASAAASGGLLKRRDRRILSGSCPDPKCQARLFFPASGSVSIECTECGQRHEQQQLLGVEEVTDPDVVLHNLLRNALLGVTGAPKKNTELVKVMGLSNYHCKLLSPILARYGMDKQTGRAKLLRDMNQGELFDCALLGDRAFLIEPEHVNTVGYGKDRSGSLLYLHDTLEDIKRANKSQECLIPVHVDGDGHCLVHAVSRALVGRELFWHALRENLKQHFQQHLARYQALFHDFIDAAEWEDIINECDPLFVPPEGVPLGLRNIHIFGLANVLHRPIILLDSLSGMRSSGDYSATFLPGLIPAEKCTGKDGHLNKPICIAWSSSGRNHYIPLVGIKGAALPKLPMNLLPKAWGVPQDLIKKYIKLEEDGGCVIGGDRSLQDKYLLRLVAAMEEVFMDKHGIHPSLVADVHQYFYRRTGVIGVQPEEVTAAAKKAVMDNRLHKCLLCGALSELHVPPEWLAPGGKLYNLAKSTHGQLRTDKNYSFPLNNLVCSYDSVKDVLVPDYGMSNLTACNWCHGTSVRKVRGDGSIVYLDGDRTNSRSTGGKCGCGFKHFWDGKEYDNLPEAFPITLEWGGRVVRETVYWFQYESDSSLNSNVYDVAMKLVTKHFPGEFGSEILVQKVVHTILHQTAKKNPDDYTPVNIDGAHAQRVGDVQGQESESQLPTKIILTGQKTKTLHKEELNMSKTERTIQQNITEQASVMQKRKTEKLKQEQKGQPRTVSPSTIRDGPSSAPATPTKAPYSPTTSKEKKIRITTNDGRQSMVTLKSSTTFFELQESIAREFNIPPYLQCIRYGFPPKELMPPQAGMEKEPVPLQHGDRITIEILKSKAEGGQSAAAHSAHTVKQEDIAVTGKLSSKELQEQAEKEMYSLCLLATLMGEDVWSYAKGLPHMFQQGGVFYSIMKKTMGMADGKHCTFPHLPGKTFVYNASEDRLELCVDAAGHFPIGPDVEDLVKEAVSQVRAEATTRSRESSPSHGLLKLGSGGVVKKKSEQLHNVTAFQGKGHSLGTASGNPHLDPRARETSVVRKHNTGTDFSNSSTKTEPSVFTASSSNSELIRIAPGVVTMRDGRQLDPDLVEAQRKKIAGNGFFYSGFNGQAPSGSKYRAVTI

SEQ ID NO: 834260 - protein, 219 aa, Homo sapiens
EAVGDSPPPRDGEFMRLGMADGKHCTFPHLPGKTFVYNASEDRLELCVDAAGHFPIGPDVEDLVKEAVSQVRAEATTRSRESSPSHGLLKLGSGGVVKKKSEQLHNVTAFQGKGHSLGTASGNPHLDPRARETSVVRKHNTGTDFSNSSTKTEPSVFTASSSNSELIRIAPGVVTMRDGRQLDPDLVEAQRKKIAGNGFFYSGFNGQAPSGSKYRAVTI

SEQ ID NO: 834261 - protein, 1134 aa, Homo sapiens; identical to SEQ ID NO: 834259

SEQ ID NO: 834262 - protein, 323 aa, Homo sapiens
RITDLRLRVTGLTEDHEYEFRVSAENAAGVGEPSPATVYYKACDPVFKPGPPTNAHIVDTTKNSITLAWGKPIYDGGSEILGYVVEICKADEEEWQIVTPQTGLRVTRFEISKLTEHQEYKIRVCALNKVGLGEATSVPGTVKPEDKLEAPELDLDSELRKGIVVRAGGSARIHIPFKGRPTPEITWSREEGEFTDKVQIEKGVNYTQLSIDNCDRNDAGKYILKLENSSGSKSAFVTVKVLDTPGPPQNLAVKEVRKDSAFLVWEPPIIDGGAKVKNYVIDKRESTRKAYANVSSKCSKTSFKVENLTEGAIYYFRVMAENE

SEQ ID NO: 834263 - protein, 157 aa, Homo sapiens
CEWALGVGRTGSSSTPCVYGVLEEAPGTSSLGESRSGRLTPPDPILPSATTGTPGSSRRPSGGDAEALAHPPADMGRRKSKRKPPPKKKMTGTLETQFTCPFCNHEKSCDVKMDRARNTGVISCTVCLEEFQTPITYLSEPVDVYSDWIDACEAANQ

SEQ ID NO: 834264 - protein, 101 aa, Homo sapiens
ARYEAGCDIGRGAHPPADMGRRKSKRKPPPKKKMTGTLETQFTCPFCNHEKSCDVKMDRARNTGVISCTVCLEEFQTPITYLSEPVDVYSDWIDACEAANQ

SEQ ID NO: 834265 - protein, 157 aa, Homo sapiens; identical to SEQ ID NO: 834263

SEQ ID NO: 834266 - protein, 102 aa, Homo sapiens
MRPHYVAQAGIQVLASSNPLTLASQSAGWDHRCEPPCLALSLFYRRGNCGTKSLNNLPRSRSSSTCRHGAQKVKTKAASQEEDDRHPRDPVHLPLLQPREIL

SEQ ID NO: 834267 - protein, 104 aa, Homo sapiens
MVRSRLTAVSASWVQAHPPADMGRRKSKRKPPPKKKMTGTLETQFTCPFCNHEKSCDVKMDRARNTGVISCTVCLEEFQTPITYLSEPVDVYSDWIDACEAANQ

SEQ ID NO: 834268 - protein, 104 aa, Homo sapiens; identical to SEQ ID NO: 834267

SEQ ID NO: 834269 - protein, 171 aa, Homo sapiens
AHHTVGNIGTARVNRTRQDPSKHPEPSHLSLLSPSPARGRTAALSLHTVFLYSEVPVPTSLPCSLSSGSRPSDNLSVTPPGMAHPPADMGRRKSKRKPPPKKKMTGTLETQFTCPFCNHEKSCDVKMDRARNTGVISCTVCLEEFQTPITYLSEPVDVYSDWIDACEAANQ

SEQ ID NO: 834270 - protein, 120 aa, Homo sapiens
MGRRKSKRKPPPKKKMTGTLETQFTCPFCNHEKSCDVKMDRARNTGVISCTVCLEEFQTPITCILGNLGFFQRVGRGLESGPCSSGPLCALVQGQSRPEEQVPPSDFCGVRRCRAGFQCQ

SEQ ID NO: 834271 - protein, 406 aa, Homo sapiens
MRLFRWLLKQPVPKQIERYSRFSPSPLSIKQFLDFGRDNACEKTSYMFLRKELPVRLANTMREVNLLPDNLLNRPSVGLVQSWYMQSFLELLEYENKSPEDPQVLDNFLQVLIKVRNRHNDVVPTMAQGVIEYKEKFGFDPFISTNIQYFLDRFYTNRISFRMLINQHTLLFGGDTNPVHPKHIGSIDPTCNVADVVKDAYETAKMLCEQYYLVAPELEVEEFNAKAPDKPIQVVYVPSHLFHMLFELFKNSMRATVELYEDRKEGYPAVKTLVTLGKEDLSIKISDLGGGVPLRKIDRLFNYMYSTAPRPSLEPTRAAPLAGFGYGLPISRLYARYFQGDLKLYSMEGVGTDAVIYLKALSSESFERLPVFNKSAWRHYKTTPEADDWSNPSSEPRDASKYKAKQ

SEQ ID NO: 834272 - protein, 406 aa, Homo sapiens; identical to SEQ ID NO: 834271

SEQ ID NO: 834273 - protein, 415 aa, Homo sapiens
MRLFRWLLKQPVPKQIERYSRFSPSPLSIKQFLDFGRDNACEKTSYMFLRKELPVRLANTMREVNLLPDNLLNRPSVGLVQSWYMQSFLELLEYENKSPEDPQVLDNFLQVLIKVRNRHNDVVPTMAQGVIEYKEKFGFDPFISTNIQYFLDRFYTNRISFRMLINQHTLLFGGDTNPVHPKHIGSIDPTCNVADVVKDAYETAKMLCEQYYLVAPELEVEEFNAKAPDKPIQVVYVPSHLFHMLFELFKNSMRATVELYEDRKEGYPAVKTLVTLGKEDLSIKISDLGGGVPLRKIDRLFNYMYSTAPRPSLEPTRAAPLAGFGYGLPISRLYARYFQGDLKLYSMEGVGTDAVIYLKALSSESFERLPVFNKSAWRHYKTTPEADDWSNPSSEPRDASKYKAKQDKIKTNRTF

SEQ ID NO: 834274 - protein, 426 aa, Homo sapiens
MRLFRWLLKQPVPKQIERYSRFSPSPLSIKQFLDFGRDNACEKTSYMFLRKELPVRLANTMREVNLLPDNLLNRPSVGLVQSWYMQSFLELLEYENKSPEDPQVLDNFLQVLIKVRNRHNDVVPTMAQGVIEYKEKFGFDPFISTNIQYFLDRFYTNRISFRMLINQHSKLEFVGPVLKALLFGGDTNPVHPKHIGSIDPTCNVADVVKDAYETAKMLCEQYYLVAPELEVEEFNAKAPDKPIQVVYVPSHLFHMLFELFKNSMRATVELYEDRKEGYPAVKTLVTLGKEDLSIKISDLGGGVPLRKIDRLFNYMYSTAPRPSLEPTRAAPLAGFGYGLPISRLYARYFQGDLKLYSMEGVGTDAVIYLKALSSESFERLPVFNKSAWRHYKTTPEADDWSNPSSEPRDASKYKAKQDKIKTNRTF

SEQ ID NO: 834275 - protein, 107 aa, Homo sapiens
MRLFRWLLKQPVPKQIERYSRFSPSPLSIKQFLDFGRDNACEKTSYMFLRKELPVRLANTMREVNLLPDNLLNRPSVGLVQSWYMQSFLELLEYENKSPEDPQVLDK

SEQ ID NO: 834276 - protein, 415 aa, Homo sapiens; identical to SEQ ID NO: 834273

SEQ ID NO: 834277 - protein, 223 aa, Homo sapiens
MPCDQAGMGYVAVGDHEEMASEEGSEAVRGGLRLGVVSWDGSGEPISDSKDGDKINDGRIDFDEFLKMMEGVQKEWTVASTKIACPQGGGVQRRRPATEESRSPATMTDQQAEARSYLSEEMIAEFKAAFDMFDADGGGDISVKELGTVMRMLGQTPTKEELDAIIEEVDEDGSGTIDFEEFLVMMVRQMKEDAKGKSEEELAEVLPHLRQECRRLHRPGGAG

SEQ ID NO: 834278 - protein, 223 aa, Homo sapiens; identical to SEQ ID NO: 834277

SEQ ID NO: 834279 - protein, 144 aa, Homo sapiens
LEQARSSLGGGVQRRRPATEESRSPATMTDQQAEARSYLSEEMIAEFKAAFDMFDADGGGDISVKELGTVMRMLGQTPTKEELDAIIEEVDEDGSGTIDFEEFLVMMVRQMKEDAKGKSEEELAEVLPHLRQECRRLHRPGGAG

SEQ ID NO: 834280 - protein, 102 aa, Homo sapiens
MIAEFKAAFDMFDADGGGDISVKELGTVMRMLGQTPTKEELDAIIEEVDEDGSGTIDFEEFLVMMVRQMKEDAKGKSEEELAEVLPHLRQECRRLHRPGGAG

SEQ ID NO: 834281 - protein, 130 aa, Homo sapiens
MPCDQAGMGYVAVGDHEEMASEEGSEAVRGGLRLGVVSWDGSGEPISDSKDGDKINDGRIDFDEFLKMMEGVQKEWTVASTKIACPQGGGVQRRRPATEESRSPATMTDQQAEARSYLSEEMIAEFKAAL

SEQ ID NO: 834282 - protein, 699 aa, Homo sapiens
GPPGRARARGLRRAPAAFLRRSLSLPAAFSSAAGPSSPQRSQEGRREPRTPRSSRGSRGSRPRRRLRLRRGRSAIHGEGRTAKGSAAWSARTFRSPPGVGRDPMRRAHEGREIPSLGGARRREVLQAGRSQRAAGRRRRRQELELGVGSGRPGGPPPGPGRRGTCAAALPPEWPRRRTGLPRRGPRRPLAMAKWLNKYFSLGNSKTKSPPQPPRPDYREQRRRGERPSQPPQAVPQASSAASASCGPATASCFSASSGSLPDDSGSTSDLIRAYRAQKERDFEDPYNGPGSSLRKLRAMCRLDYCGGSGEPGGVQRAFSASSASGAAGCCCASSGAGAAASSSSSSGSPHLYRSSSERRPATPAEVRYISPKHRLIKVESAAGGGAGDPLGGACAGGRTWSPTACGGKKLLNKCAASAAEESGAGKKDKVTIADDYSDPFDAKNDLKSKAGKGESAGYMEPYEAQRIMTEFQRQESVRSQHKGIQLYDTPYEPEGQSVDSDSESTVSPRLRESKLPQDDDRPADEYDQPWEWNRVTIPALAAQFNGNEKRQSSPSPSRDRRRQLRAPGGGFKPIKHGSPEFCGILGERVDPAVPLEKQIWYHGAISRGDAENLLRLCKECSYLVRNSQTSKHDYSLSLRSNQGFMHMKLAKTKEKYVLGQNSPPFDSVPEVIHYYTTRKLPIKGAEHLSLLYPVAVRTL

SEQ ID NO: 834283 - protein, 699 aa, Homo sapiens; identical to SEQ ID NO: 834282

SEQ ID NO: 834284 - protein, 530 aa, Homo sapiens
GPPGRARARGLRRAPAAFLRRSLSLPAAFSSAAGPSSPQRSQEGRREPRTPRSSRGSRGSRPRRRLRLRRGRSAIHGEGRTAKGSAAWSARTFRSPPGVGRDPMRRAHEGREIPSLGGARRREVLQAGRSQRAAGRRRRRQELELGVGSGRPGGPPPGPGRRGTCAAALPPEWPRRRTGLPRRGPRRPLAMAKWLNKYFSLGNSKTKSPPQPPRPDYREQRRRGERPSQPPQAVPQASSAASASCGPATASCFSASSGSLPDDSGSTSDLIRAYRAQKERDFEDPYNGPGSSLRKLRAMCRLDYCGGSGEPGGVQRAFSASSASGAAGCCCASSGAGAAASSSSSSGSPHLYRSSSERRPATPAEVRYISPKHRLIKVESAAGGGAGDPLGGACAGGRTWSPTACGGKKLLNKCAASAAEESGAGKKDKVTIADDYSDPFDAKNDLKSKAGKGESAGYMEPYEAQRIMTEFQRQESVRSQHKGIQLYDTPYEPEGQSVDSDSESTVSPRLRESNYPSKGLSTCPSSIPWL

SEQ ID NO: 834285 - protein, 699 aa, Homo sapiens; identical to SEQ ID NO: 834282

SEQ ID NO: 834286 - protein, 699 aa, Homo sapiens; identical to SEQ ID NO: 834282

SEQ ID NO: 834287 - protein, 531 aa, Homo sapiens
GPPGRARARGLRRAPAAFLRRSLSLPAAFSSAAGPSSPQRSQEGRREPRTPRSSRGSRGSRPRRRLRLRRGRSAIHGEGRTAKGSAAWSARTFRSPPGVGRDPMRRAHEGREIPSLGGARRREVLQAGRSQRAAGRRRRRQELELGVGSGRPGGPPPGPGRRGTCAAALPPEWPRRRTGLPRRGPRRPLAMAKWLNKYFSLGNSKTKSPPQPPRPDYREQRRRGERPSQPPQAVPQASSAASASCGPATASCFSASSGSLPDDSGSTSDLIRAYRAQKERDFEDPYNGPGSSLRKLRAMCRLDYCGGSGEPGGVQRAFSASSASGAAGCCCASSGAGAAASSSSSSGSPHLYRSSSERRPATPAEVRYISPKHRLIKVESAAGGGAGDPLGGACAGGRTWSPTACGGKKLLNKCAASAAEESGAGKKDKVTIADDYSDPFDAKNDLKSKAGKGESAGYMEPYEAQRIMTEFQRQESVRSQHKGIQLYDTPYEPEGQSVDSDSESTVKQPSVRQCPGSHPLLHHQKATHQRG

SEQ ID NO: 834288 - protein, 199 aa, Homo sapiens [sequence omitted]

SEQ ID NO: 834289 - protein, 117 aa, Homo sapiens
ALWREGPVREGEAWPADPAPSSGSSYSPALCSALCWLQEGSSLADHTDLRTKGTKHSRGNPSGPRRSAKPQRVNEIPTHHQVALLTRSTCLALKAQLSDQTPHSWWGDLTSSGSSGD

SEQ ID NO: 834290 - protein, 107 aa, Homo sapiens
ALWREGPVREGEAWPADPAPSSGSSYSPALCSALCWLQEGSSLADHTDLRTKGTKHSRGNPSGPRRSAKPQRVNEIPTGGAGRRQQAGWREQHEEQHLSPACVASMC

SEQ ID NO: 834291 - protein, 392 aa, Homo sapiens
MSLVACECLPSPGLEPEPCSRARSQAHVYLEQIRNRVALGVPDMTKRDYLVDAATQIRLALERDVSEDYEAAFNHYQNGVDVLLRGIHVDPNKERREAVKLKITKYLRRAEEIFNCHLQRPLSSGASPSAVQLVQDPATGGTFVVKSLPRCHMVSRERLTIIPHGVPYMTKLLRYFVSEDSIFLHLEHVQGHIRLTYFGQWSEVEPQCCGEAVDNLYSAPEVGGISELTEACDWWSFGSLLYELLTGMALSQSHPSGIQAHTQLQLPEWLSRPAASLLTELLQFEPTRRLGMGEGGVSKLKSHPFFSTIQWSKLVGKRAERVTEAAGLVWIASPPCLTPNPGLALYQRALGEEWRALSVLLGSHWGLRIMATTQEGPAPGKAGGGGSQGLPC

SEQ ID NO: 834292 - protein, 638 aa, Homo sapiens
MHLPIPGPSCRAAMSLVACECLPSPGLEPEPCSRARSQAHVYLEQIRNRVALGVPDMTKRDYLVDAATQIRLALERDVSEDYEAAFNHYQNGVDVLLRGIHVDPNKERREAVKLKITKYLRRAEEIFNCHLQRPLSSGASPSAGFSSLRLRPIRTLSSAVEQLRGCRVVGVIEKVQLVQDPATGGTFVVKSLPRCHMVSRERLTIIPHGVPYMTKLLRYFVSEDSIFLHLEHVQGGTLWSHLLSQAHSRHSGLSSGSTQERMKAQLNPHLNLLTPARLPSGHAPGQDRIALEPPRTSPNLLLAGEAPSTRPQREAEGEPTARTSTSGSSDLPKAPGGHLHLQARRAGQNSDAGPPRGLTWVPEGAGPVLGGCGRGMDQSCLSADGAGRGCGRATWSVREEQVKQWAAEMLVALEALHEQGVLCRDLHPGNLLLDQAGHIRLTYFGQWSEVEPQCCGEAVDNLYSAPEVGGISELTEACDWWSFGSLLYELLTGMALSQSHPSGIQAHTQLQLPEWLSRPAASLLTELLQFEPTRRLGMGEGGVSKLKSHPFFSTIQWSKLVGKRAERVTEAAGLVWIASPPCLTPNPGLALYQRALGEEWRALSVLLGSHWGLRIMATTQEGPAPGKAGGGGSQGLPC

SEQ ID NO: 834293 - protein, 199 aa, Homo sapiens [sequence omitted]

SEQ ID NO: 834294 - protein, 192 aa, Homo sapiens
PVREGEAWPADPAPSSGRYGVLSGPFSTLPGEGPPRPSLHPGTVHLAAGAPWVARAAFCVQAGPAALPGRTLPGGVDPEASPTRAPPRARPQSLKFPWAWPSRDGAASLCLLAASWPGFSSPPAEAVGLPPRPTAHPALSSFSPNDLGLEVPGPAHSQWDLGEQRRGSFVGLSLSPFPSRSHGCHPFGRLGH

SEQ ID NO: 834295 - protein, 592 aa, Homo sapiens
MSLVACECLPSPGLEPEPCSRARSQAHVYLEQIRNRVALGVPDMTKRDYLVDAATQIRLALERDVSEDYEAAFNHYQNGVDVLLRGIHVDPNKERREAVKLKITKYLRRAEEIFNCHLQRPLSSGASPSAVQLVQDPATGGTFVVKSLPRCHMVSRERLTIIPHGVPYMTKLLRYFVSEDSIFLHLEHVQGGTLWSHLLSQAHSRHSGLSSGSTQERMKAQLNPHLNLLTPARLPSGHAPGQDRIALEPPRTSPNLLLAGEAPSTRPQREAEGEPTARTSTSGSSDLPKAPGGHLHLQARRAGQNSDAGPPRGLTWVPEGAGPVLGGCGRGMDQSCLSADGAGRGCGRATWSVREEQVKQWAAEMLVALEALHEQGVLCRDLHPGNLLLDQAGHIRLTYFGQWSEVEPQCCGEAVDNLYSAPEVGGISELTEACDWWSFGSLLYELLTGMALSQSHPSGIQAHTQLQLPEWLSRPAASLLTELLQFEPTRRLGMGEGGVSKLKSHPFFSTIQWSKLVGDISGDSSQDTDPLAQWTQTRLSWLVLSVTQRVGLFHQKLFVQLGRPRSRDAICCAGRDEDSLSGPGCLPCHCLL

SEQ ID NO: 834296 - protein, 625 aa, Homo sapiens
MSLVACECLPSPGLEPEPCSRARSQAHVYLEQIRNRVALGVPDMTKRDYLVDAATQIRLALERDVSEDYEAAFNHYQNGVDVLLRGIHVDPNKERREAVKLKITKYLRRAEEIFNCHLQRPLSSGASPSAGFSSLRLRPIRTLSSAVEQLRGCRVVGVIEKVQLVQDPATGGTFVVKSLPRCHMVSRERLTIIPHGVPYMTKLLRYFVSEDSIFLHLEHVQGGTLWSHLLSQAHSRHSGLSSGSTQERMKAQLNPHLNLLTPARLPSGHAPGQDRIALEPPRTSPNLLLAGEAPSTRPQREAEGEPTARTSTSGSSDLPKAPGGHLHLQARRAGQNSDAGPPRGLTWVPEGAGPVLGGCGRGMDQSCLSADGAGRGCGRATWSVREEQVKQWAAEMLVALEALHEQGVLCRDLHPGNLLLDQAGHIRLTYFGQWSEVEPQCCGEAVDNLYSAPEVGGISELTEACDWWSFGSLLYELLTGMALSQSHPSGIQAHTQLQLPEWLSRPAASLLTELLQFEPTRRLGMGEGGVSKLKSHPFFSTIQWSKLVGKRAERVTEAAGLVWIASPPCLTPNPGLALYQRALGEEWRALSVLLGSHWGLRIMATTQEGPAPGKAGGGGSQGLPC

SEQ ID NO: 834297 - protein, 392 aa, Homo sapiens; identical to SEQ ID NO: 834291

SEQ ID NO: 834298 - protein, 219 aa, Homo sapiens
MSLVACECLPSPGLEPEPCSRARSQAHVYLEQIRNRVALGVPDMTKRDYLVDAATQIRLALERDVSEDYEAAFNHYQNGVDVLLRGIHVDPNKERREAVKLKITKYLRRAEEIFNCHLQRPLSSGASPSAGFSSLRLRPIRTLSSAVEQLRGCRVVGVIEKVQLVQDPATGGTFVVKAGATLPLPLCIPLGSFSGLLETPTQNLHLKPALPPTKAGCSA

SEQ ID NO: 834299 - protein, 541 aa, Homo sapiens
MVADPPRDSKGLAAAEPTANGGLALASIEDQGAAAGGYCGSRDQVRRCLRANLLVLLTVVAVVAGVALGLGVSGAGGALALGPERLSAFVFPGELLLRLLRMIILPLVVCSLIGGAASLDPGALGRLGAWALLFFLVTTLLASALGVGLALALQPGAASAAINASVGAAGSAENAPSKEVLDSFLDLARNIFPSNLVSAAFRSYSTTYEERNITGTRVKVPVGQEVEGMNILGLVVFAIVFGVALRKLGPEGELLIRFFNSFNEATMVLVSWIMWYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVDRSCTVLNVEGDALGAGLLQNYVDRTESRSTEPELIQVKSELPLDPLPVPTEEGNPLLKHYRGPAGDATVASEKESVM

SEQ ID NO: 834300 - protein, 541 aa, Homo sapiens; identical to SEQ ID NO: 834299

SEQ ID NO: 834301 - protein, 541 aa, Homo sapiens; identical to SEQ ID NO: 834299

SEQ ID NO: 834302 - protein, 313 aa, Homo sapiens
MNILGLVVFAIVFGVALRKLGPEGELLIRFFNSFNEATMVLVSWIMWYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVDRSCTVLNVEGDALGAGLLQNYVDRTESRSTEPELIQVKSELPLDPLPVPTEEGNPLLKHYRGPAGDATVASEKESVM

SEQ ID NO: 834303 - protein, 440 aa, Homo sapiens
MIILPLVVCSLIGGAASLDPGALGRLGAWALLFFLVTTLLASALGVGLALALQPGAASAAINASVGAAGSAENAPSKEVLDSFLDLARNIFPSNLVSAAFRSYSTTYEERNITGTRVKVPVGQEVEGMNILGLVVFAIVFGVALRKLGPEGELLIRFFNSFNEATMVLVSWIMWYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVDRSCTVLNVEGDALGAGLLQNYVDRTESRSTEPELIQVKSELPLDPLPVPTEEGNPLLKHYRGPAGDATVASEKESVM

SEQ ID NO: 834304 - protein, 541 aa, Homo sapiens; identical to SEQ ID NO: 834299

SEQ ID NO: 834305 - protein, 541 aa, Homo sapiens; identical to SEQ ID NO: 834299

SEQ ID NO: 834306 - protein, 368 aa, Homo sapiens
RKTRQDIEGRLQPSGVNIFPSNLVSAAFRSYSTTYEERNITGTRVKVPVGQEVEGMNILGLVVFAIVFGVALRKLGPEGELLIRFFNSFNEATMVLVSWIMWYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVDRSCTVLNVEGDALGAGLLQNYVDRTESRSTEPELIQVKSELPLDPLPVPTEEGNPLLKHYRGPAGDATVASEKESVM

SEQ ID NO: 834307 - protein, 365 aa, Homo sapiens
MVSNNPLCVCLCRNIFPSNLVSAAFRSYSTTYEERNITGTRVKVPVGQEVEGMNILGLVVFAIVFGVALRKLGPEGELLIRFFNSFNEATMVLVSWIMWYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVDRSCTVLNVEGDALGAGLLQNYVDRTESRSTEPELIQVKSELPLDPLPVPTEEGNPLLKHYRGPAGDATVASEKESVM

SEQ ID NO: 834308 - protein, 367 aa, Homo sapiens
MVATALAGCNTFAARSDWMLHADSEFDRPYSTTYEERNITGTRVKVPVGQEVEGMNILGLVVFAIVFGVALRKLGPEGELLIRFFNSFNEATMVLVSWIMWYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVDRSCTVLNVEGDALGAGLLQNYVDRTESRSTEPELIQVKSELPLDPLPVPTEEGNPLLKHYRGPAGDATVASEKESVM

SEQ ID NO: 834309 - protein, 283 aa, Homo sapiens
DSEDPSCRLGLVSWIMWYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVDRSCTVLNVEGDALGAGLLQNYVDRTESRSTEPELIQVKSELPLDPLPVPTEEGNPLLKHYRGPAGDATVASEKESVM

SEQ ID NO: 834310 - protein, 373 aa, Homo sapiens
MVADPPRDSKGLAAAEPTANGGLALASIEDQGAAAGGYCGSRDQVRRCLRANLLVLLTVVAVVAGVALGLGVSGAGGALALGPERLSAFVFPGELLLRLLRMIILPLVVCSLIGGAASLDPGALGRLGAWALLFFLVTTLLASALGVGLALALQPGAASAAINASVGAAGSAENAPSKEVLDSFLDLARNIFPSNLVSAAFRSYSTTYEERNITGTRVKVPVGQEVEGMNILGLVVFAIVFGVALRKLGPEGELLIRFFNSFNEATMVLVSWIMWYAPVGIMFLVAGKIVEMEDVGLLFARLGKYILCCLHAGHNYSRDAERSRYGILLDELGLVSPLVGQYDIAAHCLWDLSHVCDTRPLMMTVRGGELRCR

SEQ ID NO: 834311 - protein, 225 aa, Homo sapiens
MVADPPRDSKGLAAAEPTANGGLALASIEDQGAAAGGYCGSRDQVRRCLRANLLVLLTVVAVVAGVALGLGVSGAGGALALGPERLSAFVFPGELLLRLLRMIILPLVVCSLIGGAASLDPGALGRLGAWALLFFLVTTLLASALGVGLALALQPGAASAAINASVGAAGSAENAPSKEVLDSFLDLARNIFPSNLVSAAFRSTPRDSGERLRTNTCCHSRGHFF

SEQ ID NO: 834312 - protein, 94 aa, Homo sapiens
MVADPPRDSKGLAAAEPTANGGLALASIEDQGAAAGGYCGSRDQVRRCLRANLLVLLTVVAVVAGVALGLGVSGPGAEWAERDACSRDCADRVE

SEQ ID NO: 834313 - protein, 278 aa, Homo sapiens
MVADPPRDSKGLAAAEPTANGGLALAFVFPGELLLRLLRMIILPLVVCSLIGGAASLDPGALGRLGAWALLFFLVTTLLASALGVGLALALQPGAASAAINASVGAAGSAENAPSKEVLDSFLDLARNIFPSNLVSAAFRSYSTTYEERNITGTRVKVPVGQEVEGMNILGLVVFAIVFGVALRKLGPEGELLIRFFNSFNEATMVLVSWIMWYAPVGIMVLGWQNGAMGRWVTPWPAWKEHPAAGGQQPGRKASNISLPKNHVGGIERWRLDLDRTA

SEQ ID NO: 834314 - protein, 199 aa, Homo sapiens
MVSNNPLCVCLCRNIFPSNLVSAAFRSYSTTYEERNITGTRVKVPVGQEVEGMNILGLVVFAIVFGVALRKLGPEGELLIRFFNSFNEATMVLVSWIMWYAPVGIMFLVAGKIVEMEDVGLLFARLGKYILCCLLGHAIHGLLVLPLIYFLFTRKNPYRFLWGIVTPLATAFGTSSSSQLRDDEGGGHMAGRPSRITAL

SEQ ID NO: 834315 - protein, 541 aa, Homo sapiens; identical to SEQ ID NO: 834299

SEQ ID NO: 834316 - protein, 541 aa, Homo sapiens; identical to SEQ ID NO: 834299

SEQ ID NO: 834317 - protein, 541 aa, Homo sapiens; identical to SEQ ID NO: 834299

SEQ ID NO: 834318 - protein, 541 aa, Homo sapiens; identical to SEQ ID NO: 834299

SEQ ID NO: 834319 - protein, 541 aa, Homo sapiens; identical to SEQ ID NO: 834299

SEQ ID NO: 834320 - protein, 313 aa, Homo sapiens; identical to SEQ ID NO: 834302

SEQ ID NO: 834321 - protein, 339 aa, Homo sapiens
MYSTTYEERNITGTRVKVPVGQEVEGMNILGLVVFAIVFGVALRKLGPEGELLIRFFNSFNEATMVLVSWIMWYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVDRSCTVLNVEGDALGAGLLQNYVDRTESRSTEPELIQVKSELPLDPLPVPTEEGNPLLKHYRGPAGDATVASEKESVM

SEQ ID NO: 834322 - protein, 383 aa, Homo sapiens
MVADPPRDSKGLAAAEPTANGGLALASIEDQGAAAGGYCGSRDQVRRCLRANLLVLLTVVAVVAGVALGLGVSGAGGALALGPERLSAFVFPGELLLRLLRMIILPLVVCSLIGGAASLDPGALGRLGAWALLFFLVTTLLASALGVGLALALQPGAASAAINASVGAAGSAENAPSKEVLDSFLDLARNIFPSNLVSAAFRSYSTTYEERNITGTRVKVPVGQEVEGMNILGLVVFAIVFGVALRKLGPEGELLIRFFNSFNEATMVLVSWIMWYAPVGIMFLVAGKIVEMEDVGLLFARLGKYILCCLLGHAIHGLLVLPLIYFLFTRKNPYRFLWGIVTPLATAFGTSSSSGSCVMMNAVGRTGGASIAYRPCAGNEAAQ

SEQ ID NO: 834323 - protein, 257 aa, Homo sapiens
MVADPPRDSKGLAAAEPTANGGLALASIEDQGAAAGGYCGSRDQVRRCLRANLLVLLTVVAVVAGVALGLGVSGAGGALALGPERLSAFVFPGELLLRLLRMIILPLVVCSLIGGAASLDPGALGRLGAWALLFFLVTTLLASALGVGLALALQPGAASAAINASVGAAGSAENAPSKEVLDSFLDLARNIFPSNLVSAAFRSYSTTYEERNITGTRVKVPVGQEVEGMNILGLVVCGGMCVCTCVCVCVCVCVCVL

SEQ ID NO: 834324 - protein, 190 aa, Homo sapiens
MVADPPRDSKGLAAAEPTANGGLALASIEDQGAAAGGYCGSRDQVRRCLRANLLVLLTVVAVVAGVALGLGVSGAGGALALGPERLSAFVFPGELLLRLLRMIILPLVVCSLIGGAASLDPGALGRLGAWALLFFLVTTLLASALGVGLALALQPGAARASSSWTGQAKCPRGCHSSGLEKFLTVELLLL

SEQ ID NO: 834325 - protein, 1172 aa, Homo sapiens [sequence omitted]

SEQ ID NO: 834326 - protein, 1172 aa, Homo sapiens [sequence omitted]

SEQ ID NO: 834327 - protein, 1172 aa, Homo sapiens [sequence omitted]

SEQ ID NO: 834328 - protein, 342 aa, Homo sapiens [sequence omitted]

SEQ ID NO: 834329 - protein, 1083 aa, Homo sapiens
MRPFFLLCFALPGLLHAQQACSRGACYPPVGDLLVGRTRFLRASSTCGLTKPETYCTQYGEWQMKCCKCDSRQPHNYYSHRVENVASSSGPMRWWQSQNDVNPVSLQLDLDRRFQLQEVMMEFQGPMPAGMLIERSSDFGKTWRVYQYLAADCTSTFPRVRQGRPQSWQDVRCQSLPQRPNARLNGGKVQLNLMDLVSGIPATQSQKIQEVGEITNLRVNFTRLAPVPQRGYHPPSAYYAVSQLRLQGSCFCHGHADRCAPKPGASAGPSTAVQVHDVCVCQHNTAGPNCERCAPFYNNRPWRPAEGQDAHECQRCDCNGHSETCHFDPAVFAASQGAYGGVCDNCRDHTEGKNCERCQLHYFRNRRPGASIQETCISCECDPDGAVPGAPCDPVTGQCVCKEHVQGERCDLCKPGFTGLTYANPQGCHRCDCNILGSRRDMPCDEESGRCLCLPNVVGPKCDQCAPYHWKLASGQGCEPCACDPHNSLSPQCNQFTGQCPCREGFGGLMCSAAAIRQCPDRTYGDVATGCRACDCDFRGTEGPGCDKASGRCLCRPGLTGPRCDQCQRGYCNRYPVCVACHPCFQTYDADLREQALRFGRLRNATASLWSGPGLEDRGLASRILDAKSKIEQIRAVLSSPAVTEQEVAQVASAILSLRRTLQGLQLDLPLEEETLSLPRDLESLDRSFNGLLTMYQRKREQFEKISSADPSGAFRMLSTAYEQSAQAAQQVSDSSRLLDQLRDSRREAERLVRQAGGGGGTGSPKLVALRLEMSSLPDLTPTFNKLCGNSRQMACTPISCPGELCPQDNGTACGSRCRGVLPRAGGAFLMAGQVAEQLRGFNAQLQRTRQMIRAAEESASQIQSSAQRLETQVSASRSQMEEDVRRTRLLIQQVRDFLTDPDTDAATIQEVSEAVLALWLPTDSATVLQKMNEIQAIAARLPNVDLVLSQTKQDIARARRLQAEAEEARSRAHAVEGQVEDVVGNLRQGTVALQEAQDTMQGTSRSLRLIQDRVAEVQQVLRPAEKLVTSMTKQLGDFWTRMEELRHQARQQGAEAVQAQQLAEGASEQALSAQEGFERIRH

SEQ ID NO: 834330 - protein, 913 aa, Homo sapiens
MRPFFLLCFALPGLLHAQQACSRGACYPPVGDLLVGRTRFLRASSTCGLTKPETYCTQYGEWQMKCCKCDSRQPHNYYSHRVENVASSSGPMRWWQSQNDVNPVSLQLDLDRRFQLQEVMMEFQGPMPAGMLIERSSDFGKTWRVYQYLAADCTSTFPRVRQGRPQSWQDVRCQSLPQRPNARLNGGKVQLNLMDLVSGIPATQSQKIQEVGEITNLRVNFTRLAPVPQRGYHPPSAYYAVSQLRLQGSCFCHGHADRCAPKPGASAGPSTAVQVHDVCVCQHNTAGPNCERCAPFYNNRPWRPAEGQDAHECQRCDCNGHSETCHFDPAVFAASQGAYGGVCDNCRDHTEGKNCERCQLHYFRNRRPGASIQETCISCECDPDGAVPGAPCDPVTGQCVCKEHVQGERCDLCKPGFTGLTYANPQGCHRCDCNILGSRRDMPCDEESGRCLCLPNVVGPKCDQCAPYHWKLASGQGCEPCACDPHNSLSPQCNQFTGQCPCREGFGGLMCSAAAIRQCPDRTYGDVATGCRACDCDFRGTEGPGCDKASGRCLCRPGLTGPRCDQCQRGYCNRYPVCVACHPCFQTYDADLREQALRFGRLRNATASLWSGPGLEDRGLASRILDAKSKIEQIRAVLSSPAVTEQEVAQVASAILSLRRTLQGLQLDLPLEEETLSLPRDLESLDRSFNGLLTMYQRKREQFEKISSADPSGAFRMLSTAYEQSAQAAQQVSDSSRLLDQLRDSRREAERLVRQAGGGGGTGSPKLVALRLEMSSLPDLTPTFNKLCGNSRQMACTPISCPGELCPQDNGTACGSRCRGVLPRAGGAFLMAGQVAEQLRGFNAQLQRTRQMIRAAEESASQIQSSAQRLETQVSASRSQMEEDVRRTRLLIQQVRDFLTDPDTDSSLRGNAP

SEQ ID NO: 834331 - protein, 814 aa, Homo sapiens
MRPFFLLCFALPGLLHAQQACSRGACYPPVGDLLVGRTRFLRASSTCGLTKPETYCTQYGEWQMKCCKCDSRQPHNYYSHRVENVASSSGPMRWWQSQNDVNPVSLQLDLDRRFQLQEVMMEFQGPMPAGMLIERSSDFGKTWRVYQYLAADCTSTFPRVRQGRPQSWQDVRCQSLPQRPNARLNGGKVQLNLMDLVSGIPATQSQKIQEVGEITNLRVNFTRLAPVPQRGYHPPSAYYAVSQLRLQGSCFCHGHADRCAPKPGASAGPSTAVQVHDVCVCQHNTAGPNCERCAPFYNNRPWRPAEGQDAHECQRCDCNGHSETCHFDPAVFAASQGAYGGVCDNCRDHTEGKNCERCQLHYFRNRRPGASIQETCISCECDPDGAVPGAPCDPVTGQCVCKEHVQGERCDLCKPGFTGLTYANPQGCHRCDCNILGSRRDMPCDEESGRCLCLPNVVGPKCDQCAPYHWKLASGQGCEPCACDPHNSLSPQCNQFTGQCPCREGFGGLMCSAAAIRQCPDRTYGDVATGCRACDCDFRGTEGPGCDKASGRCLCRPGLTGPRCDQCQRGYCNRYPVCVACHPCFQTYDADLREQALRFGRLRNATASLWSGPGLEDRGLASRILDAKSKIEQIRAVLSSPAVTEQEVAQVASAILSLRRTLQGLQLDLPLEEETLSLPRDLESLDRSFNGLLTMYQRKREQFEKISSADPSGAFRMLSTAYEQSAQAAQQVSDSSRLLDQLRDSRREAERLVRQAGGGGGTGSPKLVALRLEMSSLPDLTPTFNKVTWGMESHFLEPTPQLVTHQLLPPAILL

SEQ ID NO: 834332 - protein, 196 aa, Homo sapiens [sequence omitted]

SEQ ID NO: 834333 - protein, 1172 aa, Homo sapiens [sequence omitted]

SEQ ID NO: 834334 - protein, 1199 aa, Homo sapiens
RGLHCCTQFALLCPRKGPFWGSPHWLKMRPFFLLCFALPGLLHAQQACSRGACYPPVGDLLVGRTRFLRASSTCGLTKPETYCTQYGEWQMKCCKCDSRQPHNYYSHRVENVASSSGPMRWWQSQNDVNPVSLQLDLDRRFQLQEVMMEFQGPMPAGMLIERSSDFGKTWRVYQYLAADCTSTFPRVRQGRPQSWQDVRCQSLPQRPNARLNGGKVQLNLMDLVSGIPATQSQKIQEVGEITNLRVNFTRLAPVPQRGYHPPSAYYAVSQLRLQGSCFCHGHADRCAPKPGASAGPSTAVQVHDVCVCQHNTAGPNCERCAPFYNNRPWRPAEGQDAHECQRCDCNGHSETCHFDPAVFAASQGAYGGVCDNCRDHTEGKNCERCQLHYFRNRRPGASIQETCISCECDPDGAVPGAPCDPVTGQCVCKEHVQGERCDLCKPGFTGLTYANPQGCHRCDCNILGSRRDMPCDEESGRCLCLPNVVGPKCDQCAPYHWKLASGQGCEPCACDPHNSLSPQCNQFTGQCPCREGFGGLMCSAAAIRQCPDRTYGDVATGCRACDCDFRGTEGPGCDKASGRCLCRPGLTGPRCDQCQRGYCNRYPVCVACHPCFQTYDADLREQALRFGRLRNATASLWSGPGLEDRGLASRILDAKSKIEQIRAVLSSPAVTEQEVAQVASAILSLRRTLQGLQLDLPLEEETLSLPRDLESLDRSFNGLLTMYQRKREQFEKISSADPSGAFRMLSTAYEQSAQAAQQVSDSSRLLDQLRDSRREAERLVRQAGGGGGTGSPKLVALRLEMSSLPDLTPTFNKLCGNSRQMACTPISCPGELCPQDNGTACGSRCRGVLPRAGGAFLMAGQVAEQLRGFNAQLQRTRQMIRAAEESASQIQSSAQRLETQVSASRSQMEEDVRRTRLLIQQVRDFLTDPDTDAATIQEVSEAVLALWLPTDSATVLQKMNEIQAIAARLPNVDLVLSQTKQDIARARRLQAEAEEARSRAHAVEGQVEDVVGNLRQGTVALQEAQDTMQGTSRSLRLIQDRVAEVQQVLRPAEKLVTSMTKQLGDFWTRMEELRHQARQQGAEAVQAQQLAEGASEQALSAQEGFERIKQKYAELKDRLGQSSMLGEQGARIQSVKTEAEELFGETMEMMDRMKDMELELLRGSQAIMLRSADLTGLEKRVEQIRDHINGRVLYYATCK

SEQ ID NO: 834335 - protein, 319 aa, Homo sapiens
KGGSSSLGHHGRGATVGAFHKCCSAEERPRISGEVSGLLQSNACCLPDPDTDAATIQEVSEAVLALWLPTDSATVLQKMNEIQAIAARLPNVDLVLSQTKQDIARARRLQAEAEEARSRAHAVEGQVEDVVGNLRQGTVALQEAQDTMQGTSRSLRLIQDRVAEVQQVLRPAEKLVTSMTKQLGDFWTRMEELRHQARQQGAEAVQAQQLAEGASEQALSAQEGFERIKQKYAELKDRLGQSSMLGEQGARIQSVKTEAEELFGETMEMMDRMKDMELELLRGSQAIMLRSADLTGLEKRVEQIRDHINGRVLYYATCK

SEQ ID NO: 834336 - protein, 882 aa, Homo sapiens
MRPFFLLCFALPGLLHAQQACSRGACYPPVGDLLVGRTRFLRASSTCGLTKPETYCTQYGEWQMKCCKCDSRQPHNYYSHRVENVASSSGPMRWWQSQNDVNPVSLQLDLDRRFQLQEVMMEFQGPMPAGMLIERSSDFGKTWRVYQYLAADCTSTFPRVRQGRPQSWQDVRCQSLPQRPNARLNGGKVQLNLMDLVSGIPATQSQKIQEVGEITNLRVNFTRLAPVPQRGYHPPSAYYAVSQLRLQGSCFCHGHADRCAPKPGASAGPSTAVQVHDVCVCQHNTAGPNCERCAPFYNNRPWRPAEGQDAHECQRCDCNGHSETCHFDPAVFAASQGAYGGVCDNCRDHTEGKNCERCQLHYFRNRRPGASIQETCISCECDPDGAVPGAPCDPVTGQCVCKEHVQGERCDLCKPGFTGLTYANPQGCHRCDCNILGSRRDMPCDEESGRCLCLPNVVGPKCDQCAPYHWKLASGQGCEPCACDPHNSLSPQCNQFTGQCPCREGFGGLMCSAAAIRQCPDRTYGDVATGCRACDCDFRGTEGPGCDKASGRCLCRPGLTGPRCDQCQRGYCNRYPVCVACHPCFQTYDADLREQALRFGRLRNATASLWSGPGLEDRGLASRILDAKSKIEQIRAVLSSPAVTEQEVAQVASAILSLRRTLQGLQLDLPLEEETLSLPRDLESLDRSFNGLLTMYQRKREQFEKISSADPSGAFRMLSTAYEQSAQAAQQVSDSSRLLDQLRDSRREAERLVRQAGGGGGTGSPKLVALRLEMSSLPDLTPTFNKLCGNSRQMACTPISCPGELCPQDNGTACGSRCRGVLPRAGGAFLMAGQVAEQLRGFNAQLQRTRQMIRAAEESASQIQSSAQRLETQVSASRSQME

SEQ ID NO: 834337 - protein, 273 aa, Homo sapiens
MRPFFLLCFALPGLLHAQQACSRGACYPPVGDLLVGRTRFLRASSTCGLTKPETYCTQYGEWQMKCCKCDSRQPHNYYSHRVENVASSSGPMRWWQSQNDVNPVSLQLDLDRRFQLQEVMMEFQGPMPAGMLIERSSDFGKTWRVYQYLAADCTSTFPRVRQGRPQSWQDVRCQSLPQRPNARLNGGKVQLNLMDLVSGIPATQSQKIQEVGEITNLRVNFTRLAPVPQRGYHPPSAYYALKLRALKSRKLGWAVSPAFSSPLGRNPGPSTKT

SEQ ID NO: 834338 - protein, 86 aa, Homo sapiens
APVPPLCTLPLSPQGPMPAGMLIERSSDFGKTWRVYQYLAADCTSTFPRVRQGRPQSWQDVRCQSLPQRPNARLNGGKVGRGNPEK

SEQ ID NO: 834339 - protein, 130 aa, Homo sapiens; identical to SEQ ID NO: 747898

SEQ ID NO: 834340 - protein, 136 aa, Homo sapiens
RPNIQAVLLPKKTESRHKAKGKRNASRAGLQFPVGRVHRLLRKGNYSERVGAGAPVYLAAVLEYLTAEILELAGNAARDNKKTRIIPRHLQLAIRNDEELNKLLGRVTIAQGGVLPNIQAVLLPKKTESHHKAKGK

SEQ ID NO: 834341 - protein, 130 aa, Homo sapiens; identical to SEQ ID NO: 747898

SEQ ID NO: 834342 - protein, 1458 aa, Homo sapiens
QVAGRWGWYSPRRLCCSRCRLLLARWHSAAFKVRAGARQELAMKSLKSRLRRQDVPGPASSGAAAASAHAADWNKYDDRLMKAAERGDVEKVTSILAKKGVNPGKLDVEGRSVFHVVTSKGNLECLNAILIHGVDITTSDTAGRNALHLAAKYGHALCLQKLLQYNCPTEHADLQGRTALHDAAMADCPSSIQLLCDHGASVNAKDVDGRTPLVLATQMSRPTICQLLIDRGADVNSRDKQNRTALMLGCEYGCRDAVEVLIKNGADISLLDALGHDSSYYARIGDNLDILTLLKTASENTNKGRELWKKGPSLQQRNLTHMQDEVNVKSHQREHQNIQDLEIENEDLKERLRKIQQEQRILLDKVNGLQLQLNEEVMVADDLESEREKLKSLLAAKEKQHEESLRTIEALKNRFKYFESDHLGSGSHFSNRKEDMLLKQGQMYMADSQCTSPGIPAHMQSRSMLRPLELSLPSQTSYSENEILKKELEAMRTFCESAKQDRLKLQNELAHKVAECKALALECERVKEDSDEQIKQLEDALKDVQKRMYESEGKVKQMQTHFLALKEHLTSEAASGNHRLTEELKDQLKDLKVKYEGASAEVGKLRNQIKQNEMIVEEFKRDEGKLIEENKRLQKELSMCEMEREKKGRKVTEMEGQAKELSAKLALSIPAEKFENMKSSLSNEVNEKAKKLVEMEREHEKSLSEIRQLKRELENVKAKLAQHVKPEEHEQVKSRLEQKSGELGKKITELTLKNQTLQKEIEKVYLDNKLLKEQAHNLTIEMKNHYVPLKVSEDMKKSHDAIIDDLNRKLLDVTQKYTEKKLEMEKLLLENDSLSKDVSRLETVFVPPEKHEKEIIALKSNIVELKKQLSELKKKCGEDQEKIHALTSENTNLKKMMSNQYVPVKTHEEVKMTLNDTLAKTNRELLDVKKKFEDINQEFVKIKDKNEILKRNLENTQNQIKAEYISLAEHEAKMSSLSQSMRKVQDSNAEILANYRKGQEEIVTLHAEIKAQKKELDTIQECIKVKYAPIVSFEECERKFKATEKELKDQLSEQTQKYSVSEEEVKKNKQENDKLKKEIFTLQKDLRDKTVLIEKSHEMERALSRKTDELNKQLKDLSQKYTEVKNVKEKLVEENAKQTSEILAVQNLLQKQHVPLEQVEALKKSLNGTIENLKEELKSMQRCYEKEQQTVTKLHQLLENQKNSSVPLAEHLQIKEAFEKEVGIIKASLREKEEESQNKMEEVSKLQSEVQNTKQALKKLETREVVDLSKYKATKSDLETQISSLNEKLANLNRKYEEVCEEVLHAKKKEISAKDEKELLHFSIEQEIKDQKERCDKSLTTITELQRRIQESAKQIEAKDNKITELLNDVERLKQALNGLSQLTYTSGNPTKRQSQLIDTLQHQVKSLEQQLADADRQHQEVIAIYRTHLLSAAQGHMDEDVQEALLQIIQMRQGLVC

SEQ ID NO: 834343 - protein, 1318 aa, Homo sapiens
MLFKDLFILLRSEGLSVSSLPYLLIFYFGGAQRSKYISVLSLQINVTSPSSSFFFFFKLSSFSELAMQCFIAQLLLCIYYKFFLKFCDFSENKSLIIFKICYYLVFLNKLYLIYLKHSLKGPFHFGVLNRNTATLCYVQLMLDKLKITNWVYCQLRKIYFSVFLHLLTVFSYVLPKRNLTHMQDEVNVKSHQREHQNIQDLEIENEDLKERLRKIQQEQRILLDKVNGLQLQLNEEVMVADDLESEREKLKSLLAAKEKQHEESLRTIEALKNRFKYFESDHLGSGSHFSNRKEDMLLKQGQMYMADSQCTSPGIPAHMQSRSMLRPLELSLPSQTSYSENEILKKELEAMRTFCESAKQDRLKLQNELAHKVAECKALALECERVKEDSDEQIKQLEDALKDVQKRMYESEGKVKQMQTHFLALKEHLTSEAASGNHRLTEELKDQLKDLKVKYEGASAEVGKLRNQIKQNEMIVEEFKRDEGKLIEENKRLQKELSMCEMEREKKGRKVTEMEGQAKELSAKLALSIPAEKFENMKSSLSNEVNEKAKKLVEMEREHEKSLSEIRQLKRELENVKAKLAQHVKPEEHEQVKSRLEQKSGELGKKITELTLKNQTLQKEIEKVYLDNKLLKEQAHNLTIEMKNHYVPLKVSEDMKKSHDAIIDDLNRKLLDVTQKYTEKKLEMEKLLLENDSLSKDVSRLETVFVPPEKHEKEIIALKSNIVELKKQLSELKKKCGEDQEKIHALTSENTNLKKMMSNQYVPVKTHEEVKMTLNDTLAKTNRELLDVKKKFEDINQEFVKIKDKNEILKRNLENTQNQIKAEYISLAEHEAKMSSLSQSMRKVQDSNAEILANYRKGQEEIVTLHAEIKAQKKELDTIQECIKVKYAPIVSFEECERKFKATEKELKDQLSEQTQKYSVSEEEVKKNKQENDKLKKEIFTLQKDLRDKTVLIEKSHEMERALSRKTDELNKQLKDLSQKYTEVKNVKEKLVEENAKQTSEILAVQNLLQKQHVPLEQVEALKKSLNGTIENLKEELKSMQRCYEKEQQTVTKLHQLLENQKNSSVPLAEHLQIKEAFEKEVGIIKASLREKEEESQNKMEEVSKLQSEVQNTKQALKKLETREVVDLSKYKATKSDLETQISSLNEKLANLNRKYEEVCEEVLHAKKKEISAKDEKELLHFSIEQEIKDQKERCDKSLTTITELQRRIQESAKQIEAKDNKITELLNDVERLKQALNGLSQLTYTSGNPTKRQSQLIDTLQHQVKSLEQQLADADRQHQEVIAIYRTHLLSAAQGHMDEDVQEALLQIIQMRQGLVC

SEQ ID NO: 834344 - protein, 1608 aa, Homo sapiens
MLFKDLFILLRSEGLSVSSLPYLLIFYFGGAQRSKYISVLSLQINVTSPSSSFFFFFKLSSFSELAMQCFIAQLLLCIYYKFFLKFCDFSENKSLIIFKICYYLVFLNKLYLIYLKHSLKGPFHFGVLNRNTATLCYVQLMLDKLKITNWVYCQLRKIYFSVFLHLLTVFSYVLPKRNLTHMQDEVNVKSHQREHQNIQDLEIENEDLKERLRKIQQEQRILLDKVNGLQLQLNEEVMVADDLESEREKLKSLLAAKEKQHEESLRTIEALKNRFKYFESDHLGSGSHFSNRKYKSMDYHYSSPSSSKEECLSYLFNYTGITVQDIPAAKLHQHMELGRRYDDYCNFYHILIITEALILLSYLYFKIVYCMNYQICLVDVVDIDICLVIFRVHFFYGKNINKFSNLEKSVLMQVGILKLHLRIIFRPYIIFFILQCETVSLENLFLFPSDYETILSYNSNIYAINLNHHFVLIDYKIYVLLSCEPSLRVLNISEVLVILLRESIEKNKKKKNQPSICCSEIVGTSVYRNNKGKMGILEEDTFVLYLLLLFYLNNKGNNIKLMFAYFSMDIEVKMSFICIYLGKEDMLLKQGQMYMADSQCTSPGIPAHMQSRSMLRPLELSLPSQTSYSENEILKKELEAMRTFCESAKQDRLKLQNELAHKVAECKALALECERVKEDSDEQIKQLEDALKDVQKRMYESEGKVKQMQTHFLALKEHLTSEAASGNHRLTEELKDQLKDLKVKYEGASAEVGKLRNQIKQNEMIVEEFKRDEGKLIEENKRLQKELSMCEMEREKKGRKVTEMEGQAKELSAKLALSIPAEKFENMKSSLSNEVNEKAKKLVEMEREHEKSLSEIRQLKRELENVKAKLAQHVKPEEHEQVKSRLEQKSGELGKKITELTLKNQTLQKEIEKVYLDNKLLKEQAHNLTIEMKNHYVPLKVSEDMKKSHDAIIDDLNRKLLDVTQKYTEKKLEMEKLLLENDSLSKDVSRLETVFVPPEKHEKEIIALKSNIVELKKQLSELKKKCGEDQEKIHALTSENTNLKKMMSNQYVPVKTHEEVKMTLNDTLAKTNRELLDVKKKFEDINQEFVKIKDKNEILKRNLENTQNQIKAEYISLAEHEAKMSSLSQSMRKVQDSNAEILANYRKGQEEIVTLHAEIKAQKKELDTIQECIKVKYAPIVSFEECERKFKATEKELKDQLSEQTQKYSVSEEEVKKNKQENDKLKKEIFTLQKDLRDKTVLIEKSHEMERALSRKTDELNKQLKDLSQKYTEVKNVKEKLVEENAKQTSEILAVQNLLQKQHVPLEQVEALKKSLNGTIENLKEELKSMQRCYEKEQQTVTKLHQLLENQKNSSVPLAEHLQIKEAFEKEVGIIKASLREKEEESQNKMEEVSKLQSEVQNTKQALKKLETREVVDLSKYKATKSDLETQISSLNEKLANLNRKYEEVCEEVLHAKKKEISAKDEKELLHFSIEQEIKDQKERCDKSLTTITELQRRIQESAKQIEAKDNKITELLNDVERLKQALNGLSQLTYTSGNPTKRQSQLIDTLQHQVKSLEQQLADADRQHQEVIAIYRTHLLSAAQGHMDEDVQEALLQIIQMRQGLVC

SEQ ID NO: 834345 - protein, 891 aa, Homo sapiens
MSNSGRREKTEKQEKQHGRSIGKRTRRYEGASAEVGKLRNQIKQNEMIVEEFKRDEGKLIEENKRLQKELSMCEMEREKKGRKVTEMEGQAKELSAKLALSIPAEKFENMKSSLSNEVNEKAKKLVEMEREHEKSLSEIRQLKRELENVKAKLAQHVKPEEHEQVKSRLEQKSGELGKKITELTLKNQTLQKEIEKVYLDNKLLKEQAHNLTIEMKNHYVPLKVSEDMKKSHDAIIDDLNRKLLDVTQKYTEKKLEMEKLLLENDSLSKDVSRLETVFVPPEKHEKEIIALKSNIVELKKQLSELKKKCGEDQEKIHALTSENTNLKKMMSNQYVPVKTHEEVKMTLNDTLAKTNRELLDVKKKFEDINQEFVKIKDKNEILKRNLENTQNQIKAEYISLAEHEAKMSSLSQSMRKVQDSNAEILANYRKGQEEIVTLHAEIKAQKKELDTIQECIKVKYAPIVSFEECERKFKATEKELKDQLSEQTQKYSVSEEEVKKNKQENDKLKKEIFTLQKDLRDKTVLIEKSHEMERALSRKTDELNKQLKDLSQKYTEVKNVKEKLVEENAKQTSEILAVQNLLQKQHVPLEQVEALKKSLNGTIENLKEELKSMQRCYEKEQQTVTKLHQLLENQKNSSVPLAEHLQIKEAFEKEVGIIKASLREKEEESQNKMEEVSKLQSEVQNTKQALKKLETREVVDLSKYKATKSDLETQISSLNEKLANLNRKYEEVCEEVLHAKKKEISAKDEKELLHFSIEQEIKDQKERCDKSLTTITELQRRIQESAKQIEAKDNKITELLNDVERLKQALNGLSQLTYTSGNPTKRQSQLIDTLQHQVKSLEQQLADADRQHQEVIAIYRTHLLSAAQGHMDEDVQEALLQIIQMRQGLVC

SEQ ID NO: 834346 - protein, 271 aa, Homo sapiens
MMNCWFSCTPKNRHAADWNKYDDRLMKAAERGDVEKVTSILAKKGVNPGKLDVEGRSVFHVVTSKGNLECLNAILIHGVDITTSDTAGRNALHLAAKYGHALCLQKLLQYNCPTEHADLQGRTALHDAAMADCPSSIQLLCDHGASVNAKDVDGRTPLVLATQMSRPTICQLLIDRGADVNSRDKQNRTALMLGCEYGCRDAVEVLIKNGADISLLDALGHDSSYYARIGDNLDILTLLKTASENTNKGRELWKKGPSLQQAFSFSLVRGT

SEQ ID NO: 834347 - protein, 325 aa, Homo sapiens
MMNCWFSCTPKNRHAADWNKYDDRLMKAAERGDVEKVTSILAKKGVNPGKLDVEGRSVFHVVTSKGNLECLNAILIHGVDITTSDTAGRNALHLAAKYGHALCLQKLLQYNCPTEHADLQGRTALHDAAMADCPSSIQLLCDHGASVNAKDVDGRTPLVLATQMSRPTICQLLIDRGADVNSRDKQNRTALMLGCEYGCRDAVEVLIKNGADISLLDALGHDSSYYARIGDNLDILTLLKTASENTNKGRELWKKGPSLQQRNLTHMQDEVNVKSHQREHQNIQDLEIENEDLKERLRKIQQEQRILLDKVNGLQLQLNEEFRGP

SEQ ID NO: 834348 - protein, 1252 aa, Homo sapiens
MQCFIAQLLLCIYYKFFLKFCDFSENKSLIIFKICYYLVFLNKLYLIYLKHSLKGPFHFGVLNRNTATLCYVQLMLDKLKITNWVYCQLRKIYFSVFLHLLTVFSYVLPKRNLTHMQDEVNVKSHQREHQNIQDLEIENEDLKERLRKIQQEQRILLDKVNGLQLQLNEEVMVADDLESEREKLKSLLAAKEKQHEESLRTIEALKNRFKYFESDHLGSGSHFSNRKEDMLLKQGQMYMADSQCTSPGIPAHMQSRSMLRPLELSLPSQTSYSENEILKKELEAMRTFCESAKQDRLKLQNELAHKVAECKALALECERVKEDSDEQIKQLEDALKDVQKRMYESEGKVKQMQTHFLALKEHLTSEAASGNHRLTEELKDQLKDLKVKYEGASAEVGKLRNQIKQNEMIVEEFKRDEGKLIEENKRLQKELSMCEMEREKKGRKVTEMEGQAKELSAKLALSIPAEKFENMKSSLSNEVNEKAKKLVEMEREHEKSLSEIRQLKRELENVKAKLAQHVKPEEHEQVKSRLEQKSGELGKKITELTLKNQTLQKEIEKVYLDNKLLKEQAHNLTIEMKNHYVPLKVSEDMKKSHDAIIDDLNRKLLDVTQKYTEKKLEMEKLLLENDSLSKDVSRLETVFVPPEKHEKEIIALKSNIVELKKQLSELKKKCGEDQEKIHALTSENTNLKKMMSNQYVPVKTHEEVKMTLNDTLAKTNRELLDVKKKFEDINQEFVKIKDKNEILKRNLENTQNQIKAEYISLAEHEAKMSSLSQSMRKVQDSNAEILANYRKGQEEIVTLHAEIKAQKKELDTIQECIKVKYAPIVSFEECERKFKATEKELKDQLSEQTQKYSVSEEEVKKNKQENDKLKKEIFTLQKDLRDKTVLIEKSHEMERALSRKTDELNKQLKDLSQKYTEVKNVKEKLVEENAKQTSEILAVQNLLQKQHVPLEQVEALKKSLNGTIENLKEELKSMQRCYEKEQQTVTKLHQLLENQKNSSVPLAEHLQIKEAFEKEVGIIKASLREKEEESQNKMEEVSKLQSEVQNTKQALKKLETREVVDLSKYKATKSDLETQISSLNEKLANLNRKYEEVCEEVLHAKKKEISAKDEKELLHFSIEQEIKDQKERCDKSLTTITELQRRIQESAKQIEAKDNKITELLNDVERLKQALNGLSQLTYTSGNPTKRQSQLIDTLQHQVKSLEQQLADADRQHQEVIAIYRTHLLSAAQGHMDEDVQEALLQIIQMRQGLVC

SEQ ID NO: 834349 - protein, 1385 aa, Homo sapiens
MMNCWFSCTPKNRHAADWNKYDDRLMKAAERGDVEKVTSILAKKGVNPGKLDVEGRSVFHVVTSKGNLECLNAILIHGVDITTSDTAGRNALHLAAKYGHALCLQKLLQYNCPTEHADLQGRTALHDAAMADCPSSIQLLCDHGASVNAKDVDGRTPLVLATQMSRPTICQLLIDRGADVNSRDKQNRTALMLGCEYGCRDAVEVLIKNGADISLLDALGHDSSYYARIGDNLDILTLLKTASENTNKGRELWKKGPSLQQRNLTHMQDEVNVKSHQREHQNIQDLEIENEDLKERLRKIQQEQRILLDKVNGLQLQLNEEVMVADDLESEREKLKSLLAAKEKQHEESLRTIEALKNRFKYFESDHLGSGSHFSNLYFPRYTSPYAKQIYVKTSGTIFTQSTSYSENEILKKELEAMRTFCESAKQDRLKLQNELAHKVAECKALALECERVKEDSDEQIKQLEDALKDVQKRMYESEGKVKQMQTHFLALKEHLTSEAASGNHRLTEELKDQLKDLKVKYEGASAEVGKLRNQIKQNEMIVEEFKRDEGKLIEENKRLQKELSMCEMEREKKGRKVTEMEGQAKELSAKLALSIPAEKFENMKSSLSNEVNEKAKKLVEMEREHEKSLSEIRQLKRELENVKAKLAQHVKPEEHEQVKSRLEQKSGELGKKITELTLKNQTLQKEIEKVYLDNKLLKEQAHNLTIEMKNHYVPLKVSEDMKKSHDAIIDDLNRKLLDVTQKYTEKKLEMEKLLLENDSLSKDVSRLETVFVPPEKHEKEIIALKSNIVELKKQLSELKKKCGEDQEKIHALTSENTNLKKMMSNQYVPVKTHEEVKMTLNDTLAKTNRELLDVKKKFEDINQEFVKIKDKNEILKRNLENTQNQIKAEYISLAEHEAKMSSLSQSMRKVQDSNAEILANYRKGQEEIVTLHAEIKAQKKELDTIQECIKVKYAPIVSFEECERKFKATEKELKDQLSEQTQKYSVSEEEVKKNKQENDKLKKEIFTLQKDLRDKTVLIEKSHEMERALSRKTDELNKQLKDLSQKYTEVKNVKEKLVEENAKQTSEILAVQNLLQKQHVPLEQVEALKKSLNGTIENLKEELKSMQRCYEKEQQTVTKLHQLLENQKNSSVPLAEHLQIKEAFEKEVGIIKASLREKEEESQNKMEEVSKLQSEVQNTKQALKKLETREVVDLSKYKATKSDLETQISSLNEKLANLNRKYEEVCEEVLHAKKKEISAKDEKELLHFSIEQEIKDQKERCDKSLTTITELQRRIQESAKQIEAKDNKITELLNDVERLKQALNGLSQLTYTSGNPTKRQSQLIDTLQHQVKSLEQQLADADRQHQEVIAIYRTHLLSAAQGHMDEDVQEALLQIIQMRQGLVC

SEQ ID NO: 834350 - protein, 1219 aa, Homo sapiens
MLFKDLFILLRSEGLSVSSLPYLLIFYFGGAQRSKYISVLSLQINVTSPSSSFFFFFKLSSFSELAMQCFIAQLLLCIYYKFFLKFCDFSENKSLIIFKICYYLVFLNKLYLIYLKHSLKGPFHFGVLNRNTATLCYVQLMLDKLKITNWVYCQLRKIYFSVFLHLLTVFSYVLPKRNLTHMQDEVNVKSHQREHQNIQDLEIENEDLKERLRKIQQEQRILLDKVNGLQLQLNEEVMVADDLESEREKLKSLLAAKEKQHEESLRTIEALKNRFKYFESDHLGSGSHFSNRKYKSMDYHYSSPSSSKEECLSYLFNYTGITVQDIPAAKLHQHMELGRRYDDYCNFYHILIITEALILLSYLYFKIVYCMNYQICLVDVVDIDICLVIFRVHFFYGKNINKFSNLEKSVLMQVGILKLHLRIIFRPYIIFFILQCETVSLENLFLFPSDYETILSYNSNIYAINLNHHFVLIDYKIYVLLSCEPSLRVLNISEVLVILLRESIEKNKKKKNQPSICCSEIVGTSVYRNNKGKMGILEEDTFVLYLLLLFYLNNKGNNIKLMFAYFSMDIEVKMSFICIYLGKEDMLLKQGQMYMADSQCTSPGIPAHMQSRSMLRPLELSLPSQTSYSENEILKKELEAMRTFCESAKQDRLKLQNELAHKVAECKALALECERVKEDSDEQIKQLEDALKDVQKRMYESEGKVKQMQTHFLALKEHLTSEAASGNHRLTEELKDQLKDLKVKYEGASAEVGKLRNQIKQNEMIVEEFKRDEGKLIEENKRLQKELSMCEMEREKKGRKVTEMEGQAKELSAKLALSIPAEKFENMKSSLSNEVNEKAKKLVEMEREHEKSLSEIRQLKRELENVKAKLAQHVKPEEHEQVKSRLEQKSGELGKKITELTLKNQTLQKEIEKVYLDNKLLKEQAHNLTIEMKNHYVPLKVSEDMKKSHDAIIDDLNRKLLDVTQKYTEKKLEMEKLLLENDSLSKDVSRLETVFVPPEKHEKEIIALKSNIVELKKQLSELKKKCGEDQEKIHALTSENTNLKKMMSNQYVPVKTHEEVKMTLNDTLAKTNRELLDVKKKFEDINQEFVKIKDKNEILKRNLENTQNQIKAEYISLAEHEAKMSSLSQSMRKVQDSNAEILANYRKGQEEIVTLHAEIKAQKKELDTIQECIKVKYAPIVSFEECERKFKATEKELKDQLSEQTQKYSVSEEEVKKNK

SEQ ID NO: 834351 - protein, 695 aa, Homo sapiens
QASPSWISGQSPRLLRRAAAASAPAPAPCPASREPGWTRGGSAGVPPPLPGAAATMFSCVKPYEDQNYSALRRDCRRRKVLFEDPLFPATDDSLYYKGTPGPAVRWKRPKGICEDPRLFVDGISSHDLHQGQVGNCWFVAACSSLASRESLWQKVIPDWKEQEWDPEKPNAYAGIFHFHFWRFGEWVDVVIDDRLPTVNNQLIYCHSNSRNEFWCALVEKAYAKLAGCYQALDGGNTADALVDFTGGVSEPIDLTEGDFANDETKRNQLFERMLKVHSRGGLISASIKAVTAADMEARLACGLVKGHAYAVTDVRKVRLGHGLLAFFKSEKLDMIRLRNPWGEREWNGPWSDTSEEWQKVSKSEREKMGVTVQDDGEFWMTFEDVCRYFTDIIKCRVINTSHLSIHKTWEEARLHGAWTLHEDPRQNRGGGCINHKDTFFQNPQYIFEVKKPEDEVLICIQQRPKRSTRREGKGENLAIGFDIYKVEENRQYRMHSLQHKAASSIYINSRSVFLRTDQPEGRYVIIPTTFEPGHTGEFLLRVFTDVPSNCRELRLDEPPHTCWSSLCGYPQLVTQVHVLGAAGLKDSPTGANSYVIIKCEGDKVRSAVQKGTSTPEYNVKGIFYRKKLSQPITVQVWNHRVLKDEFLGQVHLKADPDNLQALHTLHLRDRNSRQPSNLPGTVAVHILSSTSLMAV

SEQ ID NO: 834352 - protein, 654 aa, Homo sapiens
LTIGLERPPGQVATMFSCVKPYEDQNYSALRRDCRRRKVLFEDPLFPATDDSLYYKGTPGPAVRWKRPKGICEDPRLFVDGISSHDLHQGQVGNCWFVAACSSLASRESLWQKVIPDWKEQEWDPEKPNAYAGIFHFHFWRFGEWVDVVIDDRLPTVNNQLIYCHSNSRNEFWCALVEKAYAKLAGCYQALDGGNTADALVDFTGGVSEPIDLTEGDFANDETKRNQLFERMLKVHSRGGLISASIKAVTAADMEARLACGLVKGHAYAVTDVRKVRLGHGLLAFFKSEKLDMIRLRNPWGEREWNGPWSDTSEEWQKVSKSEREKMGVTVQDDGEFWMTFEDVCRYFTDIIKCRVINTSHLSIHKTWEEARLHGAWTLHEDPRQNRGGGCINHKDTFFQNPQYIFEVKKPEDEVLICIQQRPKRSTRREGKGENLAIGFDIYKVEENRQYRMHSLQHKAASSIYINSRSVFLRTDQPEGRYVIIPTTFEPGHTGEFLLRVFTDVPSNCRELRLDEPPHTCWSSLCGYPQLVTQVHVLGAAGLKDSPTGANSYVIIKCEGDKVRSAVQKGTSTPEYNVKGIFYRKKLSQPITVQVWNHRVLKDEFLGQVHLKADPDNLQALHTLHLRDRNSRQPSNLPGTVAVHILSSTSLMAV

SEQ ID NO: 834353 - protein, 695 aa, Homo sapiens; identical to SEQ ID NO: 834351

SEQ ID NO: 834354 - protein, 654 aa, Homo sapiens; identical to SEQ ID NO: 834352

SEQ ID NO: 834355 - protein, 695 aa, Homo sapiens; identical to SEQ ID NO: 834351

SEQ ID NO: 834356 - protein, 695 aa, Homo sapiens; identical to SEQ ID NO: 834351

SEQ ID NO: 834357 - protein, 654 aa, Homo sapiens; identical to SEQ ID NO: 834352

SEQ ID NO: 834358 - protein, 116 aa, Homo sapiens
HEGLDKDGWASWRSWHWGWALKDLGEDDTRNEEGTLSIEHIFLRPCCLPRSAKKMSLVYTRTATSPSSVLAPRVLGPTQPPRPHFPHQQYLVFSHLERTLGSCRVPAQAGIGKICR

SEQ ID NO: 834359 - protein, 515 aa, Homo sapiens
WRCLRRRSGPGCSRDDLPAGCAARLSGGSECHVPSATRRIRAGGALGAGAARSPARPHRSPAAMGSSQSVEIPGGGTEGYHVLRVQENSPGHRAGLEPFFDFIVSINGSRLNKDNDTLKDLLKANVEKPVKMLIYSSKTLELRETSVTPSNLWGGQGLLGVSIRFCSFDGANENVWHVLEVESNSPAALAGLRPHSDYIIGADTVMNESEDLFSLIETHEAKPLKLYVYNTDTDNCREVIITPNSAWGGEGSLGCGIGYGYLHRIPTRPFEEGKKISLPGQMAGTPITPLKDGFTEVQLSSVNPPSLSPPGTTGIEQSLTGLSISSTPPAVSSVLSTGVPTVPLLPPQVNQSLTSVPPMNPATTLPGLMPLPAGLPNLPNLNLNLPAPHIMPGVGLPELVNPGLPPLPSMPPRNLPGIAPLPLPSEFLPSFPLVPESSSAASSGELLSSLPPTSNAPSDPATTTAKADAASSLTVDVTPPTAKAPTTVEDRVGDSTPVSEKPVSAAVDANASESP

SEQ ID NO: 834360 - protein, 102 aa, Homo sapiens
VEFVVLLGEFVVLLRRFVVLLGEFVVLLGEFVVLLGEFVVLLGEFVVLLGEFVVLFDGANENVWHVLEVESNSPAALAGLRPHSDYIIGADTVMNESEHLFA

SEQ ID NO: 834361 - protein, 384 aa, Homo sapiens
MLIYSSKTLELRETSVTPSNLWGGQGLLGVSIRFCSFDGANENVWHVLEVESNSPAALAGLRPHSDYIIGADTVMNESEDLFSLIETHEAKPLKLYVYNTDTDNCREVIITPNSAWGGEGSLGCGIGYGYLHRIPTRPFEEGKKISLPGQMAGTPITPLKDGFTEVQLSSVNPPSLSPPGTTGIEQSLTGLSISSTPPAVSSVLSTGVPTVPLLPPQVNQSLTSVPPMNPATTLPGLMPLPAGLPNLPNLNLNLPAPHIMPGVGLPELVNPGLPPLPSMPPRNLPGIAPLPLPSEFLPSFPLVPESSSAASSGELLSSLPPTSNAPSDPATTTAKADAASSLTVDVTPPTAKAPTTVEDRVGDSTPVSEKPVSAAVDANASESP

SEQ ID NO: 834362 - protein, 498 aa, Homo sapiens
WRCLRRRSGPGCSRDDLPAGCAARLSGGSECHVPSATRRIRAGGALGAGAARSPARPHRSPAAMGSSQSVEIPGGGTEGYHVLRVQENSPGHRAGLEPFFDFIVSINGSRLNKDNDTLKDLLKANVEKPVKMLIYSSKTLELRETSVTPSNLWGGQGLLGVSIRFCSFDGANENVWHVLEVESNSPAALAGLRPHSDYIIGADTVMNESEDLFSLIETHEAKPLKLYVYNTDTDNCREVIITPNSAWGGEGSLGCGIGYGYLHRIPTRPFEEGKKISLPGQMAGTPITPLKDGFTEVQLSSVNPPSLSPPGTTGIEQSLTGLSISSTPPAVSSVLSTGVPTVPLLPPQVNQSLTSVPPMNPATTLPGLMPLPAGLPNLPNLNLNLPAPHIMPGVGLPELVNPALPLPSEFLPSFPLVPESSSAASSGELLSSLPPTSNAPSDPATTTAKADAASSLTVDVTPPTAKAPTTVEDRVGDSTPVSEKPVSAAVDANASESP

SEQ ID NO: 834363 - protein, 467 aa, Homo sapiens
WRCLRRRSGPGCSRDDLPAGCAARLSGGSECHVPSATRRIRAGGALGAGAARSPARPHRSPAAMGSSQSVEIPGGGTEGYHVLRVQENSPGHRAGLEPFFDFIVSINGSRLNKDNDTLKDLLKANVEKPVKMLIYSSKTLELRETSVTPSNLWGGQGLLGVSIRFCSFDGANENVWHVLEVESNSPAALAGLRPHSDYIIGADTVMNESEDLFSLIETHEAKPLKLYVYNTDTDNCREVIITPNSAWGGEGSLGCGIGYGYLHRIPTRPFEEGKKISLPGQMAGTPITPLKDGFTEVQLSSVNPPSLSPPGTTGIEQSLTGLSISSTPPAVSSVLSTGVPTVPLLPPQVNQSLTSVPPMNPATTLPGLMPLPAGLPNLPNLNLNLPAPHIMPGVGLPELVNPGLPPLPSMPPRNLPGIAPLPLPSEFLPSFPLVPESSSAASSGELLSSLPPTSNAPSVDANASESP

SEQ ID NO: 834364 - protein, 454 aa, Homo sapiens
WRCLRRRSGPGCSRDDLPAGCAARLSGGSECHVPSATRRIRAGGALGAGAARSPARPHRSPAAMGSSQSVEIPGGGTEGYHVLRVQENSPGHRAGLEPFFDFIVSINGSRLNKDNDTLKDLLKANVEKPVKMLIYSSKTLELRETSVTPSNLWGGQGLLGVSIRFCSFDGANENVWHVLEVESNSPAALAGLRPHSDYIIGADTVMNESEDLFSLIETHEAKPLKLYVYNTDTDNCREVIITPNSAWGGEGSLGCGIGYGYLHRIPTRPFEEGKKISLPGQMAGTPITPLKDGFTEVQLSSVNPPSLSPPGTTGIEQSLTGLSISSTPPAVSSVLSTGVPTVPLLPPQVNQSLTSVPPMNPATTLPGLMPLPAGLPNLPNLNLNLPAPHIMPGVGLPELVNPGMADLTLSSLTVDVTPPTAKAPTTVEDRVGDSTPVSEKPVSAAVDANASESP

SEQ ID NO: 834365 - protein, 384 aa, Homo sapiens; identical to SEQ ID NO: 834361

SEQ ID NO: 834366 - protein, 515 aa, Homo sapiens; identical to SEQ ID NO: 834359

SEQ ID NO: 834367 - protein, 443 aa, Homo sapiens
WRCLRRRSGPGCSRDDLPAGCAARLSGGSECHVPSATRRIRAGGALGAGAARSPARPHRSPAAMGSSQSVEIPGGGTEGYHVLRVQENSPGHRAGLEPFFDFIVSINGSRLNKDNDTLKDLLKANVEKPVKMLIYSSKTLELRETSVTPSNLWGGQGLLGVSIRFCSFDGANENVWHVLEVESNSPAALAGLRPHSDYIIGADTVMNESEDLFSLIETHEAKPLKLYVYNTDTDNCREVIITPNSAWGGEGSLGCGIGYGYLHRIRVPTVPLLPPQVNQSLTSVPPMNPATTLPGLMPLPAGLPNLPNLNLNLPAPHIMPGVGLPELVNPGLPPLPSMPPRNLPGIAPLPLPSEFLPSFPLVPESSSAASSGELLSSLPPTSNAPSDPATTTAKADAASSLTVDVTPPTAKAPTTVEDRVGDSTPVSEKPVSAAVDANASESP

SEQ ID NO: 834368 - protein, 276 aa, Homo sapiens
MFTPYSACRDADSLGCGIGYGYLHRIPTRPFEEGKKISLPGQMAGTPITPLKDGFTEVQLSSVNPPSLSPPGTTGIEQSLTGLSISSTPPAVSSVLSTGVPTVPLLPPQVNQSLTSVPPMNPATTLPGLMPLPAGLPNLPNLNLNLPAPHIMPGVGLPELVNPGLPPLPSMPPRNLPGIAPLPLPSEFLPSFPLVPESSSAASSGELLSSLPPTSNAPSDPATTTAKADAASSLTVDVTPPTAKAPTTVEDRVGDSTPVSEKPVSAAVDANASESP

SEQ ID NO: 834369 - protein, 243 aa, Homo sapiens
EVIQRIPSVMGGAPITPLKDGFTEVQLSSVNPPSLSPPGTTGIEQSLTGLSISSTPPAVSSVLSTGVPTVPLLPPQVNQSLTSVPPMNPATTLPGLMPLPAGLPNLPNLNLNLPAPHIMPGVGLPELVNPGLPPLPSMPPRNLPGIAPLPLPSEFLPSFPLVPESSSAASSGELLSSLPPTSNAPSDPATTTAKADAASSLTVDVTPPTAKAPTTVEDRVGDSTPVSEKPVSAAVDANASESP

SEQ ID NO: 834370 - protein, 157 aa, Homo sapiens
MNPATTLPGLMPLPAGLPNLPNLNLNLPAPHIMPGVGLPELVNPGLPPLPSMPPRNLPGIAPLPLPSEFLPSFPLVPESSSAASSGELLSSLPPTSNAPSDPATTTAKADAASSLTVDVTPPTAKAPTTVEDRVGDSTPVSEKPVSAAVDANASESP

SEQ ID NO: 834371 - protein, 402 aa, Homo sapiens
WRCLRRRSGPGCSRDDLPAGCAARLSGGSECHVPSATRRIRAGGALGAGAARSPARPHRSPAAMGSSQSVEIPGGGTEGYHVLRVQENSPGHRAGLEPFFDFIVSINGSRLNKDNDTLKDLLKANVEKPVKMLIYSSKTLELRETSVTPSNLWGGQGLLGVSIRFCSFDGANENVWHVLEVESNSPAALAGLRPHSDYIIGADTVMNESEDLFSLIETHEAKPLKLYVYNTDTDNCREVIITPNSAWGGEGSLGCGIGYGYLHRIPTRPFEEGKKISLPGQMAGTPITPLKDGFTEVQLSSVNPPSLSPPGTTGIEQSLTGLSISSTPPAVSSVLSTGVPTVPLLPPQVNQSLTSVPPMNPATTLPGLMPLPAGLPNLPNLNLNLPAPHIWPAHPSGPHIRT

SEQ ID NO: 834372 - protein, 542 aa, Homo sapiens
WRCLRRRSGPGCSRDDLPAGCAARLSGGSECHVPSATRRIRAGGALGAGAARSPARPHRSPAAMGSSQSVEIPGGGTEGYHVLRVQENSPGHRAGLDFAFSWVISFTWSPQHSHITQHHMHHSFTGICLHKPNVCTKPCTQHAIISSDQPTHPWRNLAEQHLKVHHPQLNPGGARAPRASHQAQLPATFRLFLAASHYSHCGGHNRAHTTALCAQWVALRTAAWRKPPHHMPLPAATAPHPAPNATHHNSTPEPHHRRRTAHHTHTQAATAPAPTPTTPTGPRRASPTWQPRTPPAQSPRAHHTHSRTHTHTHPHTPHANNPQHTPTTLAPPASLTPTPTHANPTPAPHTPPRPPPPHHDRHPPRRPPPPHNTSPSPPLGAARAANPTTTAPRTPNSGKHAPATTPKLGPNTTGNTNTTPAHTLPSTHRTPPTTIPTQDPPHTENKKTGDPQATTPQPPTPTTAQRRKPDTNECPPRTQHHDATRPPSPHHPPPPRKHTDAVKHHAHRNTRSYTAPHQNTTTTHTPPHPQAAPPPTNPDDTA

SEQ ID NO: 834373 - protein, 515 aa, Homo sapiens; identical to SEQ ID NO: 834359

SEQ ID NO: 834374 - protein, 435 aa, Homo sapiens
WRCLRRRSGPGCSRDDLPAGCAARLSGGSECHVPSATRRIRAGGALGAGAARSPARPHRSPAAMGSSQSVEIPGGGTEGYHVLRVQENSPGHRAGLEPFFDFIVSINGSRLNKDNDTLKDLLKANVEKPVKMLIYSSKTLELRETSVTPSNLWGGQGLLGVSIRFCSFDGANENVWHVLEVESNSPAALAGLRPHSDYIIGADTVMNESEDLFSLIETHEAKPLKLYVYNTDTDNCREVIITPNSAWGGEGSLGCGIGYGYLHRIPTRPFEEGKKISLPGQMAGTPITPLKDGFTEVQLSSVNPPSLSPPGTTGIEQSLTGLSISSTPPAVSSVLSTGVPTVPLLPPQVNQSLTSVPPMNPATTLPGLMPLPAGLPNLPNLNLNLPAPHIMPGVGLPELVNPGLPPLPSMPPRNLPGIAPLPLPSEFLPPHSLWM

SEQ ID NO: 834375 - protein, 422 aa, Homo sapiens
WRCLRRRSGPGCSRDDLPAGCAARLSGGSECHVPSATRRIRAGGALGAGAARSPARPHRSPAAMGSSQSVEIPGGGTEGYHVLRVQENSPGHRAGLEPFFDFIVSINGSRLNKDNDTLKDLLKANVEKPVKMLIYSSKTLELRETSVTPSNLWGGQGLLGVSIRFCSFDGANENVWHVLEVESNSPAALAGLRPHSDYIIGADTVMNESEDLFSLIETHEAKPLKLYVYNTDTDNCREVIITPNSAWGGEGSLGCGIGYGYLHRIPTRPFEEGKKISLPGQMAGTPITPLKDGFTEVQLSSVNPPSLSPPGTTGIEQSLTGLSISSTPPAVSSVLSTGVPTVPLLPPQVNQSLTSVPPMNPATTLPGLMPLPAGLPNLPNLNLNLPAPHIMPGVGLPELVNPGLPPLPSMPPRNLPGIAHHR

SEQ ID NO: 834376 - protein, 384 aa, Homo sapiens; identical to SEQ ID NO: 834361

SEQ ID NO: 834377 - protein, 171 aa, Homo sapiens
ASGPHRSQAHFCATMNPATTLPGLMPLPAGLPNLPNLNLNLPAPHIMPGVGLPELVNPGLPPLPSMPPRNLPGIAPLPLPSEFLPSFPLVPESSSAASSGELLSSLPPTSNAPSDPATTTAKADAASSLTVDVTPPTAKAPTTVEDRVGDSTPVSEKPVSAAVDANASESP

SEQ ID NO: 834378 - protein, 508 aa, Homo sapiens
WRCLRRRSGPGCSRDDLPAGCAARLSGGSECHVPSATRRIRAGGALGAGAARSPARPHRSPAAMGSSQSVEIPGGGTEGYHVLRVQENSPGHRAGLEPFFDFIVSINGSRLNKDNDTLKDLLKANVEKPVKMLIYSSKTLELRETSVTPSNLWGGQGLLGVSIRFCSFDGANENVWHVLEVESNSPAALAGLRPHSDYIIGADTVMNESEDLFSLIETHEAKPLKLYVYNTDTDNCREVIITPNSAWGGEGSLGCGIGYGYLHRIPTRPFEEGKKISLPGQMAGTPITPLKDGFTEVQLSSVNPPSLSPPGTTGIEQSLTGLSISSTPPAVSSVLSTGVPTVPLLPPQVNQSLTSVPPMNPATTLPGLMPLPAGLPNLPNLNLNLPAPHIMPGVGLPELVNPGLPPLPSMPPRNLPGIAPLPLPSEFLPSFPLVPESSSAASSGELLSSLPPTSNAPSDPATTTAKADAASSLTVDVTPPTAKAPAPLLRTQHHRTRQHLRHKLPGPY

SEQ ID NO: 834379 - protein, 72 aa, Homo sapiens
MDSDRVEARKSLLESFLKQLCAIPEIANSEEVQEFLALNTDARIAFVKKPFMVSRIDKVLPIWKLEITFLLK

SEQ ID NO: 834380 - protein, 992 aa, Homo sapiens
MKTETVPPFQETPAGSSCHLNNLLSSRKLMAVGVLLGWLLVIHLLVNVWLLCLLSALLVVLGGWLGSSLAGVASGRLHLERFIPLATCPPCPEAERQLEREINRTIQMIIRDFVLSWYRSVSQEPAFEEEMEAAMKGLVQELRRRMSVMDSHAVAQSVLTLCGCHLQSYIQAKEATAGKNGPVEPSHLWEAYCRATAPHPAVHSPSAEVTYTRGVVNLLLQGLVPKPHLETRTGRHVVVELITCNVILPLISRLSDPDWIHLVLVGIFSKARDPAPCPASAPEQPSVPTSLPLIAEVEQLPEGRASPVAAPVFLSYSEPEGSAGPSPEVEEGHEAVEGDLGGMCEERKVGNNSSHFLQPNLRGPLFLCEDSELESPLSELGKETIMLMTPGSFLSDRIQDALCALESSQALEPKDGEASEGAEAEEGPGTETETGLPVSTLNSCPEIHIDTADKEIEQGDVTASVTALLEGPEKTCPSRPSCLEKDLTNDVSSLDPTLPPVLLSSSPPGPLSSATFSFEPLSSPDGPVIIQNLRITGTITAREHSGTGFHPYTLYTVKYETALDGENSSGLQQLAYHTVNRRYREFLNLQTRLEEKPDLRKFIKNVKGPKKLFPDLPFGNMDSDRVEARKSLLESFLKQLCAIPEIANSEEVQEFLALNTDARIAFVKKPFMVSRIDKMVVSAIVDTLKTAFPRSEPQSPTEELSEAETESKPQTEGKKASKSRLRFSSSKISPALSVTEAQDKILYCLQEGSVESETLSMSAMESFIEKQTKLLEMQPTKAPEKDPEQPPKGRVDSCVSDAAVPAQDPSNSDPGTETELADTALDLLLLLLTEQWKWLCTENMQKFLRLIFGTLVQRWLEVQVANLTSPQRWVQYLRLLQESIWPGGVLPKFPRPVRTQEQKLAAEKQALQSLMGVLPDLVVEILGVNKCRLSWGLVLESLQQPLINRHLIYCLGDIILEFLDLSASVEESAATTSASDTPGNSKRMGVSS

SEQ ID NO: 834381 - protein, 907 aa, Homo sapiens
MKTETVPPFQETPAGSSCHLNNLLSSRKLMAVGVLLGWLLVIHLLVNVWLLCLLSALLVVLGGWLGSSLAGVASGRLHLERFIPLATCPPCPEAERQLEREINRTIQMIIRDFVLSWYRSVSQEPAFEEEMEAAMKGLVQELRRRMSVMDSHAVAQSVLTLCGCHLQSYIQAKEATAGKNGPVEPSHLWEAYCRATAPHPAVHSPSAEVTYTRGVVNLLLQGLVPKPHLETRTGRHVVVELITCNVILPLISRLSDPDWIHLVLVGIFSKARDPAPCPASAPEQPSVPTSLPLIAEVEQLPEGRASPVAAPVFLSYSEPEGSAGPSPEVEEGHEAVEGDLGGMCEERKVGNNSSHFLQPNLRGPLFLCEDSELESPLSELGKETIMLMTPGSFLSDRIQDALCALESSQALEPKDGEASEGAEAEEGPGTETETGLPVSTLNSCPEIHIDTADKEIEQGDVTASVTALLEGPEKTCPSRPSCLEKDLTNDVSSLDPTLPPVLLSSSPPGPLSSATFSFEPLSSPDGPVIIQNLRITGTITAREHSGTGFHPYTLYTVKYETALDGENSSGLQQLAYHTVNRRYREFLNLQTRLEEKPDLRKFIKNVKGPKKLFPDLPFGNMDSDRVEARKSLLESFLKQLCAIPEIANSEEVQEFLALNTDARIAFVKKPFMVSRIDKMVVSAIVDTLKTAFPRSEPQSPTEELSEAETESKPQTEGKKASKSRLRFSSSKISPALSVTEAQDKILYCLQEGSVESETLSMSAMESFIEKQTKLLEMQPTKAPEKDPEQPPKGRVDSCVSDAAVPAQDPSNSDPGTETELADTALDLLLLLLTEQWKWLCTENMQKFLRLIFGTLVQRSRSRNSWGEQMPAELGSSPGVTTTTPHQQAFDLLPWGHHPGILGSQCLC

SEQ ID NO: 834382 - protein, 417 aa, Homo sapiens
MPFQGSLLPGFASGVLKFSAGQQQSHSFRDVKGPKKLFPDLPFGNMDSDRVEARKSLLESFLKQLCAIPEIANSEEVQEFLALNTDARIAFVKKPFMVSRIDKMVVSAIVDTLKTAFPRSEPQSPTEELSEAETESKPQTEGKKASKSRLRFSSSKISPALSVTEAQDKILYCLQEGSVESETLSMSAMESFIEKQTKLLEMQPTKAPEKDPEQPPKGRVDSCVSDAAVPAQDPSNSDPGTETELADTALDLLLLLLTEQWKWLCTENMQKFLRLIFGTLVQRWLEVQVANLTSPQRWVQYLRLLQESIWPGGVLPKFPRPVRTQEQKLAAEKQALQSLMGVLPDLVVEILGVNKCRLSWGLVLESLQQPLINRHLIYCLGDIILEFLDLSASVEESAATTSASDTPGNSKRMGVSS

SEQ ID NO: 834383 - protein, 992 aa, Homo sapiens; identical to SEQ ID NO: 834380

SEQ ID NO: 834384 - protein, 820 aa, Homo sapiens
MKTETVPPFQETPAGSSCHLNNLLSSRKLMAVGVLLGWLLVIHLLVNVWLLCLLSALLVVLGGWLGSSLAGVASGRLHLERFIPLATCPPCPEAERQLEREINRTIQMIIRDFVLSWYRSVSQEPAFEEEMEAAMKGLVQELRRRMSVMDSHAVAQSVLTLCGCHLQSYIQAKEATAGKNGPVEPSHLWEAYCRATAPHPAVHSPSAEVTYTRGVVNLLLQGLVPKPHLETRTGRHVVVELITCNVILPLISRLSDPDWIHLVLVGIFSKARDPAPCPASAPEQPSVPTSLPLIAEVEQLPEGRASPVAAPVFLSYSEPEGSAGPSPEVEEGHEAVEGDLGGMCEERKVGNNSSHFLQPNLRGPLFLCEDSELESPLSELGKETIMLMTPGSFLSDRIQDALCALESSQALEPKDGEASEGAEAEEGPGTETETGLPVSTLNSCPEIHIDTADKEIEQGDVTASVTALLEGPEKTCPSRPSCLEKDLTNDVSSLDPTLPPVLLSSSPPGPLSSATFSFEPLSSPDGPVIIQNLRITGTITAREHSGTGFHPYTLYTVKYETALDGENSSGLQQLAYHTVNRRYREFLNLQTRLEEKPDLRKFIKNVKGPKKLFPDLPFGNMDSDRVEARKSLLESFLKQLCAIPEIANSEEVQEFLALNTDARIAFVKKPFMVSRIDKMVVSAIVDTLKTAFPRSEPQSPTEELSEAETESKPQTEGKKASKSRLRFSSSKISPALSVTEAQDKILYCLQEGSVESETLSMSAMESFIEKQTKLLEMQPTKAPEKDPEQPPKGRVDSCVSDAAVPAQDPSNSDPAEHAMC

SEQ ID NO: 834385 - protein, 858 aa, Homo sapiens
MKTETVPPFQETPAGSSCHLNNLLSSRKLMAVGVLLGWLLVIHLLVNVWLLCLLSALLVVLGGWLGSSLAGVASGRLHLERFIPLATCPPCPEAERQLEREINRTIQMIIRDFVLSWYRSVSQEPAFEEEMEAAMKGLVQELRRRMSVMDSHAVAQSVLTLCGCHLQSYIQAKEATAGKNGPVEPSHLWEAYCRATAPHPAVHSPSAEVTYTRGVVNLLLQGLVPKPHLETRTGRHVVVELITCNVILPLISRLSDPDWIHLVLVGIFSKARDPAPCPASAPEQPSVPTSLPLIAEVEQLPEGRASPVAAPVFLSYSEPEGSAGPSPEVEEGHEAVEGDLGGMCEERKVGNNSSHFLQPNLRGPLFLCEDSELESPLSELGKETIMLMTPGSFLSDRIQDALCALESSQALEPKDGEASEGAEAEEGPGTETETGLPVSTLNSCPEIHIDTADKEIEQGDVTASVTALLEGPEKTCPSRPSCLEKDLTNDVSSLDPTLPPVLLSSSPPGPLSSATFSFEPLSSPDGPVIIQNLRITGTITAREHSGTGFHPYTLYTVKYETALDGENSSGLQQLAYHTVNRRYREFLNLQTRLEEKPDLRKFIKNVKGPKKLFPDLPFGNMDSDRVEARKSLLESFLKQLCAIPEIANSEEVQEFLALNTDARIAFVKKPFMVSRIDKMVVSAIVDTLKTAFPRSEPQSPTEELSEAETESKPQTEGKKASKSRLRFSSSKISPALSVTEAQDKILYCLQEGSVESETLSMSAMESFIEKQTKLLEMQPTKAPEKDPEQPPKGRVDSCVSDAAVPAQDPSNSDPGTETELADTALDLLLLLLTEQWKWLCTENMQKFLRLIFGTLVQR

SEQ ID NO: 834386 - protein, 803 aa, Homo sapiens
MKTETVPPFQETPAGSSCHLNNLLSSRKLMAVGVLLGWLLVIHLLVNVWLLCLLSALLVVLGGWLGSSLAGVASGRLHLERFIPLATCPPCPEAERQLEREINRTIQMIIRDFVLSWYRSVSQEPAFEEEMEAAMKGLVQELRRRMSVMDSHAVAQSVLTLCGCHLQSYIQAKEATAGKNGPVEPSHLWEAYCRATAPHPAVHSPSAEVTYTRGVVNLLLQGLVPKPHLETRTGRHVVVELITCNVILPLISRLSDPDWIHLVLVGIFSKARDPAPCPASAPEQPSVPTSLPLIAEVEQLPEGRASPVAAPVFLSYSEPEGSAGPSPEVEEGHEAVEGDLGGMCEERKVGNNSSHFLQPNLRGPLFLCEDSELESPLSELGKETIMLMTPGSFLSDRIQDALCALESSQALEPKDGEASEGAEAEEGPGTETETGLPVSTLNSCPEIHIDTADKEIEQGDVTASVTALLEGPEKTCPSRPSCLEKDLTNDVSSLDPTLPPVLLSSSPPGPLSSATFSFEPLSSPDGPVIIQNLRITGTITAREHSGTGFHPYTLYTVKYETALDGENSSGLQQLAYHTVNRRYREFLNLQTRLEEKPDLRKFIKNVKGPKKLFPDLPFGNMDSDRVEARKSLLESFLKQLCAIPEIANSEEVQEFLALNTDARIAFVKKPFMVSRIDKMVVSAIVDTLKTAFPRSEPQSPTEELSEAETESKPQTEGKKASKSRLRFSSSKISPALSVTEAQDKILYCLQEGSVTKLLEMQPTKAPEKDPEQPPKGRVDSCVSDAAVPAQDPSNSDPAEHAMC

SEQ ID NO: 834387 - protein, 276 aa, Homo sapiens
MKTETVPPFQETPAGSSCHLNNLLSSRKLMAVGVLLGWLLVIHLLVNVWLLCLLSALLVVLGGWLGSSLAGVASGRLHLERFIPLATCPPCPEAERQLEREINRTIQMIIRDFVLSWYRSVSQEPAFEEEMEAAMKGLVQELRRRMSVMDSHAVAQSVLTLCGCHLQSYIQAKEATAGKNGPVEPSHLWEAYCRATAPHPAVHSPSAEVTYTRGVVNLLLQGLVPKPHLETRTGRHVVVELITCNVILPLISRLSDPDWIHLVLVAAACSSWPTTL

SEQ ID NO: 834388 - protein, 992 aa, Homo sapiens; identical to SEQ ID NO: 834380

SEQ ID NO: 834389 - protein, 111 aa, Homo sapiens
LFAIISGNLGSEVAYISNKEERVRMETCRAYFSNWLTTATLSCTRALAVPWQHSKPTCGKQGHHMYPYWKFHLYLGPYEKRESMCVCVCVSVSVLMFHGPAITDSQYLTFS

SEQ ID NO: 834390 - protein, 992 aa, Homo sapiens; identical to SEQ ID NO: 834380

SEQ ID NO: 834391 - protein, 372 aa, Homo sapiens
MDSDRVEARKSLLESFLKQLCAIPEIANSEEVQEFLALNTDARIAFVKKPFMVSRIDKMVVSAIVDTLKTAFPRSEPQSPTEELSEAETESKPQTEGKKASKSRLRFSSSKISPALSVTEAQDKILYCLQEGSVESETLSMSAMESFIEKQTKLLEMQPTKAPEKDPEQPPKGRVDSCVSDAAVPAQDPSNSDPGTETELADTALDLLLLLLTEQWKWLCTENMQKFLRLIFGTLVQRWLEVQVANLTSPQRWVQYLRLLQESIWPGGVLPKFPRPVRTQEQKLAAEKQALQSLMGVLPDLVVEILGVNKCRLSWGLVLESLQQPLINRHLIYCLGDIILEFLDLSASVEESAATTSASDTPGNSKRMGVSS

SEQ ID NO: 834392 - protein, 355 aa, Homo sapiens
MDSDRVEARKSLLESFLKQLCAIPEIANSEEVQEFLALNTDARIAFVKKPFMVSRIDKMVVSAIVDTLKTAFPRSEPQSPTEELSEAETESKPQTEGKKASKSRLRFSSSKISPALSVTEAQDKILYCLQEGSVTKLLEMQPTKAPEKDPEQPPKGRVDSCVSDAAVPAQDPSNSDPGTETELADTALDLLLLLLTEQWKWLCTENMQKFLRLIFGTLVQRWLEVQVANLTSPQRWVQYLRLLQESIWPGGVLPKFPRPVRTQEQKLAAEKQALQSLMGVLPDLVVEILGVNKCRLSWGLVLESLQQPLINRHLIYCLGDIILEFLDLSASVEESAATTSASDTPGNSKRMGVSS

SEQ ID NO: 834393 - protein, 992 aa, Homo sapiens; identical to SEQ ID NO: 834380

SEQ ID NO: 834394 - protein, 880 aa, Homo sapiens
MKTETVPPFQETPAGSSCHLNNLLSSRKLMAVGVLLGWLLVIHLLVNVWLLCLLSALLVVLGGWLGSSLAGVASGRLHLERFIPLATCPPCPEAERQLEREINRTIQMIIRDFVLSWYRSVSQEPAFEEEMEAAMKGLVQELRRRMSVMDSHAVAQSVLTLCGCHLQSYIQAKEATAGKNGPVEPSHLWEAYCRATAPHPAVHSPSAEVTYTRGVVNLLLQGLVPKPHLETRTGRHVVVELITCNVILPLISRLSDPDWIHLVLVGIFSKARDPAPCPASAPEQPSVPTSLPLIAEVEQLPEGRASPVAAPVFLSYSEPEGSAGPSPEVEEGHEAVEGDLGGMCEERKVGNNSSHFLQPNLRGPLFLCEDSELESPLSELGKETIMLMTPGSFLSDRIQDALCALESSQALEPKDGEASEGAEAEEGPGTETETGLPVSTLNSCPEIHIDTADKEIEQGDVTASVTALLEGPEKTCPSRPSCLEKDLTNDVSSLDPTLPPVLLSSSPPGPLSSATFSFEPLSSPDGPVIIQNLRITGTITAREHSGTGFHPYTLYTVKYETALDGENSSGLQQLAYHTVNRRYREFLNLQTRLEEKPDLRKFIKNVKGPKKLFPDLPFGNMDSDRVEARKSLLESFLKQLCAIPEIANSEEVQEFLALNTDARIAFVKKPFMVSRIDKMVVSAIVDTLKTAFPRSEPQSPTEELSEAETESKPQTEGKKASKSRLRFSSSKISPALSVTEAQDKILYCLQEGSVESETLSMSAMESFIEKQTKLLEMQPTKAPEKDPEQPPKGRVDSCVSDAAVPAQDPSNSDPGTETELADTALDLLLLLLTEQWKWLCTENMQKFLRLIFGTLVQRVLGFCRSASEANLEAQGKLSGP

SEQ ID NO: 834395 - protein, 692 aa, Homo sapiens
MKTETVPPFQETPAGSSCHLNNLLSSRKLMAVGVLLGWLLVIHLLVNVWLLCLLSALLVVLGGWLGSSLAGVASGRLHLERFIPLATCPPCPEAERQLEREINRTIQMIIRDFVLSWYRSVSQEPAFEEEMEAAMKGLVQELRRRMSVMDSHAVAQSVLTLCGCHLQSYIQAKEATAGKNGPVEPSHLWEAYCRATAPHPAVHSPSAEVTYTRGVVNLLLQGLVPKPHLETRTGRHVVVELITCNVILPLISRLSDPDWIHLVLVGIFSKARDPAPCPASAPEQPSVPTSLPLIAEVEQLPEGRASPVAAPVFLSYSEPEGSAGPSPEVEEGHEAVEGDLGGMCEERKVGNNSSHFLQPNLRGPLFLCEDSELESPLSELGKETIMLMTPGSFLSDRIQDALCALESSQALEPKDGEASEGAEAEEGPGTETETGLPVSTLNSCPEIHIDTADKEIEQGDVTASVTALLEGPEKTCPSRPSCLEKDLTNDVSSLDPTLPPVLLSSSPPGPLSSATFSFEPLSSPDGPVIIQNLRITGTITAREHSGTGFHPYTLYTVKYETALDGENSSGLQQLAYHTVNRRYREFLNLQTRLEEKPDLRKFIKNVKGPKKLFPDLPFGNMDSDRVEARKSLLESFLKQLCAIPEIANSEEVQEFLALNTDARIAFVKKPFMVSRIDKVLPIWKLEITFLLK

SEQ ID NO: 834396 - protein, 572 aa, Homo sapiens
MKTETVPPFQETPAGSSCHLNNLLSSRKLMAVGVLLGWLLVIHLLVNVWLLCLLSALLVVLGGWLGSSLAGVASGRLHLERFIPLATCPPCPEAERQLEREINRTIQMIIRDFVLSWYRSVSQEPAFEEEMEAAMKGLVQELRRRMSVMDSHAVAQSVLTLCGCHLQSYIQAKEATAGKNGPVEPSHLWEAYCRATAPHPAVHSPSAEVTYTRGVVNLLLQGLVPKPHLETRTGRHVVVELITCNVILPLISRLSDPDWIHLVLVGIFSKARDPAPCPASAPEQPSVPTSLPLIAEVEQLPEGRASPVAAPVFLSYSEPEGSAGPSPEVEEGHEAVEGDLGGMCEERKVGNNSSHFLQPNLRGPLFLCEDSELESPLSELGKETIMLMTPGSFLSDRIQDALCALESSQALEPKDGEASEGAEAEEGPGTETETGLPVSTLNSCPEIHIDTADKEIEQGDVTASVTALLEGPEKTCPSRPSCLEKDLTNDVSSLDPTLPPVLLSSSPPGPLSSATFSFEPLSSPDGPVIIQNLRITGTITAREHSGTGFHPYTLYTVKRDTPCRLSPGLLIC

SEQ ID NO: 834397 - protein, 287 aa, Homo sapiens
MELERIVSAALLAFVQTHLPEADLSGLDEVIFSYVLGVLEDLGPSGPSEENFDMEAFTEMMEAYVPGFAHIPRGTIGDMMQKLSGQLSDARNKENLQPQSSGVQGQVPISPEPLQRPEMLKEETRSSAAAAADTQDEATGAEEELLPGVDVLLEVFPTCSVEQAQWVLAKARGDLEEAVQMLVEGKEEGPAAWEGPNQDLPRRLRGPQKDELKSFILQKYMMVDSAEDQKIHRPMAPKEAPKKLIRYIDNQVVSTKGERFKDVRNPEAEEMKATYINLKPARKYRFH

SEQ ID NO: 834398 - protein, 315 aa, Homo sapiens
MELERIVSAALLAFVQTHLPEADLSGLDEVIFSYVLGVLEDLGPSGPSEENFDMEAFTEMMEAYVPGFAHIPRGTIGDMMQKLSGQLSDARNKENLQPQSSGVQGQVPISPEPLQRPEMLKEETRSSAAAAADTQDEVLVEEGTDEGPRGLERGEYCLLLTFVPLATGAEEELLPGVDVLLEVFPTCSVEQAQWVLAKARGDLEEAVQMLVEGKEEGPAAWEGPNQDLPRRLRGPQKDELKSFILQKYMMVDSAEDQKIHRPMAPKEAPKKLIRYIDNQVVSTKGERFKDVRNPEAEEMKATYINLKPARKYRFH

SEQ ID NO: 834399 - protein, 78 aa, Homo sapiens
RSFTQPVFDRYMMVDSAEDQKIHRPMAPKEAPKKLIRYIDNQVVSTKGERFKDVRNPEAEEMKATYINLKPARKYRFH

SEQ ID NO: 834400 - protein, 287 aa, Homo sapiens; identical to SEQ ID NO: 834397

SEQ ID NO: 834401 - protein, 287 aa, Homo sapiens; identical to SEQ ID NO: 834397

SEQ ID NO: 834402 - protein, 294 aa, Homo sapiens
MELERIVSAALLAFVQTHLPEADLSGLDEVIFSYVLGVLEDLGPSGPSEENFDMEAFTEMMEAYVPGFAHIPRGTIGDMMQKLSGQLSDARNKENLQPQSSGVQGQVPISPEPLQRPEMLKEETRSSAAAAADTQDEATGAEEELLPGVDVLLEVFPTCSVEQAQWVLAKARGDLEEAVQMLVEGKEEGPAAWEGPNQTRPPLLQDLPRRLRGPQKDELKSFILQKYMMVDSAEDQKIHRPMAPKEAPKKLIRYIDNQVVSTKGERFKDVRNPEAEEMKATYINLKPARKYRFH

SEQ ID NO: 834403 - protein, 242 aa, Homo sapiens
MELERIVSAALLAFVQTHLPEADLSGLDEVIFSYVLGVLEDLGPSGPSEENFDMEAFTEMMEAYVPGFAHIPRGTIGDMMQKLSGQLSDARNKENLQPQSSGVQGQVPISPEPLQRPEMLKEETRCWGGDGGAAGRGGAAVVGGAVVVAVVRSVLGGGGGVRWWSPVEGALAAGVALVVEGPAGGGGAGPAAVGRGVRGAPAAPFVAQQLLVRGAAALAGGLGGPAGGQPVLGQAQAFFQGP

SEQ ID NO: 834404 - protein, 208 aa, Homo sapiens
CPWCDSVLRGCSLEQRSFISVRLLSYLSACRHPMEDSMDMDMSPLRPQNYLFGCELKADKDYHFKVDNDENEHQLSLRTVSLGAGAKDELHIVEAEAMNYEGSPIKVTLATLKMSVQPTVSLGGFEITPPVVLRLKCGSGPVHISGQHLVAVEEDAESEDEEEEDVKLLSISGKRSAPGGGSKVPQKKVKLAADEDDDDDDEEDDDER

SEQ ID NO: 834405 - protein, 208 aa, Homo sapiens; identical to SEQ ID NO: 834404

SEQ ID NO: 834406 - protein, 208 aa, Homo sapiens; identical to SEQ ID NO: 834404

SEQ ID NO: 834407 - protein, 208 aa, Homo sapiens; identical to SEQ ID NO: 834404

SEQ ID NO: 834408 - protein, 74 aa, Homo sapiens
CPWCDSVLRGCSLEQRSFISVRLLSYLSACRHPMEDSMDMDMSPLRPQNYLFGCELKADNFENVCTANGFPWGL

SEQ ID NO: 834409 - protein, 167 aa, Homo sapiens
CPWCDSVLRGCSLEQRSFISVRLLSYLSACRHPMEDSMDMDMSPLRPQNYLFGCELKADKDYHFKVDNDENEHQLSLRTVSLGAGAKDELHIVEAEAMNYEGSPIKVTLATLKMSVQPTVSLGGFEITPPVVLRLKCGSGPVHISGQHLVAVEEDAESEDEEDDDER

SEQ ID NO: 834410 - protein, 158 aa, Homo sapiens
CPWCDSVLRGCSLEQRSFISVRLLSYLSACRHPMEDSMDMDMSPLRPQNYLFGCELKADKDYHFKVDNDENEHQLSLRTVSLGAGAKDELHIVEAEAMNYEGSPIKVTLATLKMSVQPTVSLGGFEITPPVVLRLKCGSGPVHISGQHLVAVEEIASG

SEQ ID NO: 834411 - protein, 155 aa, Homo sapiens
CPWCDSVLRGCSLEQRSFISVRLLSYLSACRHPMEDSMDMDMSPLRPQNYLFGCELKADKDYHFKVDNDENEHQLSLRTVSLGAGAKDELHIVEAEAMNYEGSPIKVTLATLKMSVQPTVSLGGFEITPPVVLRLKCGSGPVHISGQHLVAVEEW

SEQ ID NO: 834412 - protein, 47 aa, Homo sapiens
CAHIPTTSNTTDMLMTTKYNQARPSAQAPCLYIRCFLDTSKQMSFKL

SEQ ID NO: 834413 - protein, 614 aa, Homo sapiens
MNTFQDQSGSSSNREPLLRCSDARRDLELAIGGVLRAEQQIKDNLREVKAQIHSCISRHLECLRSREVWLYEQVDLIYQLKEETLQQQAQQLYSLLGQFNCLTHQLECTQNKDLANQVSVCLERLGSLTLKPEDSTVLLFEADTITLRQTITTFGSLKTIQIPEHLMAHASSANIGPFLEKRGCISMPEQKSASGIVAVPFSEWLLGSKPASGYQAPYIPSTDPQDWLTQKQTLENSQTSSRACNFFNNVGGNLKGLENWLLKSEKSSYQKCNSHSTTSSFSIEMEKVGDQELPDQDEMDLSDWLVTPQESHKLRKPENGSRETSEKFKLLFQSYNVNDWLVKTDSCTNCQGNQPKGVEIENLGNLKCLNDHLEAKKPLSTPSMVTEDWLVQNHQDPCKVEEVCRANEPCTSFAECVCDENCEKEALYKWLLKKEGKDKNGMPVEPKPEPEKHKDSLNMWLCPRKEVIEQTKAPKAMTPSRIADSFQVIKNSPLSEWLIRPPYKEGSPKEVPGTEDRAGKQKFKSPMNTSWCSFNTADWVLPGKKMGNLSQLSSGEDKWLLRKKAQEVLLNSPLQEEHNFPPDHYGLPAVCDLFACMQLKVDKEKWLYRTPLQM

SEQ ID NO: 834414 - protein, 570 aa, Homo sapiens
MNTFQDQSGSSSNREPLLRCSDARRDLELAIGGVLRAEQQIKDNLREVKAQIHSCISRHLECLRSREVWLYEQVDLIYQLKEETLQQQAQQLYSLLGQFNCLTHQLECTQNKDLANQVSVCLERLGSLTLKPEDSTVLLFEADTITLRQTITTFGSLKTIQIPEHLMAHASSANIGPFLEKRGCISMPEQKSASGIVAVPFSEWLLGSKPASGYQAPYIPSTDPQDWLTQKQTLENSQTSSRACNFFNNVGGNLKGLENWLLKSEKSSYQKCNSHSTTSSFSIEMEKVGDQELPDQDEMDLSDWLVTPQESHKLRKPENGSRETSEKFKLLFQSYNVNDWLVKTDSCTNCQGNQPKGVEIENLGNLKCLNDHLEAKKPLSTPSMVTEDWLVQNHQDPCKVEEVCRANEPCTSFAECVCDENCEKEALYKWLLKKEGKDKNGMPVEPKPEPEKHKDSLNMWLCPRKEVIEQTKAPKAMTPSRIADSFQVIKNSPLSEWLIRPPYKEGSPKEVPGTEDRAGKQKEVLLNSPLQEEHNFPPDHYGLPAVCDLFACMQLKVDKEKWLYRTPLQM

SEQ ID NO: 834415 - protein, 614 aa, Homo sapiens; identical to SEQ ID NO: 834413

SEQ ID NO: 834416 - protein, 595 aa, Homo sapiens
MNTFQDQSGSSSNREPLLRCSDARRDLELAIGGVLRAEQQIKDNLREVKAQIHSCISRHLECLRSREVWLYEQVDLIYQLKEETLQQQAQQLYSLLGQFNCLTHQLECTQNKDLANQVSVCLERLGSLTLKPEDSTVLLFEADTITLRQTITTFGSLKTIQIPEHLMAHASSANIGPFLEKRGCISMPEQKSASGIVAVPFSEWLLGSKPASGYQAPYIPSTDPQDWLTQKQTLENSQTSSRACNFFNNVGGNLKGLENWLLKSEKSSYQKCNSHSTTSSFSIEMEKVGDQELPDQDEMDLSDWLVTPQESHKLRKPENGSRETSEKFKLLFQSYNVNDWLVKTDSCTNCQGNQPKGVEIENLGNLKCLNDHLEAKKPLSTPSMVTEDWLVQNHQDPCKVEEVCRANEPCTSFAECVCDENCEKEALYKWLLKKEGKDKNGMPVEPKPEPEKHKDSLNMWLCPRKEVIEQTKAPKAMTPSRIADSFQVIKNSPLSEWLIRPPYKEGSPKEVPGTEDRAGKQKPGKKMGNLSQLSSGEDKWLLRKKAQEVLLNSPLQEEHNFPPDHYGLPAVCDLFACMQLKVDKEKWLYRTPLQM

SEQ ID NO: 834417 - protein, 614 aa, Homo sapiens; identical to SEQ ID NO: 834413

SEQ ID NO: 834418 - protein, 614 aa, Homo sapiens; identical to SEQ ID NO: 834413

SEQ ID NO: 834419 - protein, 570 aa, Homo sapiens; identical to SEQ ID NO: 834414

SEQ ID NO: 834420 - protein, 614 aa, Homo sapiens; identical to SEQ ID NO: 834413

SEQ ID NO: 834421 - protein, 614 aa, Homo sapiens; identical to SEQ ID NO: 834413

SEQ ID NO: 834422 - protein, 477 aa, Homo sapiens
MFFEADTITLRQTITTFGSLKTIQIPEHLMAHASSANIGPFLEKRGCISMPEQKSASGIVAVPFSEWLLGSKPASGYQAPYIPSTDPQDWLTQKQTLENSQTSSRACNFFNNVGGNLKGLENWLLKSEKSSYQKCNSHSTTSSFSIEMEKVGDQELPDQDEMDLSDWLVTPQESHKLRKPENGSRETSEKFKLLFQSYNVNDWLVKTDSCTNCQGNQPKGVEIENLGNLKCLNDHLEAKKPLSTPSMVTEDWLVQNHQDPCKVEEVCRANEPCTSFAECVCDENCEKEALYKWLLKKEGKDKNGMPVEPKPEPEKHKDSLNMWLCPRKEVIEQTKAPKAMTPSRIADSFQVIKNSPLSEWLIRPPYKEGSPKEVPGTEDRAGKQKFKSPMNTSWCSFNTADWVLPGKKMGNLSQLSSGEDKWLLRKKAQEVLLNSPLQEEHNFPPDHYGLPAVCDLFACMQLKVDKEKWLYRTPLQM

SEQ ID NO: 834423 - protein, 529 aa, Homo sapiens
CTPAWAAELDSVSKQKKNPKPTFKKKTEERTCEVKKVSRLGSLTLKPEDSTVLLFEADTITLRQTITTFGSLKTIQIPEHLMAHASSANIGPFLEKRGCISMPEQKSASGIVAVPFSEWLLGSKPASGYQAPYIPSTDPQDWLTQKQTLENSQTSSRACNFFNNVGGNLKGLENWLLKSEKSSYQKCNSHSTTSSFSIEMEKVGDQELPDQDEMDLSDWLVTPQESHKLRKPENGSRETSEKFKLLFQSYNVNDWLVKTDSCTNCQGNQPKGVEIENLGNLKCLNDHLEAKKPLSTPSMVTEDWLVQNHQDPCKVEEVCRANEPCTSFAECVCDENCEKEALYKWLLKKEGKDKNGMPVEPKPEPEKHKDSLNMWLCPRKEVIEQTKAPKAMTPSRIADSFQVIKNSPLSEWLIRPPYKEGSPKEVPGTEDRAGKQKFKSPMNTSWCSFNTADWVLPGKKMGNLSQLSSGEDKWLLRKKAQEVLLNSPLQEEHNFPPDHYGLPAVCDLFACMQLKVDKEKWLYRTPLQM

SEQ ID NO: 834424 - protein, 614 aa, Homo sapiens; identical to SEQ ID NO: 834413

SEQ ID NO: 834425 - protein, 570 aa, Homo sapiens; identical to SEQ ID NO: 834414

SEQ ID NO: 834426 - protein, 614 aa, Homo sapiens; identical to SEQ ID NO: 834413

SEQ ID NO: 834427 - protein, 614 aa, Homo sapiens; identical to SEQ ID NO: 834413

SEQ ID NO: 834428 - protein, 504 aa, Homo sapiens
MNTFQDQSGSSSNREPLLRCSDARRDLELAIGGVLRAEQQIKDNLREVKAQIHSCISRHLECLRSREVWLYEQVDLIYQLKEETLQQQAQQLYSLLGQFNCLTHQLECTQNKDLANQVSVCLERLGSLTLKPEDSTVLLFEADTITLRQTITTFGSLKTIQIPEHLMAHASSANIGPFLEKRGCISMPEQKSASGIVAVPFSEWLLGSKPASGYQAPYIPSTDPQDWLTQKQTLENSQTSSRACNFFNNVGGNLKGLENWLLKSEKSSYQKCNSHSTTSSFSIEMEKVGDQELPDQDEMDLSDWLVTPQESHKLRKPENGSRETSEKFKLLFQSYNVNDWLVKTDSCTNCQGNQPKGVEIENLGNLKCLNDHLEAKKPLSTPSMVTEDWLVQNHQDPCKVEEVCRANEPCTSFAECVCDENCEKEALYKWLLKKEGKDKNGMPVEPKPEPEKHKDSLNMWLCPRKEVIEQTKVILSLQAQHTCTSKSDVLVNRPFSTLVPWGVH

SEQ ID NO: 834429 - protein, 578 aa, Homo sapiens
MNTFQDQSGSSSNREPLLRCSDARRDLELAIGGVLRAEQQIKDNLREVKAQIHSCISRHLECLRSREVWLYEQVDLIYQLKEETLQQQAQQLYSLLGQFNCLTHQLECTQNKDLANQVSVCLERLGSLTLKPEDSTVLLFEADTITLRQTITTFGSLKTIQIPEHLMAHASSANIGPFLEKRGCISMPEQKSASGIVAVPFSEWLLGSKPASGYQAPYIPSTDPQDWLTQKQTLENSQTSSRACNFFNNVGGNLKGLENWLLKSEKSSYQKCNSHSTTSSFSIEMEKVGDQELPDQDEMDLSDWLVTPQESHKLRKPENGSRETSEKFKLLFQSYNVNDWLVKTDSCTNCQGNQPKGVEIENLGNLKCLNDHLEAKKPLSTPSMVTEDWLVQNHQDPCKVEEVCRANEPCTSFAECVCDENCEKEALYKWLLKKEGKDKNGMPVEPKPEPEKHKDSLNMWLCPRKEVIEQTKAPKAMTPSRIADSFQVIKNSPLSEWLIRPPYKEGSPKEVPGTEDRAGKQKEVLLNSPLQEEHNFPPDHYGLPAVCDLFACMQLKVDKEKWLYRTPLQVGTCHQHEN

SEQ ID NO: 834430 - protein, 277 aa, Homo sapiens
MNTFQDQSGSSSNREPLLRCSDARRDLELAIGGVLRAEQQIKDNLREVKAQIHSCISRHLECLRSREVWLYEQVDLIYQLKEETLQQQAQQLYSLLGQFNCLTHQLECTQNKDLANQVSVCLERLGSLTLKPEDSTVLLFEADTITLRQTITTFGSLKTIQIPEHLMAHASSANIGPFLEKRGCISMPEQKSASGIVAVPFSEWLLGSKPASGYQAPYIPSTDPQDWLTQKQTLENSQRIQKWEFPRKNLVLGKTLGEGEFGKVVKATAFHLKGRAG

SEQ ID NO: 834431 - protein, 315 aa, Homo sapiens
MNTFQDQSGSSSNREPLLRCSDARRDLELAIGGVLRAEQQIKDNLREVKAQIHSCISRHLECLRSREVWLYEQVDLIYQLKEETLQQQAQQLYSLLGQFNCLTHQLECTQNKDLANQVSVCLERLGSLTLKPEDSTVLLFEADTITLRQTITTFGSLKTIQIPEHLMAHASSANIGPFLEKRGCISMPEQKSASGIVAVPFSEWLLGSKPASGYQAPYIPSTDPQDWLTQKQTLENSQTSSRACNFFNNVGGNLKGYLELQLCSFLRPNTLYFTSQNIIYINHYVNEYVKHSFALMNFVSASIKSITAIVVACYF

SEQ ID NO: 834432 - protein, 79 aa, Homo sapiens
NASKGFGHIWLDSVSCQGHEPAVWQCKHHEWGKHYCNHNEDAGVTCSDGSDLELRLRGGGSRCAGTVEVEIQISFRSII

SEQ ID NO: 834433 - protein, 596 aa, Homo sapiens
MNTFQDQSGSSSNREPLLRCSDARRDLELAIGGVLRAEQQIKDNLREVKAQIHSCISRHLECLRSREVWLYEQVDLIYQLKEETLQQQAQQLYSLLGQFNCLTHQLECTQNKDLANQVSVCLERLGSLTLKPEDSTVLLFEADTITLRQTITTFGSLKTIQIPEHLMAHASSANIGPFLEKRGCISMPEQKSASGIVAVPFSEWLLGSKPASGYQAPYIPSTDPQDWLTQKQTLENSQTSSRACNFFNNVGGNLKGLENWLLKSEKSSYQKCNSHSTTSSFSIEMEKVGDQELPDQDEMDLSDWLVTPQESHKLRKPENGSRETSEKFKLLFQSYNVNDWLVKTDSCTNCQGNQPKGVEIENLGNLKCLNDHLEAKKPLSTPSMVTEDWLVQNHQDPCKVEEVCRANEPCTSFAECVCDENCEKEALYKWLLKKEGKDKNGMPVEPKPEPEKHKDSLNMWLCPSADSFQVIKNSPLSEWLIRPPYKEGSPKEVPGTEDRAGKQKFKSPMNTSWCSFNTADWVLPGKKMGNLSQLSSGEDKWLLRKKAQEVLLNSPLQEEHNFPPDHYGLPAVCDLFACMQLKVDKEKWLYRTPLQM

SEQ ID NO: 834434 - protein, 614 aa, Homo sapiens; identical to SEQ ID NO: 834413

SEQ ID NO: 834435 - protein, 448 aa, Homo sapiens
MAHASSANIGPFLEKRGCISMPEQKSASGIVAVPFSEWLLGSKPASGYQAPYIPSTDPQDWLTQKQTLENSQTSSRACNFFNNVGGNLKGLENWLLKSEKSSYQKCNSHSTTSSFSIEMEKVGDQELPDQDEMDLSDWLVTPQESHKLRKPENGSRETSEKFKLLFQSYNVNDWLVKTDSCTNCQGNQPKGVEIENLGNLKCLNDHLEAKKPLSTPSMVTEDWLVQNHQDPCKVEEVCRANEPCTSFAECVCDENCEKEALYKWLLKKEGKDKNGMPVEPKPEPEKHKDSLNMWLCPRKEVIEQTKAPKAMTPSRIADSFQVIKNSPLSEWLIRPPYKEGSPKEVPGTEDRAGKQKFKSPMNTSWCSFNTADWVLPGKKMGNLSQLSSGEDKWLLRKKAQEVLLNSPLQEEHNFPPDHYGLPAVCDLFACMQLKVDKEKWLYRTPLQM

SEQ ID NO: 834436 - protein, 530 aa, Homo sapiens
MNRWTLFISLKRRHFNSRLSSSTRYWASSIVLLINWSVPKLGSLTLKPEDSTVLLFEADTITLRQTITTFGSLKTIQIPEHLMAHASSANIGPFLEKRGCISMPEQKSASGIVAVPFSEWLLGSKPASGYQAPYIPSTDPQDWLTQKQTLENSQTSSRACNFFNNVGGNLKGLENWLLKSEKSSYQKCNSHSTTSSFSIEMEKVGDQELPDQDEMDLSDWLVTPQESHKLRKPENGSRETSEKFKLLFQSYNVNDWLVKTDSCTNCQGNQPKGVEIENLGNLKCLNDHLEAKKPLSTPSMVTEDWLVQNHQDPCKVEEVCRANEPCTSFAECVCDENCEKEALYKWLLKKEGKDKNGMPVEPKPEPEKHKDSLNMWLCPRKEVIEQTKAPKAMTPSRIADSFQVIKNSPLSEWLIRPPYKEGSPKEVPGTEDRAGKQKFKSPMNTSWCSFNTADWVLPGKKMGNLSQLSSGEDKWLLRKKAQEVLLNSPLQEEHNFPPDHYGLPAVCDLFACMQLKVDKEKWLYRTPLQM

SEQ ID NO: 834437 - protein, 462 aa, Homo sapiens
MICPGSVAKPRIREWALLFFWVNFSTGIWTFLVLWINRKSASGIVAVPFSEWLLGSKPASGYQAPYIPSTDPQDWLTQKQTLENSQTSSRACNFFNNVGGNLKGLENWLLKSEKSSYQKCNSHSTTSSFSIEMEKVGDQELPDQDEMDLSDWLVTPQESHKLRKPENGSRETSEKFKLLFQSYNVNDWLVKTDSCTNCQGNQPKGVEIENLGNLKCLNDHLEAKKPLSTPSMVTEDWLVQNHQDPCKVEEVCRANEPCTSFAECVCDENCEKEALYKWLLKKEGKDKNGMPVEPKPEPEKHKDSLNMWLCPRKEVIEQTKAPKAMTPSRIADSFQVIKNSPLSEWLIRPPYKEGSPKEVPGTEDRAGKQKFKSPMNTSWCSFNTADWVLPGKKMGNLSQLSSGEDKWLLRKKAQEVLLNSPLQEEHNFPPDHYGLPAVCDLFACMQLKVDKEKWLYRTPLQM

SEQ ID NO: 834438 - protein, 286 aa, Homo sapiens
MNTFQDQSGSSSNREPLLRCSDARRDLELAIGGVLRAEQQIKDNLREVKAQIHSCISRHLECLRSREVWLYEQVDLIYQLKEETLQQQAQQLYSLLGQFNCLTHQLECTQNKDLANQVSVCLERLGSLTLKPEDSTVLLFEADTITLRQTITTFGSLKTIQIPEHLMAHASSANIGPFLEKRGCISMPEQKSASGIVAVPFSEWLLGSKPASGYQAPYIPSTDPQDWLTQKQTLENSQEVLLNSPLQEEHNFPPDHYGLPAVCDLFACMQLKVDKEKWLYRTPLQM

SEQ ID NO: 834439 - protein, 212 aa, Homo sapiens
LRLGSEAGWCLNDHLEAKKPLSTPSMVTEDWLVQNHQDPCKVEEVCRANEPCTSFAECVCDENCEKEALYKWLLKKEGKDKNGMPVEPKPEPEKHKDSLNMWLCPRKEVIEQTKAPKAMTPSRIADSFQVIKNSPLSEWLIRPPYKEGSPKEVPGTEDRAGKQKEVLLNSPLQEEHNFPPDHYGLPAVCDLFACMQLKVDKEKWLYRTPLQM

SEQ ID NO: 834440 - protein, 622 aa, Homo sapiens [sequence omitted]

SEQ ID NO: 834441 - protein, 289 aa, Homo sapiens
MNTFQDQSGSSSNREPLLRCSDARRDLELAIGGVLRAEQQIKDNLREVKAQIHSCISRHLECLRSREVWLYEQVDLIYQLKEETLQQQAQQLYSLLGQFNCLTHQLECTQNKDLANQVSVCLERLGSLTLKPEDSTVLLFEADTITLRQTITTFGSLKTIQIPEHLMAHASSANIGPFLEKRGCISMPEQKSASGIVAVPFSEWLLGSKPASGYQAPYIPSTDPQDWLTQKQTLENSQTSSRACNFFNNVGGNLKGLENWLLKSEKSSYQKCNSHSTTSSFSIEMEKLS

SEQ ID NO: 834442 - protein, 255 aa, Homo sapiens [sequence omitted]

SEQ ID NO: 834443 - protein, 919 aa, Homo sapiens
MTGYTMLRNGGAGNGGQTCMLRWSNRIRLTWLSFTLFVILVFFPLIAHYYLTTLDEADEAGKRIFGPRVGNELCEVKHVLDLCRIRESVSEELLQLEAKRQELNSEIAKLNLKIEACKKSIENAKQDLLQLKNVISQTEHSYKELMAQNQPKLSLPIRLLPEKDDAGLPPPKATRGCRLHNCFDYSRCPLTSGFPVYVYDSDQFVFGSYLDPLVKQAFQATARANVYVTENADIACLYVILVGEMQEPVVLRPAELEKQLYSLPHWRTDGHNHVIINLSRKSDTQNLLYNVSTGRAMVAQSTFYTVQYRPGFDLVVSPLVHAMSEPNFMEIPPQVPVKRKYLFTFQGEKIESLRSSLQEARSFEEEMEGDPPADYDDRIIATLKAVQDSKLDQVLVEFTCKNQPKPSLPTEWALCGEREDRLELLKLSTFALIITPGDPRLVISSGCATRLFEALEVGAVPVVLGEQVQLPYQDMLQWNEAALVVPKPRVTEVHFLLRSLSDSDLLAMRRQGRFLWETYFSTADSIFNTVLAMIRTRIQIPAAPIREEAAAEIPHRSGKAAGTDPNMADNGDLDLGPVETEPPYASPRYLRNFTLTVTDFYRSWNCAPGPFHLFPHTPFDPVLPSEAKFLGSGTGFRPIGGGAGGSGKEFQAALGGNVPREQFTVVMLTYEREEVLMNSLERLNGLPYLNKVVVVWNSPKLPSEDLLWPDIGVPIMVVRTEKNSLNNRFLPWNEIETEAILSIDDDAHLRHDEIMFGFRVWREARDRIVGFPGRYHAWDIPHQSWLYNSNYSCELSMVLTGAAFFHKYYAYLYSYVMPQAIRDMVDEYINCEDIAMNFLVSHITRKPPIKVTSRWTFRCPGCPQALSHDDSHFHERHKCINFFVKVYGYMPLLYTQFRVDSVLFKTRLPHDKTKCFKFI

SEQ ID NO: 834444 - protein, 919 aa, Homo sapiens; identical to SEQ ID NO: 834443

SEQ ID NO: 834445 - protein, 876 aa, Homo sapiens
MTGYTMLRNGGAGNGGQTCMLRWSNRIRLTWLSFTLFVILVFFPLIAHYYLTTLDEADEAGKRIFGPRVGNELCEVKHVLDLCRIRESVSEELLQLEAKRQELNSEIAKLNLKIEACKKSIENAKQDLLQLKNVISQTEHSYKELMAQNQPKLSLPIRLLPEKDDAGLPPPKATRGCRLHNCFDYSRCPLTSGFPVYVYDSDQFVFGSYLDPLVKQAFQATARANVYVTENADIACLYVILVGEMQEPVVLRPAELEKQLYSLPHWRTDGHNHVIINLSRKSDTQNLLYNVSTGRAMVAQSTFYTVQYRPGFDLVVSPLVHAMSEPNFMEIPPQVPVKRKYLFTFQGEKIESLRSSLQEARSFEEEMEGDPPADYDDRIIATLKAVQDSKLDQVLVEFTCKNQPKPSLPTEWALCGEREDRLELLKLSTFALIITPGDPRLVISSGCATRLFEALEVGAVPVVLGEQVQLPYQDMLQWNEAALVVPKPRVTEVHFLLRSLSDSDLLAMRRQGRFLWETYFSTADSIFNTVLAMIRTRIQIPAAPIREEAAAEIPHRSGKAAGTDPNMADNGDLDLGPVETEPPYASPRYLRNFTLTVTDFYRSWNCAPGPFHLFPHTPFDPVLPSEAKFLGSGTGFRPIGGGAGGSGKEFQAALGGNVPREQFTVVMLTYEREEVLMNSLERLNGLPYLNKVVVVWNSPKLPSEDLLWPDIGVPIMVVRTEKNSLNNRFLPWNEIETEAILSIDDDAHLRHDEIMFGFRVWREARDRIVGFPGRYHAWDIPHQSWLYNSNYSCELSMVLTGAAFFHKVTSRWTFRCPGCPQALSHDDSHFHERHKCINFFVKVYGYMPLLYTQFRVDSVLFKTRLPHDKTKCFKFI

SEQ ID NO: 834446 - protein, 919 aa, Homo sapiens; identical to SEQ ID NO: 834443

SEQ ID NO: 834447 - protein, 107 aa, Homo sapiens
MGKRRHRPRVSLAVCGPPLATLSWLAGCRSASFSGWPACCSGLGCLTITPSQGSAGHCERWLPGQCSSVWTVPQARAHQLGSCPEGWDLSGSCAGQSGELLVCGGKL

SEQ ID NO: 834448 - protein, 919 aa, Homo sapiens; identical to SEQ ID NO: 834443

SEQ ID NO: 834449 - protein, 919 aa, Homo sapiens; identical to SEQ ID NO: 834443

SEQ ID NO: 834450 - protein, 340 aa, Homo sapiens
MTGYTMLRNGGAGNGGQTCMLRWSNRIRLTWLSFTLFVILVFFPLIAHYYLTTLDEADEAGKRIFGPRVGNELCEVKHVLDLCRIRESVSEELLQLEAKRQELNSEIAKLNLKIEACKKSIENAKQDLLQLKNVISQTEHSYKELMAQNQPKLSLPIRLLPEKDDAGLPPPKATRGCRLHNCFDYSRCPLTSGFPVYVYDSDQFVFGSYLDPLVKQAFQATARANVYVTENADIACLYVILVGEMQEPVVLRPAELEKQLYSLPHWRTDGHNHVIINLSRKSDTQNLLYNVSTGRAMVAQSTFYTVQYRPGFDLVVSPLVHAMSEPNFMEIPPTCRASSA

SEQ ID NO: 834451 - protein, 132 aa, Homo sapiens
MISITEWQKIGVGITGFGIFFILFGTLLYFDSVLLAFGNLLFLTGLSLIIGLRKTFWFFFQRHKLKGTSFLLGGVVIVLLRWPLLGMFLETYGFFSLFKGFFPVAFGFLGNVCNIPFLGALFRRLQGTSSMV

SEQ ID NO: 834452 - protein, 334 aa, Homo sapiens
MVGREKELSIHFVPGSCRLVEEEVNIPNRRVLVTGATGLLGRAVHKEFQQNNWHAVGCGFRRARPKFEQVNLLDSNAVHHIIHDFQPHVIVHCAAERRPDVVENQPDAASQLNVDASGNLAKEAAAVGAFLIYISSDYVFDGTNPPYREEDIPAPLNLYGKTKLDGEKAVLENNLGAAVLRIPILYGEVEKLEESAVTVMFDKVQFSNKSANMDHWQQRFPTHVKDVATVCRQLAEKRMLDPSIKGTFHWSGNEQMTKYEMACAIADAFNLPSSHLRPITDSPVLGAQRPRNAQLDCSKLETLGIGQRTPFRIGIKESLWPFLIDKRWRQTVFH

SEQ ID NO: 834453 - protein, 334 aa, Homo sapiens; identical to SEQ ID NO: 834452

SEQ ID NO: 834454 - protein, 223 aa, Homo sapiens
MVGREKELSIHFVPGSCRLVEEEVNIPNRRVLVTGATGLLGRAVHKEFQQNNWHAVGCGFRRARPKFEQVNLLDSNAVHHIIHDFQPHVIVHCAAERRPDVVENQPDAASQLNVDASGNLAKEAAAVGAFLIYISSDYVFDGTNPPYREEDIPAPLNLYGKTKLDGEKAVLENNLGAAVLRIPILYGQLVTNIVHCRIGSHTGKIGHWFREFALRHVAALIRD

SEQ ID NO: 834455 - protein, 248 aa, Homo sapiens
MPEMPEDMEQEEVNIPNRRVLVTGATGLLGRAVHKEFQQNNWHAVGCGFRRARPKFEQVNLLDSNAVHHIIHDFQPHVIVHCAAERRPDVVENQPDAASQLNVDASGNLAKEAAAVGAFLIYISSDYVFDGTNPPYREEDIPAPLNLYGKTKLDGEKAVLENNLGAAVLRIPILYGEVEKLEESAVTVMFDKVQFSNKSANMDHWQQRFPTHVKDVATVCRQLAEKRMLVRRIPESCLSEGPLCLFHA

SEQ ID NO: 834456 - protein, 323 aa, Homo sapiens
MPEMPEDMEQEEVNIPNRRVLVTGATGLLGRAVHKEFQQNNWHAVGCGFRRARPKFEQVNLLDSNAVHHIIHDFQPHVIVHCAAERRPDVVENQPDAASQLNVDASGNLAKEAAAVGAFLIYISSDYVFDGTNPPYREEDIPAPLNLYGKTKLDGEKAVLENNLGAAVLRIPILYGEVEKLEESAVTVMFDKVQFSNKSANMDHWQQRFPTHVKDVATVCRQLAEKRMLDPSIKGTFHWSGNEQMTKYEMACAIADAFNLPSSHLRPITDSPVLGAQRPRNAQLDCSKLETLGIGQRTPFRIGIKESLWPFLIDKRWRQTVFH

SEQ ID NO: 834457 - protein, 135 aa, Homo sapiens
MFDKVQFSNKSANMDHWQQRFPTHVKDVATVCRQLAEKRMLDPSIKGTFHWSGNEQMTKYEMACAIADAFNLPSSHLRPITDSPVLGAQRPRNAQLDCSKLETLGIGQRTPFRIGIKESLWPFLIDKRWRQTVFH

SEQ ID NO: 834458 - protein, 259 aa, Homo sapiens
MVGREKELSIHFVPGSCRLVEEEVNIPNRRVLVTGATGLLGRAVHKEFQQNNWHAVGCGFRRARPKFEQVNLLDSNAVHHIIHDFQPHVIVHCAAERRPDVVENQPDAASQLNVDASGNLAKEAAAVGAFLIYISSDYVFDGTNPPYREEDIPAPLNLYGKTKLDGEKAVLENNLGAAVLRIPILYGEVEKLEESAVTVMFDKVQFSNKSANMDHWQQRFPTHVKDVATVCRQLAEKRMLVRRIPESCLSEGPLCLFHA

SEQ ID NO: 834459 - protein, 323 aa, Homo sapiens; identical to SEQ ID NO: 834456

SEQ ID NO: 834460 - protein, 139 aa, Homo sapiens
SFSPGLISVVALQLPALLFLVGPSILRVLVVPPIARRPRDVGFFFQAMCRAERWFSPLRAPLFLIGRRPVLSSLLLFAALPYGGPLLLTRGGGWVAIYWWSPPVFSPPPLFFFFFFFFFFFFFFFFFFLFLQVTYSFYA

SEQ ID NO: 834461 - protein, 334 aa, Homo sapiens; identical to SEQ ID NO: 834452

SEQ ID NO: 834462 - protein, 122 aa, Homo sapiens
GPRGSTHAYAHVKDVATVCRQLAEKRMLDPSIKGTFHWSGNEQMTKYEMACAIADAFNLPSSHLRPITDSPVLGAQRPRNAQLDCSKLETLGIGQRTPFRIGIKESLWPFLIDKRWRQTVFH

SEQ ID NO: 834463 - protein, 95 aa, Homo sapiens
MVERRKKNPQMSAWKSLESSGLMVQKLELNYEEIRYSLGLWCLECCSIDREPLLMGRVGTGDAGDITSGEAEEPLFTGTSFPLQWLDLCSGGAEG

SEQ ID NO: 834464 - protein, 155 aa, Homo sapiens
MGGNVFVLYLQIHSLYRRTGASFQKAQQEFAAGVFSNPAVRHRCCIMSRWSLICTKSFAVLGVVDTALSLGASVRECEPPCQVPAQGPAALHLGRVTGRRLCPEASPCPRLVWKLRPTSRSSLQAFHYAPSRSGALPTRASAGALDSSSINTVTA

SEQ ID NO: 834465 - protein, 72 aa, Homo sapiens
EKEGVLSCLDRIETLLPKEQIQNWALPSHQSLKDFCCGGSVVFQFFCSENGGERAALALSTPKLLSHLHSQN

SEQ ID NO: 834466 - protein, 127 aa, Homo sapiens
ASRRRQVEAAAAGPGYRRFSAARSRPGLNSYPGPRPPPRAREDTGGHPPGVERSRGLDSSLGFSCRQPYCCCCCSLSLAQGLGLQDECQYLLQPQLIVRRLLDVAVLVPGRPSEQTLSPHNRSALYK

SEQ ID NO: 834467 - protein, 650 aa, Homo sapiens
MEVVTAPSGGPFRVCRYLGLGVPADTLNEGGLFLTDYSTCSPRKLSPFRSFASTELFHFHVPEDTFLAVWNLIIFKEQGGTFGDHCPDQSVTVYFRSGAPPVINPLHTHFPGDTAVPGVFSLTLSWTLPNRTSGIFNVSSPLPGDWFLAAHLPQAHGHISVKGLQDECQYLLQPQLIVRRLLDVAVLVPGRPSEQTLSPHNRSALYKVFVPSFTYRVSAQLVCVGGRGVSACPLSLRLRPKAPPLHNSSSVACGGASGCQLELALPPWGHWVYVRVETSSRGPGRTIRFQLCVQLQECPQPGLLRALVPGAAMNMPQSLGNQPLPPEPPSLGTPAEGPGTTSPPEHCWPVRPTLRNELDTFSVHFYIFFGPSVALPPERPAVFAMRLLPVLDSGGVLSLELQLNASSVRQENVTVFGCLTHEVPLSLGDAAVTCSKESLAGFLLSVSATTRVARLRIPFPQTGTWFLALRSLCGVGPRFVRCRNATAEVRMRTFLSPCVDDCGPYGQCKLLRTHNYLYAACECKAGWRGWGCTDSADALTYGFQLLSTLLLCLSNLMFLPPVVLAIRSRYVLEAAVYTFTMFFSTVCGGVCILSLGACAWWWVTVCISTTFSEGLGMSVPSLCLLQTETAVLPKLSCIDNGHFCKTHWSK

SEQ ID NO: 834468 - protein, 995 aa, Homo sapiens
GVTPTSSRGRRRGAWLSPVQRSPESPRPELLPSLDSSLGFSCRQPYVLLLLFSVLGPGAGGLFLTDYSTCSPRKLSPFRSFASTELFHFHVPEDTFLAVWNLIIFKEQGGTFGDHCPDQSVTVYFRSGAPPVINPLHTHFPGDTAVPGVFSLTLSWTLPNRTSGIFNVSSPLPGDWFLAAHLPQAHGHISVKGLQDECQYLLQPQLIVRRLLDVAVLVPGRPSEQTLSPHNRSALYKVFVPSFTYRVSAQLVCVGGRGVSACPLSLRLRPKAPPLHNSSSVACGGASGCQLELALPPWGHWVYVRVETSSRGPGRTIRFQLCVQLQECPQPGLLRALVPGAAMNMPQSLGNQPLPPEPPSLGTPAEGPGTTSPPEHCWPVRPTLRNELDTFSVHFYIFFGPSVALPPERPAVFAMRLLPVLDSGGVLSLELQLNASSVRQENVTVFGCLTHEVPLSLGDAAVTCSKESLAGFLLSVSATTRVARLRIPFPQTGTWFLALRSLCGVGPRFVRCRNATAEVRMRTFLSPCVDDCGPYGQCKLLRTHNYLYAACECKAGWRGWGCTDSADALTYGFQLLSTLLLCLSNLMFLPPVVLAIRSRYVLEAAVYTFTMFFSTFYHACDQPGIVVFCIMDYDVLQFCDFLGSLMSVWVTVIAMARLQPVVKQVLYLLGAMLLSMALQLDRHGLWNLLGPSLFALGILATAWTVRSVRRRHCYPPTWRRWLFYLCPGSLIAGSAVLLYAFVETRDNYFYIHSIWHMLIAGSVGFLLPPRAKTDHGVPSGARARGCGYQLCINEQEELGLVGQEGPLSAASVPAERGFGLALRGYECFLEFFLGVWSPLRRRQAVFLEDMESFSRTQNSSRDLEPFPGHGELPEGLESPCIMESFLRTGAYAGTESLRTKESLLQVWSLSWDAEPSQDMDSFPGRQSPVRSTASFQRRWSLSWGNQISRFSQRLSNSGLRLPSQRQRLGCAVLWRRDCRMDGAGTGAVWVAGILV

SEQ ID NO: 834469 - protein, 627 aa, Homo sapiens
DWPARGRGHEDTASSSYWVVMTQTCRDTPVGSRHWMGLRAEAGALAGMALEATCLALQGSLLEASMKRSFPWATHCLAPQRRTTQPALPRIFLVLALNVHSLRNPSVSGKWDVWCPYHHVSLILDSPDQWEGCKHWLGLAEVVFGISVVAEVPLAWQGPLSYHQKWILSQCSPSQALPFIPFLPVQRSPESPRPELLPRSPAPAPGPRGHRRPPPGGGGAEPRPRLKSGFQLPPALLLLLLFSVLGPGAGGLFLTDYSTCSPRKLSPFRSFASTELFHFHVPEDTFLAVWNLIIFKEQGGTFGDHCPDQSVTVYFRSGAPPVINPLHTHFPGDTAVPGVFSLTLSWTLPNRTSGIFNVSSPLPGDWFLAAHLPQAHGHISVKSSVRQENVTVFGCLTHEVPLSLGDAAVTCSKESLAGFLLSVSATTRVARLRIPFPQTGTWFLALRSLCGVGPRFVRCRNATAEVRMRTFLSPCVDDCGPYGQCKLLRTHNYLYAACECKAGWRGWGCTDSADALTYGFQLLSTLLLCLSNLMFLPPVVLAIRSRYVLEAAVYTFTMFFSTVCGGVCILSLGACAWWWVTVCISTTFSEGLGMSVPSLCLLQTETAVLPKLSCIDNGHFCKTHWSK

SEQ ID NO: 834470 - protein, 473 aa, Homo sapiens
GVTPTSSRGRRRGAWLSPVQRSPESPRPELLPSLDSSLGFSCRQPYVLLLLFSVLGPGAGGLFLTDYSTCSPRKLSPFRSFASTELFHFHVPEDTFLAVWNLIIFKEQGGTFGDHCPDQSVTVYFRSGAPPVINPLHTHFPGDTAVPGVFSLTLSWTLPNRTSGIFNVSSPLPGDWFLAAHLPQAHGHISVKGLQDECQYLLQPQLIVRRLLDVAVLVPGRPSEQTLSPHNRSALYKVFVPSFTYRVSAQLVCVGGRGVSACPLSLRLRPKAPPLHNSSSVACGGASGCQLELALPPWGHWVYVRVETSSRGPGRTIRFQLCVQLQECPQPGLLRALVPGAAMNMPQSLGNQPLPPEPPSLGTPAEGPGTTSPPEHCWPVRPTLRNELDTFSVHFYIFFGPSVALPPERPAVFAMRLLPVLDSGGVLSLELQLNAVLFMESGEVALPGSLKGKVSGVLGCLPPPGSLSRLLPP

SEQ ID NO: 834471 - protein, 870 aa, Homo sapiens
DWPARGRGHEDTASSSYWVVMTQTCRDTPVGSRHWMGLRAEAGALAGMALEATCLALQGSLLEASMKRSFPWATHCLAPQRRTTQPALPRIFLVLALNVHSLRNPSVSGKWDVWCPYHHVSLILDSPDQWEGCKHWLGLAEVVFGISVVAEVPLAWQGPLSYHQKWILSQCSPSQALPFIPFLPVQRSPESPRPELLPRSPAPAPGPRGHRRPPPGGGGAEPRPRLKSGFQLPPALLLLLLFSVLGPGAGGLFLTDYSTCSPRKLSPFRSFASTELFHFHVPEDTFLAVWNLIIFKEQGGTFGDHCPDQSVTVYFRSGAPPVINPLHTHFPGDTAVPGVFSLTLSWTLPNRTSGIFNVSSPLPGDWFLAAHLPQAHGHISVKGLQDECQYLLQPQLIVRRLLDVAVLVPGRPSEQTLSPHNRSALYKVFVPSFTYRVSAQLVCVGGRGVSACPLSLRLRPKAPPLHNSSSVACGGASGCQLELALPPWGHWVYVRVETSSRGPGRTIRFQLCVQLQECPQPGLLRALVPGAAMNMPQSLGNQPLPPEPPSLGTPAEGPGTTSPPEHCWPVRPTLRNELDTFSVHFYIFFGPSVALPPERPAVFAMRLLPVLDSGGVLSLELQLNASSVRQENVTVFGCLTHEVPLSLGDAAVTCSKESLAGFLLSVSATTRVARLRIPFPQTGTWFLALRSLCGVGPRFVRCRNATAEVRMRTFLSPCVDDCGPYGQCKLLRTHNYLYAACECKAGWRGWGCTDSADALTYGFQLLSTLLLCLSNLMFLPPVVLAIRSRYVLEAAVYTFTMFFSTVCGGVCILSLGACAWWWVTVCISTTFSEGLGMSVPSLCLLQTETAVLPKLSCIDNGHFCKTHWSK

SEQ ID NO: 834472 - protein, 680 aa, Homo sapiens
GVTPTSSRGRRRGAWLSPVQRSPESPRPELLPSLDSSLGFSCRQPYVLLLLFSVLGPGAGGLFLTDYSTCSPRKLSPFRSFASTELFHFHVPEDTFLAVWNLIIFKEQGGTFGDHCPDQSVTVYFRSGAPPVINPLHTHFPGDTAVPGVFSLTLSWTLPNRTSGIFNVSSPLPGDWFLAAHLPQAHGHISVKGLQDECQYLLQPQLIVRRLLDVAVLVPGRPSEQTLSPHNRSALYKVFVPSFTYRVSAQLVCVGGRGVSACPLSLRLRPKAPPLHNSSSVACGGASGCQLELALPPWGHWVYVRVETSSRGPGRTIRFQLCVQLQECPQPGLLRALVPGAAMNMPQSLGNQPLPPEPPSLGTPAEGPGTTSPPEHCWPVRPTLRNELDTFSVHFYIFFGPSVALPPERPAVFAMRLLPVLDSGGVLSLELQLNASSVRQENVTVFGCLTHEVPLSLGDAAVTCSKESLAGFLLSVSATTRVARLRIPFPQTGTWFLALRSLCGVGPRFVRCRNATAEVRMRTFLSPCVDDCGPYGQCKLLRTHNYLYAACECKAGWRGWGCTDSADALTYGFQLLSTLLLCLSNLMFLPPVVLAIRSRYVLEAAVYTFTMFFSTVCGGVCILSLGACAWWWVTVCISTTFSEGLGMSVPSLCLLQTETAVLPKLSCIDNGHFCKTHWSK

SEQ ID NO: 834473 - protein, 887 aa, Homo sapiens
GVTPTSSRGRRRGAWLSPVQRSPESPRPELLPRLSGTPALCQGGQQHKGGWGGAWLKASRSPSGSEAMIWRRQLGSPRRTCWVQGLQDECQYLLQPQLIVRRLLDVAVLVPGRPSEQTLSPHNRSALYKVFVPSFTYRVSAQLVCVGGRGVSACPLSLRLRPKAPPLHNSSSVACGGASGCQLELALPPWGHWVYVRVETSSRGPGRTIRFQLCVQLQECPQPGLLRALVPGAAMNMPQSLGNQPLPPEPPSLGTPAEGPGTTSPPEHCWPVRPTLRNELDTFSVHFYIFFGPSVALPPERPAVFAMRLLPVLDSGGVLSLELQLNASSVRQENVTVFGCLTHEVPLSLGDAAVTCSKESLAGFLLSVSATTRVARLRIPFPQTGTWFLALRSLCGVGPRFVRCRNATAEVRMRTFLSPCVDDCGPYGQCKLLRTHNYLYAACECKAGWRGWGCTDSADALTYGFQLLSTLLLCLSNLMFLPPVVLAIRSRYVLEAAVYTFTMFFSTFYHACDQPGIVVFCIMDYDVLQFCDFLGSLMSVWVTVIAMARLQPVVKQVLYLLGAMLLSMALQLDRHGLWNLLGPSLFALGILATAWTVRSVRRRHCYPPTWRRWLFYLCPGSLIAGSAVLLYAFVETRDNYFYIHSIWHMLIAGSVGFLLPPRAKTDHGVPSGARARGCGYQLCINEQEELGLVGQEGPLSAASVPAERGFGLALRGYECFLEFFLGVWSPLRRRQAVFLEDMESFSRTQNSSRDLEPFPGHGELPEGLESPCIMESFLRTGAYAGTESLRTKESLLQVWSLSWDAEPSQDMDSFPGRQSPVRSTASFQRRWSLSWGNQISRFSQRLSNSGLRLPSQRQRLGCAVLWRRDCRMDGAGTGAVWVAGILV

SEQ ID NO: 834474 - protein, 345 aa, Homo sapiens
EKEGVLSCLDRIETLLPKEQIQNWALPSHQSLKDFCCGGSVVFQFFCSENGGERAALAWRAPGGMGCPWKVWVNRGGSLRVAVGGDGGCGGLTSITCPPQSSVRQENVTVFGCLTHEVPLSLGDAAVTCSKESLAGFLLSVSATTRVARLRIPFPQTGTWFLALRSLCGVGPRFVRCRNATAEVRMRTFLSPCVDDCGPYGQCKLLRTHNYLYAACECKAGWRGWGCTDSADALTYGFQLLSTLLLCLSNLMFLPPVVLAIRSRYVLEAAVYTFTMFFSTVCGGVCILSLGACAWWWVTVCISTTFSEGLGMSVPSLCLLQTETAVLPKLSCIDNGHFCKTHWSK

SEQ ID NO: 834475 - protein, 435 aa, Homo sapiens
MLLPWATSAPGLAWGPLVLGLFGLLAASQPQAVPPYASENQTCRDQEKEYYEPQHRICCSRCPPGTYVSAKCSRIRDTVCATCAENSYNEHWNYLTICQLCRPCDPVMGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSGTMLMLAVLLPLAFFLLLATVFSCIWKSHPSLCRKLGSLLKRRPQGEGPNPVAGSWEPPKAHPYFPDLVQPLLPISGDVSPVSTGLPAAPVLEAGVPQQQSPLDLTREPQLEPGEQSQVAHGTNGIHVTGGSMTITGNIYIYNGPVLGGPPGPGDLPATPEPPYPIPEEGDPGPPGLSTPHQEDGKAWHLAETEHCGATPSNRGPRNQFITHD

SEQ ID NO: 834476 - protein, 116 aa, Homo sapiens
MWTQYHIPCSRCPPGTYVSAKCSRIRDTVCATCAENSYNEHWNYLTICQLCRPCDPVMGLEEIAPCTSKRKTQCRCQPGMFCAAWALECTHCELLSDCPPGTEAELKGQRSLRGWM

SEQ ID NO: 834477 - protein, 215 aa, Homo sapiens
MSGTMLMLAVLLPLAFFLLLATVFSCIWKSHPSLCRKLGSLLKRRPQGEGPNPVAGSWEPPKAHPYFPDLVQPLLPISGDVSPVSTGLPAAPVLEAGVPQQQSPLDLTREPQLEPGEQSQVAHGTNGIHVTGGSMTITGNIYIYNGPVLGGPPGPGDLPATPEPPYPIPEEGDPGPPGLSTPHQEDGKAWHLAETEHCGATPSNRGPRNQFITHD

SEQ ID NO: 834478 - protein, 435 aa, Homo sapiens; identical to SEQ ID NO: 834475

SEQ ID NO: 834479 - protein, 215 aa, Homo sapiens; identical to SEQ ID NO: 834477

SEQ ID NO: 834480 - protein, 261 aa, Homo sapiens
APDNYSSEEVYYNHALLNGSHVHGTVPHPLSPLTTTPLSTHVGPIMMSRTMLMLAVLLPLAFFLLLATVFSCIWKSHPSLCRKLGSLLKRRPQGEGPNPVAGSWEPPKAHPYFPDLVQPLLPISGDVSPVSTGLPAAPVLEAGVPQQQSPLDLTREPQLEPGEQSQVAHGTNGIHVTGGSMTITGNIYIYNGPVLGGPPGPGDLPATPEPPYPIPEEGDPGPPGLSTPHQEDGKAWHLAETEHCGATPSNRGPRNQFITHD

SEQ ID NO: 834481 - protein, 305 aa, Homo sapiens
MLLPWATSAPGLAWGPLVLGLFGLLAASQPQAVPPYASENQTCRDQEKEYYEPQHRICCSRCPPGTYVSAKCSRIRDTVCATCAENSYNEHWNYLTICQLCRPCDPVMGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSGTMLMLAVLLPLAFFLLLATVFSCIWKSHPSLCRKLGSLLKRRPQVMAGAEKAARRGRGDEGTRWSRQEESMQADSTLIHSFN

SEQ ID NO: 834482 - protein, 190 aa, Homo sapiens
MLLPWATSAPGLAWGPLVLGLFGLLAASQPQAVPPYASENQTCRDQEKEYYEPQHRICCSRCPPGTYVSAKCSRIRDTVCATCAENSYNEHWNYLTICQLCRPCDPVMGLEEIAPCTSKRKTQCRCQPGMFCAAWALECTHCELLSDCPPGTEAELKDEVGKGNNHCVPCKAGHFQNTSSPSARCQPHTR

SEQ ID NO: 834483 - protein, 129 aa, Homo sapiens
SRRAPTPPPNMPIHDTVSPGCQEVLKSNLVPLLYNPREVSLILPLGAALCLEGKKLLPFLCLGCPGIWKALPSPPPLCPSWGCDHPPVCCPGRNHADAGRSAATGLLSAPCHRLLLHLEEPPFSLQETG

SEQ ID NO: 834484 - protein, 435 aa, Homo sapiens; identical to SEQ ID NO: 834475

SEQ ID NO: 834485 - protein, 412 aa, Homo sapiens
RATGRMMGGQRDRGKGQVTLQAAEVRVEPRLLRLYCSTHVLGTYVSAKCSRIRDTVCATCAENSYNEHWNYLTICQLCRPCDPVMGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSGTMLMLAVLLPLAFFLLLATVFSCIWKSHPSLCRKLGSLLKRRPQGEGPNPVAGSWEPPKAHPYFPDLVQPLLPISGDVSPVSTGLPAAPVLEAGVPQQQSPLDLTREPQLEPGEQSQVAHGTNGIHVTGGSMTITGNIYIYNGPVLGGPPGPGDLPATPEPPYPIPEEGDPGPPGLSTPHQEDGKAWHLAETEHCGATPSNRGPRNQFITHD

SEQ ID NO: 834486 - protein, 435 aa, Homo sapiens; identical to SEQ ID NO: 834475

SEQ ID NO: 834487 - protein, 215 aa, Homo sapiens; identical to SEQ ID NO: 834477

SEQ ID NO: 834488 - protein, 450 aa, Homo sapiens
MLLPWATSAPGLAWGPLVLGLFGLLAASQPQAVPPYASENQTCRDQEKEYYEPQHRICCSRCPPGTYVSAKCSRIRDTVCATCAENSYNEHWNYLTICQLCRPCDPVMGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSGTMLMLAVLLPLAFFLLLATVFSCIWKSHPSLCRKLGSLLKRRPQGEGPNPVAGSWEPPKAHPYFPDLVQPLLPISGDVSPVSTGLPAAPVLEAGVPQQQSPLDLTREPQLEPGEQSQVAHGTNGIHVTGGSMTITGNIYIYNGPVLGGPPGPGDLPATPEPPYPIPEEGDPGPPGLSTPHQEDGKAWHLAETEHCGATPSKGFVVLIPKLQRPFGVPHFTWTEVDPA

SEQ ID NO: 834489 - protein, 251 aa, Homo sapiens [sequence omitted]

SEQ ID NO: 834490 - protein, 102 aa, Homo sapiens
MLLPWATSAPGLAWGPLVLGLFGLLAASQPQAVPPYASENQTCRDQEKEYYEPQHRICCSRCPPGECSREGEDGKSSRLGPAPLCYLPDDAEETAFLDASVP

SEQ ID NO: 834491 - protein, 215 aa, Homo sapiens
MATAPYNYSYIFKYIIIGDMGVGKSCLLHQFTEKKFMADCPHTIGVEFGTRIIEVSGQKIKLQIWDTAGQERFRAVTRSYYRGAAGALMVYDITRRSTYNHLSSWLTDARNLTNPNTVIILIGNKADLEAQRDVTYEEAKQFAEENGLLFLEASAKTGENVEDAFLEAAKKIYQNIQDGSLDLNAAESGVQHKPSAPQGGRLTSEPQPQREGCGC

SEQ ID NO: 834492 - protein, 44 aa, Homo sapiens
MTIFQDDLYAGLPQLRKRLPQLDDDADTATHTSNPPRWLTTPIT

SEQ ID NO: 834493 - protein, 215 aa, Homo sapiens; identical to SEQ ID NO: 834491

SEQ ID NO: 834494 - protein, 239 aa, Homo sapiens
GASARGAGLSGGATSPEVRAEEGAWLAALASATLFRAPPAARASSPPSFVVRPIARVTGNPVQGAPPSWTSPRKILREHRSSHRCHCYCRYCCRRVCTSRPASVPAGASVDRPRPLSRCVRTPVPGPDAPLPPGKLPSHQQPPSATMATAPYNYSYIFKYIIIGDMGVGKSCLLHQFTEKKFMADCPHTIGVEFGTRIIEVSGQKIKRHREMLHMKKPNSLLKKMAYCSSKRVQKRERM

SEQ ID NO: 834495 - protein, 215 aa, Homo sapiens; identical to SEQ ID NO: 834491

SEQ ID NO: 834496 - protein, 148 aa, Homo sapiens
NCSCVYFFVEMEGSNMVTYRSYCTNWYFILFQCQYWLHPLVLAVFGDIMLERAPSIRGLTLADSVPSLHCCLPADFLNCSCAIDNVLTCFSLFVNVFALQAAFLPYCIEKEKRLGLLLHILSFYTFIFLEWSDSELDSQNHRSAVKGF

SEQ ID NO: 834497 - protein, 215 aa, Homo sapiens; identical to SEQ ID NO: 834491

SEQ ID NO: 834498 - protein, 215 aa, Homo sapiens; identical to SEQ ID NO: 834491

SEQ ID NO: 834499 - protein, 215 aa, Homo sapiens
MATAPYNYSYIFKYIIIGDMGVGKSCLLHQFTEKKFMADCPHTIGVEFGTRIIEVSGQKIKLQIWDTAGQERFRAVTRSYYRGAAGALMVYDITRRSTYNHLSSWLTDARNLTNPNTVIILIGNKADLEAQRDVTYEEAKQFAEENGLLFLEARVQATRERQRKGGRLGGGGVGASDGGREMLLNVALVALVLLGAYRLGALGAAGSGGRGGAGE

SEQ ID NO: 834500 - protein, 215 aa, Homo sapiens; identical to SEQ ID NO: 834491

SEQ ID NO: 834501 - protein, 196 aa, Homo sapiens
MGVGKSCLLHQFTEKKFMADCPHTIGVEFGTRIIEVSGQKIKLQIWDTAGQERFRAVTRSYYRGAAGALMVYDITRRSTYNHLSSWLTDARNLTNPNTVIILIGNKADLEAQRDVTYEEAKQFAEENGLLFLEASAKTGENVEDAFLEAAKKIYQNIQDGSLDLNAAESGVQHKPSAPQGGRLTSEPQPQREGCGC

SEQ ID NO: 834502 - protein, 215 aa, Homo sapiens; identical to SEQ ID NO: 834491

SEQ ID NO: 834503 - protein, 127 aa, Homo sapiens
MVYDITRRSTYNHLSSWLTDARNLTNPNTVIILIGNKADLEAQRDVTYEEAKQFAEENGLLFLEASAKTGENVEDAFLEAAKKIYQNIQDGSLDLNAAESGVQHKPSAPQGGRLTSEPQPQREGCGC

SEQ ID NO: 834504 - protein, 132 aa, Homo sapiens [sequence omitted]

SEQ ID NO: 834505 - protein, 215 aa, Homo sapiens; identical to SEQ ID NO: 834491

SEQ ID NO: 834506 - protein, 215 aa, Homo sapiens; identical to SEQ ID NO: 834491

SEQ ID NO: 834507 - protein, 1247 aa, Homo sapiens
MTRILTAFKVVRTLKTGFGFTNVTAHQKWKFSRPGIRLLSVKAQTAHIVLEDGTKMKGYSFGHPSSVAGEVVFNTGLGGYPEAITDPAYKGQILTMANPIIGNGGAPDTTALDELGLSKYLESNGIKVSGLLVLDYSKDYNHWLATKSLGQWLQEEKVPAIYGVDTRMLTKIIRDKGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGIMHESKPFFAVQFHPEVTPGPIDTEYLFDSFFSLIKKGKATTITSVLPKPALVASRVEVSKVLILGSGGLSIGQAGEFDYSGSQAVKAMKEENVKTVLMNPNIASVQTNEVGLKQADTVYFLPITPQFVTEVIKAEQPDGLILGMGGQTALNCGVELFKRGVLKEYGVKVLGTSVESIMATEDRQLFSDKLNEINEKIAPSFAVESIEDALKAADTIGYPVMIRSAYALGGLGSGICPNRETLMDLSTKAFAMTNQILVEKSVTGWKEIEYEVVRDADDNCVTVCNMENVDAMGVHTGDSVVVAPAQTLSNAEFQMLRRTSINVVRHLGIVGECNIQFALHPTSMEYCIIEVNARLSRSSALASKATGYPLAFIAAKIALGIPLPEIKNVVSGKTSACFEPSLDYMVTKIPRWDLDRFHGTSSRIGSSMKSVGEVMAIGRTFEESFQKALRMCHPSIEGFTPRLPMNKEWPSNLDLRKELSEPSSTRIYAIAKAIDDNMSLDEIEKLTYIDKWFLYKMRDILNMEKTLKGLNSESMTEETLKRAKEIGFSDKQISKCLGLTEAQTRELRLKKNIHPWVKQIDTLAAEYPSVTNYLYVTYNGQEHDVNFDDHGMMVLGCGPYHIGSSVEFDWCAVSSIRTLRQLGKKTVVVNCNPETVSTDFDECDKLYFEELSLERILDIYHQEACGGCIISVGGQIPNNLAVPLYKNGVKIMGTSPLQIDRAEDRSIFSAVLDELKVAQAPWKAVNTLNEALEFAKSVDYPCLLRPSYVLSGSAMNVVFSEDEMKKFLEEATRVSQEHPVVLTKFVEGAREVEMDAVGKDGRVISHAISEHVEDAGVHSGDATLMLPTQTISQGAIGEGCYPEDCKGFCHLWSIQRPISCQRK

SEQ ID NO: 834508 - protein, 1247 aa, Homo sapiens; identical to SEQ ID NO: 834507

SEQ ID NO: 834509 - protein, 1464 aa, Homo sapiens
MTRILTAFKVVRTLKTGFGFTNVTAHQKWKFSRPGIRLLSVKAQTAHIVLEDGTKMKGYSFGHPSSVAGEVVFNTGLGGYPEAITDPAYKGQILTMANPIIGNGGAPDTTALDELGLSKYLESNGIKVSGLLVLDYSKDYNHWLATKSLGQWLQEEKVPAIYGVDTRMLTKIIRDKGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGIMHESKPFFAVQFHPEVTPGPIDTEYLFDSFFSLIKKGKATTITSVLPKPALVASRVEVSKVLILGSGGLSIGQAGEFDYSGSQAVKAMKEENVKTVLMNPNIASVQTNEVGLKQADTVYFLPITPQFVTEVIKAEQPDGLILGMGGQTALNCGVELFKRGVLKEYGVKVLGTSVESIMATEDRQLFSDKLNEINEKIAPSFAVESIEDALKAADTIGYPVMIRSAYALGGLGSGICPNRETLMDLSTKAFAMTNQILVEKSVTGWKEIEYEVVRDADDNCVTVCNMENVDAMGVHTGDSVVVAPAQTLSNAEFQMLRRTSINVVRHLGIVGECNIQFALHPTSMEYCIIEVNARLSRSSALASKATGYPLAFIAAKIALGIPLPEIKNVVSGKTSACFEPSLDYMVTKIPRWDLDRFHGTSSRIGSSMKSVGEVMAIGRTFEESFQKALRMCHPSIEGFTPRLPMNKEWPSNLDLRKELSEPSSTRIYAIAKAIDDNMSLDEIEKLTYIDKWFLYKMRDILNMEKTLKGLNSESMTEETLKRAKEIGFSDKQISKCLGLTEAQTRELRLKTVTNYLYVTYNGQEHDVNFDDHGMMVLGCGPYHIGSSVEFDWCAVSSIRTLRQLGKKTVVVNCNPETVSTDFDECDKLYFEELSLERILDIYHQEACGGCIISVGGQIPNNLAVPLYKNGVKIMGTSPLQIDRAEDRSIFSAVLDELKVAQAPWKAVNTLNEALEFAKSVDYPCLLRPSYVLSGSAMNVVFSEDEMKKFLEEATRVSQEHPVVLTKFVEGAREVEMDAVGKDGRVISHAISEHVEDAGVHSGDATLMLPTQTISQGAIAFNVQFLVKGNDVLVIECNLRASRSFPFVSKTLGVDFIDVATKVMIGENVDEKHLPTLDHPIIPADYVAIKAPMFSWPRLRDADPILRCEMASTGEVACFGEGIHTAFLKAMLSTGFKIPQKGILIGIQQSFRPRFLGVAEQLHNEGFKLFATEATSDWLNANNVPATPVAWPSQEGQNPSLSSIRKLIRDGSIDLVINLPNNNTKFVHDNYVIRRTAVDSGIPLLTNFQVTKLFAEAVQKSRKVDSKSLFHYRQYSAGKAA

SEQ ID NO: 834510 - protein, 1247 aa, Homo sapiens; identical to SEQ ID NO: 834507

SEQ ID NO: 834511 - protein, 1227 aa, Homo sapiens
MTRILTAFKVVRTLKTGFGFTNVTAHQKWKFSRPGIRLLSVKAQTAHIVLEDGTKMKGYSFGHPSSVAGEVVFNTGLGGYPEAITDPAYKGQILTMANPIIGNGGAPDTTALDELGLSKYLESNGIKVSGLLVLDYSKDYNHWLATKSLGQWLQEEKVPAIYGVDTRMLTKIIRDKGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGIMHESKPFFAVQFHPEVTPGPIDTEYLFDSFFSLIKKGKATTITSVLPKPALVASRVEVSKVLILGSGGLSIGQAGEFDYSGSQAVKAMKEENVKTVLMNPNIASVQTNEVGLKQADTVYFLPITPQFVTEVIKAEQPDGLILGMGGQTALNCGVELFKRGVLKEYGVKVLGTSVESIMATEDRQLFSDKLNEINEKIAPSFAVESIEDALKAADTIGYPVMIRSAYALGGLGSGICPNRETLMDLSTKAFAMTNQILVEKSVTGWKEIEYEVVRDADDNCVTVCNMENVDAMGVHTGDSVVVAPAQTLSNAEFQMLRRTSINVVRHLGIVGECNIQFALHPTSMEYCIIEVNARLSRSSALASKATGYPLAFIAAKIALGIPLPEIKNVVSGKTSACFEPSLDYMVTKIPRWDLDRFHGTSSRIGSSMKSVGEVMAIGRTFEESFQKALRMCHPSIEGFTPRLPMNKEWPSNLDLRKELSEPSSTRIYAIAKAIDDNMSLDEIEKLTYIDKWFLYKMRDILNMEKTLKGLNSESMTEETLKRAKEIGFSDKQISKCLGLTEAQTRELRLKKNIHPWVKQIDTLAAEYPSVTNYLYVTYNGQEHDVNFDDHGMMVLGCGPYHIGSSVEFDWCAVSSIRTLRQLGKKTVVVNCNPETVSTDFDECDKLYFEELSLERILDIYHQEACGGCIISVGGQIPNNLAVPLYKNGVKIMGTSPLQIDRAEDRSIFSAVLDELKVAQAPWKAVNTLNEALEFAKSVDYPCLLRPSYVLSGSAMNVVFSEDEMKKFLEEATRVSQVVSNFFVISHAISEHVEDAGVHSGDATLMLPTQTISQGAIGEGCYPEDCKGFCHLWSIQRPISCQRK

SEQ ID NO: 834512 - protein, 1247 aa, Homo sapiens; identical to SEQ ID NO: 834507

SEQ ID NO: 834513 - protein, 355 aa, Homo sapiens
FFSPSFSSGSAMNVVFSEDEMKKFLEEATRVSQEHPVVLTKFVEGAREVEMDAVGKDGRVISHAISEHVEDAGVHSGDATLMLPTQTISQGAIAFNVQFLVKGNDVLVIECNLRASRSFPFVSKTLGVDFIDVATKVMIGENVDEKHLPTLDHPIIPADYVAIKAPMFSWPRLRDADPILRCEMASTGEVACFGEGIHTAFLKAMLSTGFKIPQKGILIGIQQSFRPRFLGVAEQLHNEGFKLFATEATSDWLNANNVPATPVAWPSQEGQNPSLSSIRKLIRDGSIDLVINLPNNNTKFVHDNYVIRRTAVDSGIPLLTNFQVTKLFAEAVQKSRKVDSKSLFHYRQYSAGKAA

SEQ ID NO: 834514 - protein, 1464 aa, Homo sapiens
MTRILTAFKVVRTLKTGFGFTNVTAHQKWKFSRPGIRLLSVKAQTAHIVLEDGTKMKGYSFGHPSSVAGEVVFNTGLGGYPEAITDPAYKGQILTMANPIIGNGGAPDTTALDELGLSKYLESNGIKVSGLLVLDYSKDYNHWLATKSLGQWLQEEKVPAIYGVDTRMLTKIIRDKGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGIMHESKPFFAVQFHPEVTPGPIDTEYLFDSFFSLIKKGKATTITSVLPKPALVASRVEVSKVLILGSGGLSIGQAGEFDYSGSQAVKAMKEENVKTVLMNPNIASVQTNEVGLKQADTVYFLPITPQFVTEVIKAEQPDGLILGMGGQTALNCGVELFKRGVLKEYGVKVLGTSVESIMATEDRQLFSDKLNEINEKIAPSFAVESIEDALKAADTIGYPVMIRSAYALGGLGSGICPNRETLMDLSTKAFAMTNQILVEKSVTGWKEIEYEVVRDADDNCVTVCNMENVDAMGVHTGDSVVVAPAQTLSNAEFQMLRRTSINVVRHLGIVGECNIQFALHPTSMEYCIIEVNARLSRSSALASKATGYPLAFIAAKIALGIPLPEIKNVVSGKTSACFEPSLDYMVTKIPRWDLDRFHGTSSRIGSSMKSVGEVMAIGRTFEESFQKALRMCHPSIEGFTPRLPMNKEWPSNLDLRKELSEPSSTRIYAIAKAIDDNMSLDEIEKLTYIDKWFLYKMRDILNMEKTLKGLNSESMTEETLKRAKEIGFSDKQISKCLGLTEAQTRELRLKKNIHPWVKQIDTLAAEYPSVTNYLYVTYNGQEHDVNFDDHGMMVLGCGPYHIGSSVEFDWCAVSSIRTLRQLGKKTVVVNCNPETVSTDFDECDKLYFEELSLERILDIYHQEACGGCIISVGGQIPNNLAVPLYKNGVKIMGTSPLQIDRAEDRSIFSAVLDELKVAQAPWKAVNTLNEALEFAKSVDYPCLLRPSYVLSGSAMNVVFSEDEMKKFLEEATRVSQEHPVVLTKFVEGAREVEMDAVGKDGRVISHAISEHVEDAGVHSGDATLMLPTQTISQGAIAFNVQFLVKGNDVLVIECNLRASRSFPFVSKTLGVDFIDVATKVMIGENVDEKHLPTLDHPIIPADYVAIKAPMFSWPRLRDADPILRCEMASTGEVACFGEGIHTAFLKAMLSTGFKIPQKGILIGIQQSFRPRFLGVAEQLHNEGFKLFATEATSDWLNANNVPATPVAWPSQEGQNPSLSSIRNKFVHDNYVIRRTAVDSGIPLLTNFQVTKLFAEAVQKSRKVDSKSLFHYRQYSAGKAA

SEQ ID NO: 834515 - protein, 1483 aa, Homo sapiens
MTRILTAFKVVRTLKTGFGFTNVTAHQKWKFSRPGIRLLSVKAQTAHIVLEDGTKMKGYSFGHPSSVAGEVVFNTGLGGYPEAITDPAYKGQILTMANPIIGNGGAPDTTALDELGLSKYLESNGIKVSGLLVLDYSKDYNHWLATKSLGQWLQEEKVPAIYGVDTRMLTKIIRDKGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGIMHESKPFFAVQFHPEVTPGPIDTEYLFDSFFSLIKKGKATTITSVLPKPALVASRVEVSKVLILGSGGLSIGQAGEFDYSGSQAVKAMKEENVKTVLMNPNIASVQTNEVGLKQADTVYFLPITPQFVTEVIKAEQPDGLILGMGGQTALNCGVELFKRGVLKEYGVKVLGTSVESIMATEDRQLFSDKLNEINEKIAPSFAVESIEDALKAADTIGYPVMIRSAYALGGLGSGICPNRETLMDLSTKAFAMTNQILVEKSVTGWKEIEYEVVRDADDNCVTVCNMENVDAMGVHTGDSVVVAPAQTLSNAEFQMLRRTSINVVRHLGIVGECNIQFALHPTSMEYCIIEVNARLSRSSALASKATGYPLAFIAAKIALGIPLPEIKNVVSGKTSACFEPSLDYMVTKIPRWDLDRFHGTSSRIGSSMKSVGEVMAIGRTFEESFQKALRMCHPSIEGFTPRLPMNKEWPSNLDLRKELSEPSSTRIYAIAKAIDDNMSLDEIEKLTYIDKWFLYKMRDILNMEKTLKGLNSESMTEETLKRAKEIGFSDKQISKCLGLTEAQTRELRLKKNIHPWVKQIDTLAAEYPSVTNYLYVTYNGQEHDVNFDDHGMMVLGCGPYHIGSSVEFDWCAVSSIRTLRQLGKKTVVVNCNPETVSTDFDECDKLYFEELSLERILDIYHQEACGGCIISVGGQIPNNLAVPLYKNGVKIMGTSPLQIDRAEDRSIFSAVLDELKVAQAPWKAVNTLNEALEFAKSVDYPCLLRPSYVLSGSAMNVVFSEDEMKKFLEEATRVSQEHPVVLTKFVEGAREVEMDAVGKDGRVISHAISEHVEDAGVHSGDATLMLPTQTISQGAIAFNVQFLVKGNDVLVIECNLRASRSFPFVSKTLGVDFIDVATKVMIGENVDEKHLPTLDHPIIPADYVAIKAPMFSWPRLRDADPILRCEMASTGEVACFGEGIHTAFLKAMLSTGFKIPQKGILIGIQQSFRPRFLGVAEQLHNEGFKLFATEATSDWLNANNVPATPVAWPSQEGQNPSLSSIRKLIRDGSIDLVINLPNNNTKFVHDNYVIRRTAVDSGIPLLTNFQVTKLFAEAVQKSRKVDSKSLFHYRQYSAEPHVI

SEQ ID NO: 834516 - protein, 1233 aa, Homo sapiens
MTRILTAFKVVRTLKTGFGFTNVTAHQKWKFSRPGIRLLSVKAQTAHIVLEDGTKMKGYSFGHPSSVAGEVVFNTGLGGYPEAITDPAYKGQILTMANPIIGNGGAPDTTALDELGLSKYLESNGIKVSGLLVLDYSKDYNHWLATKSLGQWLQEEKVPAIYGVDTRMLTKIIRDKGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGIMHESKPFFAVQFHPEVTPGPIDTEYLFDSFFSLIKKGKATTITSVLPKPALVASRVEVSKVLILGSGGLSIGQAGEFDYSGSQAVKAMKEENVKTVLMNPNIASVQTNEVGLKQADTVYFLPITPQFVTEVIKAEQPDGLILGMGGQTALNCGVELFKRGVLKEYGVKVLGTSVESIMATEDRQLFSDKLNEINEKIAPSFAVESIEDALKAADTIGYPVMIRSAYALGGLGSGICPNRETLMDLSTKAFAMTNQILVEKSVTGWKEIEYEVVRDADDNCVTVCNMENVDAMGVHTGDSVVVAPAQTLSNAEFQMLRRTSINVVRHLGIVGECNIQFALHPTSMEYCIIEVNARLSRSSALASKATGYPLAFIAAKIALGIPLPEIKNVVSGKTSACFEPSLDYMVTKIPRWDLDRFHGTSSRIGSSMKSVGEVMAIGRTFEESFQKALRMCHPSIEGFTPRLPMNKEWPSNLDLRKELSEPSSTRIYAIAKAIDDNMSLDEIEKLTYIDKWFLYKMRDILNMEKTLKGLNSESMTEETLKRAKEIGFSDKQISKCLGLTEAQTRELRLKKNIHPWVKQIDTLAAEYPSVTNYLYVTYNGQEHDVNFDDHGMMVLGCGPYHIGSSVEFDWCAVSSIRTLRQLGKKTVVVNCNPETVSTDFDECDKLYFEELSLERILDIYHQEACGGCIISVGGQIPNNLAVPLYKNGVKIMGTSPLQIDRAEDRSIFSAVLDELKVAQAPWKAVNTLNEALEFAKSVDYPCLLRPSYVLSGSAMNVVFSEDEMKKFLEEATRVSQEHPVVLTKFVEGAREVEMDAVGKDGRVISHAISEHVEDAGVHSGDATLMLPTQTISQGAIVTSILARNDAWDE

SEQ ID NO: 834517 - protein, 1482 aa, Homo sapiens
MTRILTAFKVVRTLKTGFGFTNVTAHQKWKFSRPGIRLLSVKAQTAHIVLEDGTKMKGYSFGHPSSVAGEVVFNTGLGGYPEAITDPAYKGQILTMANPIIGNGGAPDTTALDELGLSKYLESNGIKVSGLLVLDYSKDYNHWLATKSLGQWLQEEKVPAIYGVDTRMLTKIIRDKGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGIMHESKPFFAVQFHPEVTPGPIDTEYLFDSFFSLIKKGKATTITSVLPKPALVASRVEVSKVLILGSGGLSIGQAGEFDYSGSQAVKAMKEENVKTVLMNPNIASVQTNEVGLKQADTVYFLPITPQFVTEVIKAEQPDGLILGMGGQTALNCGVELFKRGVLKEYGVKVLGTSVESIMATEDRQLFSDKLNEINEKIAPSFAVESIEDALKAADTIGYPVMIRSAYALGGLGSGICPNRETLMDLSTKAFAMTNQILVEKSVTGWKEIEYEVVRDADDNCVTVCNMENVDAMGVHTGDSVVVAPAQTLSNAEFQMLRRTSINVVRHLGIVGECNIQFALHPTSMEYCIIEVNARLSRSSALASKATGYPLAFIAAKIALGIPLPEIKNVVSGKTSACFEPSLDYMVTKIPRWDLDRFHGTSSRIGSSMKSVGEVMAIGRTFEESFQKALRMCHPSIEGFTPRLPMNKEWPSNLDLRKELSEPSSTRIYAIAKAIDDNMSLDEIEKLTYIDKWFLYKMRDILNMEKTLKGLNSESMTEETLKRAKEIGFSDKQISKCLGLTEAQTRELRLKKNIHPWVKQIDTLAAEYPSVTNYLYVTYNGQEHDVNFDDHGMMVLGCGPYHIGSSVEFDWCAVSSIRTLRQLGKKTVVVNCNPETVSTDFDECDKLYFEELSLERILDIYHQEACGGCIISVGGQIPNNLAVPLYKNGVKIMGTSPLQIDRAEDRSIFSAVLDELKVAQAPWKAVNTLNEALEFAKSVDYPCLLRPSYVLSGSAMNVVFSEDEMKKFLEEATRVSQEHPVVLTKFVEGAREVEMDAVGKDGRVISHAISEHVEDAGVHSGDATLMLPTQTISQGAIAFNVQFLVKGNDVLVIECNLRASRSFPFVSKTLGVDFIDVATKVMIGENVDEKHLPTLDHPIIPADYVAIKAPMFSWPRLRDADPILRCEMASTGEVACFGEGIHTAFLKAMLSTGFKIPQKGILIGIQQSFRPRFLGVAEQLHNEGFKLFATEATSDWLNANNVPATPVAWPSQEGQNPSLSSIRKLIRDGSIDLVINLPNNNTKFVHDNYVIRRTAVDSGIPLLTNFQVTKLFAEAVQKSRKVDSKSLFHYRQYSAGKAA

SEQ ID NO: 834518 - protein, 1247 aa, Homo sapiens; identical to SEQ ID NO: 834507

SEQ ID NO: 834519 - protein, 300 aa, Homo sapiens
GYEEKLKTSKFKVLCLLESFQKVKDATRKIAKAFAISGPFNVQFLVKGNDVLVIECNLRASRSFPFVSKTLGVDFIDVATKVMIGENVDEKHLPTLDHPIIPADYVAIKAPMFSWPRLRDADPILRCEMASTGEVACFGEGIHTAFLKAMLSTGFKIPQKGILIGIQQSFRPRFLGVAEQLHNEGFKLFATEATSDWLNANNVPATPVAWPSQEGQNPSLSSIRKLIRDGSIDLVINLPNNNTKFVHDNYVIRRTAVDSGIPLLTNFQVTKLFAEAVQKSRKVDSKSLFHYRQYSAGKAA

SEQ ID NO: 834520 - protein, 1366 aa, Homo sapiens
MTRILTAFKVVRTLKTGFGFTNVTAHQKWKFSRPGIRLLSVKAQTAHIVLEDGTKMKGYSFGHPSSVAGEVVFNTGLGGYPEAITDPAYKGQILTMANPIIGNGGAPDTTALDELGLSKYLESNGIKVSGLLVLDYSKDYNHWLATKSLGQWLQEEKVPAIYGVDTRMLTKIIRDKGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGIMHESKPFFAVQFHPEVTPGPIDTEYLFDSFFSLIKKGKATTITSVLPKPALVASRVEVSKVLILGSGGLSIGQAGEFDYSGSQAVKAMKEENVKTVLMNPNIASVQTNEVGLKQADTVYFLPITPQFVTEVIKAEQPDGLILGMGGQTALNCGVELFKRGVLKEYGVKVLGTSVESIMATEDRQLFSDKLNEINEKIAPSFAVESIEDALKAADTIGYPVMIRSAYALGGLGSGICPNRETLMDLSTKAFAMTNQILVEKSVTGWKEIEYEVVRDADDNCVTVCNMENVDAMGVHTGDSVVVAPAQTLSNAEFQMLRRTSINVVRHLGIVGECNIQFALHPTSMEYCIIEVNARLSRSSALASKATGYPLAFIAAKIALGIPLPEIKNVVSGKTSACFEPSLDYMVTKIPRWDLDRFHGTSSRIGSSMKSVGEVMAIGRTFEESFQKALRMCHPSIEGFTPRLPMNKEWPSNLDLRKELSEPSSTRIYAIAKAIDDNMSLDEIEKLTYIDKWFLYKMRDILNMEKTLKGLNSESMTEETLKRAKEIGFSDKQISKCLGLTEAQTRELRLKKNIHPWVKQIDTLAAEYPSVTNYLYVTYNGQEHDVNFDDHGMMVLGCGPYHIGSSVEFDWCAVSSIRTLRQLGKKTVVVNCNPETVSTDFDECDKLYFEELSLERILDIYHQEACGGCIISVGGQIPNNLAVPLYKNGVKIMGTSPLQIDRAEDRSIFSAVLDELKVAQAPWKAVNTLNEALEFAKSVDYPCLLRPSYVLSGSAMNVVFSEDEMKKFLEEATRVSQEHPVVLTKFVEGAREVEMDAVGKDGRVISHAISEHVEDAGVHSGDATLMLPTQTISQGAIAFNVQFLVKGNDVLVIECNLRASRSFPFVSKTLGVDFIDVATKVMIGENVDEKHLPTLDHPIIPADYVAIKAPMFSWPRLRDADPILRCEMASTGEVACFGEGIHTAFLKAMLSTGFKIPQKGILIGIQQSFRPRILGGLNNTHEG

SEQ ID NO: 834521 - protein, 140 aa, Homo sapiens
MKRGTSLHSRRGKPEAPKGSPQINRKSGQEMTAVMQSGRPRSSSTTDAPTGSAMMEIACAAAAAAAACLPGEEGTAERIERLEVSSLAQTSSAVASSTDGSIHTDSVDGTPDPQRTKAAIAHLQQKILKLTEQIKIAQTA

SEQ ID NO: 834522 - protein, 130 aa, Homo sapiens
MLTLGEQLPLVTRFRRHSVHPPRLDLFFIWIFCFYVFLKNNFLGNLLDYNCSSSPMQRKGSYCWDFEEIERLEVSSLAQTSSAVASSTDGSIHTDSVDGTPDPQRTKAAIAHLQQKILKLTEQIKIAQTA

SEQ ID NO: 834523 - protein, 72 aa, Homo sapiens
GLLMASPRKCWNQNWSETLKGTAWRATPQGSQVSAHLTTLQQTLLCNLTSPFRPQPTTILFMPGTNCFSASA

SEQ ID NO: 834524 - protein, 121 aa, Homo sapiens
LKAKNSARRRSPDRDRHRDLEERNRRSSGHRDRERDSRDRESRREKEEARGKEKPEVTDRAGGNKTVEPPISQVGNVDTASELEKGVSEAAVLKPSEELPAEATSSVEPEKDSGSAAEAPR

SEQ ID NO: 834525 - protein, 767 aa, Homo sapiens
MDAVNAFNQELFSLMDMKPPISRAKMILITKAAIKAIKLYKHVVQIVEKFIKKCKPEYKVPGLYVIDSIVRQSRHQFGTDKDVFGPRFSKNITATFQYLYLCPSEDKSKIVRVLNLWQKNGVFKIEIIQPLLDMAAGTSNAAPVAENVTNNEGSPPPPVKVSSEPPTQATPNSVPAVPQLPSSDAFAAVAQLFQTTQGQQLQQILQTFQQPPKPQSPALDNAVMAQVQAITAQLKTTPTQPSEQKAAFPPPEQKTAFDKKLLDRFDYDDEPEAVEESKKEDTTAVTTTAPAAAVPPAPTATVPAAAAPAAASPPPPQAPFGFPGDGMQQPAYTQHQNMDQFQPRMMGIQQDPMHHQVPLPPNGQMPGFGLLPTPPFPPMAQPVIPPTPPVQQPFQASFQAQNEPLTQKPHQQEMEVEQPCIQEVKRHMSDNRKSRSRSASRSPKRRRSRSGSRSRRSRHRRSRSRSRDRRRHSPRSRSQERRDREKERERRQKGLPQVKPETASVCSTTLWVGQLDKRTTQQDVASLLEEFGPIESINMIPPRGCAYIVMVHRQDAYRALQKLSRGNYKVNQKSIKIAWALNKGIKADYKQYWDVELGVTYIPWDKVKPEELESFCEGGMLDSDTLNPDWKGIPKKPENEVAQNGGAETSHTEPVSPIPKPLPVPVPPIPVPAPITVPPPQVPPHQPGPPVVGALQPPAFTPPLGIPPPGFGPGVPPPPPPPPFLRPGFNPMHLPPGFLPPGPPPPITPPVSIPPPHTPPISIPNWG

SEQ ID NO: 834526 - protein, 344 aa, Homo sapiens
MYGSAVPPAAPTNLPTPPVTQPVSLLGTQGVAPGPVIGLQAPSTGLLGARPGLIPLQRPPGMPPPHLQRFPLMPPRPMPPHMMHRGPPPGPGGFAMPPPHGMKGPFPPHGPFVRPGGMPGLGGPGPGPGGPEDRDGRQQPPQQPQQQPQPQAPQQPQQQQQQQPPPSQQPPPTQQQPQQFRNDNRQQFNSGRDQERFGRRSFGNRVENDRERYGNRNDDRDNSNRDRREWGRRSPDRDRHRDLEERNRRSSGHRDRERDSRDRESRREKEEARGKEKPEVTDRAGGNKTVEPPISQVGNVDTASELEKGVSEAAVLKPSEELPAEATSSVEPEKDSGSAAEAPR

SEQ ID NO: 834527 - protein, 853 aa, Homo sapiens
MDAVNAFNQELFSLMDMKPPISRAKMILITKAAIKAIKLYKHVVQIVEKFIKKCKPEYKVPGLYVIDSIVRQSRHQFGTDKDVFGPRFSKNITATFQYLYLCPSEDKSKIVRVLNLWQKNGVFKIEIIQPLLDMAAGTSNAAPVAENVTNNEGSPPPPVKVSSEPPTQATPNSVPAVPQLPSSDAFAAVAQLFQTTQGQQLQQILQTFQQPPKPQSPALDNAVMAQVQAITAQLKTTPTQPSEQKAAFPPPEQKTAFDKKLLDRFDYDDEPEAVEESKKEDTTAVTTTAPAAAVPPAPTATVPAAAAPAAASPPPPQAPFGFPGDGMQQPAYTQHQNMDQFQPRMMGIQQDPMHHQVPLPPNGQMPGFGLLPTPPFPPMAQPVIPPTPPVQQPFQASFQAQNEPLTQKPHQQEMEVEQPCIQEVKRHMSDNRKSRSRSASRSPKRRRSRSGSRSRRSRHRRSRSRSRDRRRHSPRSRSQERRDREKERERRQKGLPQVKPETASVCSTTLWVGQLDKRTTQQDVASLLEEFGPIESINMIPPRGCAYIVMVHRQDAYRALQKLSRGNYKVNQKSIKIAWALNKGIKADYKQYWDVELGVTYIPWDKVKPEELESFCEGGMLDSDTLNPDWKGIPKKPENEVAQNGGAETSHTEPVSPIPKPLPVPVPPIPVPAPITVPPPQVPPHQPGPPVVGALQPPAFTPPLGIPPPGFGPGVPPPPPPPPFLRPGFNPMHLPPGFLPPGPPPPITPPVSIPPPHTPPISIPNSTIAGINEDTTKDLSIGNPIPTVVSGARGNAESGDSVKMYGSAVPPAAPTNLPTPPVTQPVSLLGKLFFFIISFPCPTPPPPPHPSPS

SEQ ID NO: 834528 - protein, 344 aa, Homo sapiens; identical to SEQ ID NO: 834526

SEQ ID NO: 834529 - protein, 789 aa, Homo sapiens
MDAVNAFNQELFSLMDMKPPISRAKMILITKAAIKAIKLYKHVVQIVEKFIKKCKPEYKVPGLYVIDSIVRQSRHQFGTDKDVFGPRFSKNITATFQYLYLCPSEDKSKIVRVLNLWQKNGVFKIEIIQPLLDMAAGTSNAAPVAENVTNNEGSPPPPVKVSSEPPTQATPNSVPAVPQLPSSDAFAAVAQLFQTTQGQQLQQILQTFQQPPKPQSPALDNAVMAQVQAITAQLKTTPTQPSEQKAAFPPPEQKTAFDKKLLDRFDYDDEPEAVEESKKEDTTAVTTTAPAAAVPPAPTATVPAAAAPAAASPPPPQAPFGFPGDGMQQPAYTQHQNMDQFQPRMMGIQQDPMHHQVPLPPNGQMPGFGLLPTPPFPPMAQPVIPPTPPVQQPFQASFQAQNEPLTQKPHQQEMEVEQPCIQEVKRHMSDNRKSRSRSASRSPKRRRSRSGSRSRRSRHRRSRSRSRDRRRHSPRSRSQERRDREKERERRQKGLPQVKPETASVCSTTLWVGQLDKRTTQQDVASLLEEFGPIESINMIPPRGCAYIVMVHRQDAYRALQKLSRGNYKVNQKSIKIAWALNKGIKADYKQYWDVELGVTYIPWDKVKPEELESFCEGGMLDSDTLNPDWKGIPKKPENEVAQNGGAETSHTEPVSPIPKPLPVPVPPIPVPAPITVPPPQVPPHQPGPPVVGALQPPAFTPPLGIPPPGFGPGVPPPPPPPPFLRPGFNPMHLPPGFLPPGPPPPITPPVSIPPPHTPPISIPNCKHVFFFVFAYPLGAGCRRISKKK

SEQ ID NO: 834530 - protein, 71 aa, Homo sapiens
MLSPTQQQPQQFRNDNRQQFNSGRDQERFGRRSFGNRVENDRERYGNRNDDRDNSNRDRREWGVLGDNITG

SEQ ID NO: 834531 - protein, 621 aa, Homo sapiens
MPFSFLGSPPPPVKVSSEPPTQATPNSVPAVPQLPSSDAFAAVAQLFQTTQGQQLQQILQTFQQPPKPQSPALDNAVMAQVQAITAQLKTTPTQPSEQKAAFPPPEQKTAFDKKLLDRFDYDDEPEAVEESKKEDTTAVTTTAPAAAVPPAPTATVPAAAAPAAASPPPPQAPFGFPGDGMQQPAYTQHQNMDQFQPRMMGIQQDPMHHQVPLPPNGQMPGFGLLPTPPFPPMAQPVIPPTPPVQQPFQASFQAQNEPLTQKPHQQEMEVEQPCIQEVKRHMSDNRKSRSRSASRSPKRRRSRSGSRSRRSRHRRSRSRSRDRRRHSPRSRSQERRDREKERERRQKGLPQVKPETASVCSTTLWVGQLDKRTTQQDVASLLEEFGPIESINMIPPRGCAYIVMVHRQDAYRALQKLSRGNYKVNQKSIKIAWALNKGIKADYKQYWDVELGVTYIPWDKVKPEELESFCEGGMLDSDTLNPDWKGIPKKPENEVAQNGGAETSHTEPVSPIPKPLPVPVPPIPVPAPITVPPPQVPPHQPGPPVVGALQPPAFTPPLGIPPPGFGPGVPPPPPPPPFLRPGFNPMHLPPGFLPPGPPPPITPPVSIPPPHTPPISIPNWG

SEQ ID NO: 834532 - protein, 1147 aa, Homo sapiens
MDAVNAFNQELFSLMDMKPPISRAKMILITKAAIKAIKLYKHVVQIVEKFIKKCKPEYKVPGLYVIDSIVRQSRHQFGTDKDVFGPRFSKNITATFQYLYLCPSEDKSKIVRVLNLWQKNGVFKIEIIQPLLDMAAGTSNAAPVAENVTNNEGSPPPPVKVSSEPPTQATPNSVPAVPQLPSSDAFAAVAQLFQTTQGQQLQQILQTFQQPPKPQSPALDNAVMAQVQAITAQLKTTPTQPSEQKAAFPPPEQKTAFDKKLLDRFDYDDEPEAVEESKKEDTTAVTTTAPAAAVPPAPTATVPAAAAPAAASPPPPQAPFGFPGDGMQQPAYTQHQNMDQFQPRMMGIQQDPMHHQVPLPPNGQMPGFGLLPTPPFPPMAQPVIPPTPPVQQPFQASFQAQNEPLTQKPHQQEMEVEQPCIQEVKRHMSDNRKSRSRSASRSPKRRRSRSGSRSRRSRHRRSRSRSRDRRRHSPRSRSQERRDREKERERRQKGLPQVKPETASVCSTTLWVGQLDKRTTQQDVASLLEEFGPIESINMIPPRGCAYIVMVHRQDAYRALQKLSRGNYKVNQKSIKIAWALNKGIKADYKQYWDVELGVTYIPWDKVKPEELESFCEGGMLDSDTLNPDWKGIPKKPENEVAQNGGAETSHTEPVSPIPKPLPVPVPPIPVPAPITVPPPQVPPHQPGPPVVGALQPPAFTPPLGIPPPGFGPGVPPPPPPPPFLRPGFNPMHLPPGFLPPGPPPPITPPVSIPPPHTPPISIPNSTIAGINEDTTKDLSIGNPIPTVVSGARGNAESGDSVKMYGSAVPPAAPTNLPTPPVTQPVSLLGTQGVAPGPVIGLQAPSTGLLGARPGLIPLQRPPGMPPPHLQRFPLMPPRPMPPHMMHRGPPPGPGGFAMPPPHGMKGPFPPHGPFVRPGGMPGLGGPGPGPGGPEDRDGRQQPPQQPQQQPQPQAPQQPQQQQQQQPPPSQQPPPTQQQPQQFRNDNRQQFNSGRDQERFGRRSFGNRVENDRERYGNRNDDRDNSNRDRREWGRRSPDRDRHRDLEERNRRSSGHRDRERDSRDRESRREKEEARGKEKPEVTDRAGGNKTVEPPISQVGNVDTASELEKGVSEAAVLKPSEELPAEATSSVEPEKDSGSAAEAPR

SEQ ID NO: 834533 - protein, 1057 aa, Homo sapiens
MDAVNAFNQELFSLMDMKPPISRAKMILITKAAIKAIKLYKHVVQIVEKFIKKCKPEYKVPGLYVIDSIVRQSRHQFGTDKDVFGPRFSKNITATFQYLYLCPSEDKSKIVRVLNLWQKNGVFKIEIIQPLLDMAAGTSNAAPVAENVTNNEGSPPPPVKVSSEPPTQATPNSVPAVPQLPSSDAFAAVAQLFQTTQGQQLQQILQTFQQPPKPQSPALDNAVMAQVQAITAQLKTTPTQPSEQKAAFPPPEQKTAFDKKLLDRFDYDDEPEAVEESKKEDTTAVTTTAPAAAVPPAPTATVPAAAAPAAASPPPPQAPFGFPGDGMQQPAYTQHQNMDQFQPRMMGIQQDPMHHQVPLPPNGQMPGFGLLPTPPFPPMAQPVIPPTPPVQQPFQASFQAQNEPLTQKPHQQEMEVEQPCIQEVKRHMSDNRKSRSRSASRSPKRRRSRSGSRSRRSRHRRSRSRSRDRRRHSPRSRSQERRDREKERERRQKGLPQVKPETASVCSTTLWVGQLDKRTTQQDVASLLEEFGPIESINMIPPRGCAYIVMVHRQDAYRALQKLSRGNYKVNQKSIKIAWALNKGIKADYKQYWDVELGVTYIPWDKVKPEELESFCEGGMLDSDTLNPDWKGIPKKPENEVAQNGGAETSHTEPVSPIPKPLPVPVPPIPVPAPITVPPPQVPPHQPGPPVVGALQPPAFTPPLGIPPPGFGPGVPPPPPPPPFLRPGFNPMHLPPGFLPPGPPPPITPPVSIPPPHTPPISIPNSTIAGINEDTTKDLSIGNPIPTVVSGARGNAESGDSVKMYGSAVPPAAPTNLPTPPVTQPVSLLGTQGVAPGPVIGLQAPSTGLLGARPGLIPLQRPPGMPPPHLQRFPLMPPRPMPPHMMHRGPPPGPGGFAMPPPHGMKGPFPPHGPFVRPGGMPGLGGPGPGPGGPEDRDGRQQPPQQPQQQPQPQAPQQPQQQQQQQPPPSQQPPPTQQQPQQFRNDNRQQFNSGRDQERFGRRSFGNRVENDRERYGNRNDDREIDALVGIETEREILEIESLVERRKKPEERKSLR

SEQ ID NO: 834534 - protein, 121 aa, Homo sapiens; identical to SEQ ID NO: 834524

SEQ ID NO: 834535 - protein, 313 aa, Homo sapiens [sequence omitted]

SEQ ID NO: 834536 - protein, 375 aa, Homo sapiens
ASGGSGLNKGNFIVPVGQSRMSVNYAAGLSPYADKGKCGLPEIFDPPEELERKVWELARLVWQSSNVVFHTGAGISTASGIPDFRGPHGVWTMEERGLAPKFDTTFESARPTQTHMALVQLERVGLLRFLVSQNVDGLHVRSGFPRDKLAELHGNMFVEECAKCKTQYVRDTVVGTMGLKATGRLCTVAKARGLRACRGELRDTILDWEDSLPDRDLALADEASRNADLSITLGTSLQIRPSGNLPLATKRRGGRLVIVNLQPTKHDRHADLRIHGYVDEVMTRLMKHLGLEIPAWDGPRVLERALPPLPRPPTPKLEPKEESPTRINGSIPAGPKQEPCAQHNGSEPASPKRERPTSPAPHRPPKRVKAKAVPS

SEQ ID NO: 834537 - protein, 108 aa, Homo sapiens
MLAGAGHQAQPTLPGSRNADLSITLGTSLQIRPSGNLPLATKRRGGRLVIVNLQPTKHVGVCAYPCPGPPCTLCPPRLTRPAPRQDRHADLRTHVSIVGLIAAAVLVE

SEQ ID NO: 834538 - protein, 369 aa, Homo sapiens
RAGGRQHAQLCGHPVGADRGERGCSSRKRGRQAQREIFDPPEELERKVWELARLVWQSSNVVFHTGAGISTASGIPDFRGPHGVWTMEERGLAPKFDTTFESARPTQTHMALVQLERVGLLRFLVSQNVDGLHVRSGFPRDKLAELHGNMFVEECAKCKTQYVRDTVVGTMGLKATGRLCTVAKARGLRACRGELRDTILDWEDSLPDRDLALADEASRNADLSITLGTSLQIRPSGNLPLATKRRGGRLVIVNLQPTKHDRHADLRIHGYVDEVMTRLMKHLGLEIPAWDGPRVLERALPPLPRPPTPKLEPKEESPTRINGSIPAGPKQEPCAQHNGSEPASPKRERPTSPAPHRPPKRVKAKAVPS

SEQ ID NO: 834539 - protein, 283 aa, Homo sapiens
MEERGLAPKFDTTFESARPTQTHMALVQLERVGLLRFLVSQNVDGLHVRSGFPRDKLAELHGNMFVEECAKCKTQYVRDTVVGTMGLKATGRLCTVAKARGLRACRGELRDTILDWEDSLPDRDLALADEASRNADLSITLGTSLQIRPSGNLPLATKRRGGRLVIVNLQPTKHDRHADLRIHGYVDEVMTRLMKHLGLEIPAWDGPRVLERALPPLPRPPTPKLEPKEESPTRINGSIPAGPKQEPCAQHNGSEPASPKRERPTSPAPHRPPKRVKAKAVPS

SEQ ID NO: 834540 - protein, 283 aa, Homo sapiens; identical to SEQ ID NO: 834539

SEQ ID NO: 834541 - protein, 283 aa, Homo sapiens; identical to SEQ ID NO: 834539

SEQ ID NO: 834542 - protein, 314 aa, Homo sapiens
ASGGSGLNKGNFIVPVGQSRMSVNYAAGLSPYADKGKCGLPEIFDPPEELERKVWELARLVWQSSNVVFHTGAGISTASGIPDFRDKLAELHGNMFVEECAKCKTQYVRDTVVGTMGLKATGRLCTVAKARGLRACRGELRDTILDWEDSLPDRDLALADEASRNADLSITLGTSLQIRPSGNLPLATKRRGGRLVIVNLQPTKHDRHADLRIHGYVDEVMTRLMKHLGLEIPAWDGPRVLERALPPLPRPPTPKLEPKEESPTRINGSIPAGPKQEPCAQHNGSEPASPKRERPTSPAPHRPPKRVKAKAVPS

SEQ ID NO: 834543 - protein, 485 aa, Homo sapiens
MEERGLAPKFDTTFESARPTQTHMALVQLERVGLLRFLVSQNVDGLHVRSGFPRDKLAELHGNMFVEECAKCKTQYVRDTVVGTMGLKATGRLCTVAKARGLRACRGATPTHALGSRGGCEAPEDSPQLPHCRGELRDTILDWEDSLPDRDLALADEASRSDPPPQGAHGGAGRDDSRNTASSSMGQWLRLTGSEGRLPGAGGPGQGLHTRTHTHSSPHGSGWVLHKETKASARCLLYPVLPSREVTEPGSHPRCPSSYHTVILPGMSKGPPRSMTPPTDRRGGQGGIPKADSGVGLALTAPVSTDGLGVNRPPGLARDVGRSRAQAQPTLPGPRNADLSITLGTSLQIRPSGNLPLATKRRGGRLVIVNLQPTKHDRHADLRIHGYVDEVMTRLMKHLGLEIPAWDGPRVLERALPPLPRPPTPKLEPKEESPTRINGSIPAGPKQEPCAQHNGSEPASPKRERPTSPAPHRPPKRVKAKAVPS

SEQ ID NO: 834544 - protein, 262 aa, Homo sapiens
RAGGRQHAQLCGHPVGADRGERGCSSRKRGRQAQREIFDPPEELERKVWELARLVWQSSNVVFHTGAGISTASGIPDFRGPHGVWTMEERGLAPKFDTTFESARPTQTHMALVQLERVGLLRFLVSQNVDGLHVRSGFPRDKLAELHGNMFVEECAKCKTQYVRDTVVGTMGLKATGRLCTVAKARGLRACRGELRDTILDWEDSLPDRDLALADEASRSGPAGTCRWLPSAGEAAWSSSTCSPPSTTAMLTSASMATLTRS

SEQ ID NO: 834545 - protein, 207 aa, Homo sapiens
ASGGSGLNKGNFIVPVGQSRMSVNYAAGLSPYADKGKCGLPEIFDPPEELERKVWELARLVWQSSNVVFHTGAGISTASGIPDFRDKLAELHGNMFVEECAKCKTQYVRDTVVGTMGLKATGRLCTVAKARGLRACRGELRDTILDWEDSLPDRDLALADEASRSGPAGTCRWLPSAGEAAWSSSTCSPPSTTAMLTSASMATLTRS

SEQ ID NO: 834546 - protein, 332 aa, Homo sapiens
ASGGSGLNKGNFIVPVGQSRMSVNYAAGLSPYADKGKCGLPEIFDPPEELERKVWELARLVWQSSNVVFHTGAGISTASGIPDFRGPHGVWTMEERGLAPKFDTTFESARPTQTHMALVQLERVGLLRFLVSQNVDGLHVRSGFPRDKLAELHGNMFVEECAKCKTQYVRDTVVGTMGLKATGRLCTVAKARGLRACRGELRDTILDWEDSLPDRDLALADEASRNADLSITLGTSLQIRPSGNLPLATKRRGGRLVIVNLQPTKHDRHADLRIHGYVDEVMTRLMKHLGLEIPAWDGPRVLERALPPLPRPPTPKGLWCGSGKKPHPRGDS

SEQ ID NO: 834547 - protein, 256 aa, Homo sapiens
MEERGLAPKFDTTFESARPTQTHMALVQLERVGLLRFLVSQNVDGLHVRSGFPRDKLAELHGNMFVEECAKCKTQYVRDTVVGTMGLKATGRLCTVAKARGLRACRNADLSITLGTSLQIRPSGNLPLATKRRGGRLVIVNLQPTKHDRHADLRIHGYVDEVMTRLMKHLGLEIPAWDGPRVLERALPPLPRPPTPKLEPKEESPTRINGSIPAGPKQEPCAQHNGSEPASPKRERPTSPAPHRPPKRVKAKAVPS

SEQ ID NO: 834548 - protein, 550 aa, Homo sapiens
ASGGSGLNKGNFIVPVGQSRMSVNYAAGLSPYADKGKCGLPEIFDPPEELERKVWELARLVWQSSNVVFHTGAGISTASGIPDFRGPHGVWTMEERGLAPKFDTTFESARPTQTHMALVQLERVGLLRFLVSQNVDGLHVRSGFPRDKLAELHGNMFVEECAKCKTQYVRDTVVGTMGLKATGRLCTVAKARGLRACRGELRDTILDWEDSLPDRDLALADEASRSDPPPQGAHGGAGRDDSRNTASSSMGQWLRLTGSEGRLPGAGGPGQGLHTRTHTHSSPHGSGWVLHKETKASARCLLYPVLPSREVTEPGSHPRCPSSYHTVILPGMSKGPPRSMTPPTDRRGGQGGIPKADSGVGLALTAPVSTDGLGVNRPPGLARDVGRSRAQAQPTLPGPRNADLSITLGTSLQIRPSGNLPLATKRRGGRLVIVNLQPTKHDRHADLRIHGYVDEVMTRLMKHLGLEIPAWDGPRVLERALPPLPRPPTPKLEPKEESPTRINGSIPAGPKQEPCAQHNGSEPASPKRERPTSPAPHRPPKRVKAKAVPS

SEQ ID NO: 834549 - protein, 402 aa, Homo sapiens
ASGGSGLNKGNFIVPVGQSRMSVNYAAGLSPYADKGKCGLPEIFDPPEELERKVWELARLVWQSSNVVFHTGAGISTASGIPDFRGPHGVWTMEERGLAPKFDTTFESARPTQTHMALVQLERVGLLRFLVSQNVDGLHVRSGFPRDKLAELHGNMFVEECAKCKTQYVRDTVVGTMGLKATGRLCTVAKARGLRACRGATPTHALGSRGGCEAPEDSPQLPHCRGELRDTILDWEDSLPDRDLALADEASRNADLSITLGTSLQIRPSGNLPLATKRRGGRLVIVNLQPTKHDRHADLRIHGYVDEVMTRLMKHLGLEIPAWDGPRVLERALPPLPRPPTPKLEPKEESPTRINGSIPAGPKQEPCAQHNGSEPASPKRERPTSPAPHRPPKRVKAKAVPS

SEQ ID NO: 834550 - protein, 268 aa, Homo sapiens
ASGGSGLNKGNFIVPVGQSRMSVNYAAGLSPYADKGKCGLPEIFDPPEELERKVWELARLVWQSSNVVFHTGAGISTASGIPDFRGPHGVWTMEERGLAPKFDTTFESARPTQTHMALVQLERVGLLRFLVSQNVDGLHVRSGFPRDKLAELHGNMFVEECAKCKTQYVRDTVVGTMGLKATGRLCTVAKARGLRACRGELRDTILDWEDSLPDRDLALADEASRSGPAGTCRWLPSAGEAAWSSSTCSPPSTTAMLTSASMATLTRS

SEQ ID NO: 834551 - protein, 126 aa, Homo sapiens
ASGGSGLNKGNFIVPVGQSRMSVNYAAGLSPYADKGKCGLPEIFDPPEELERKVWELARLVWQSSNVVFHTGAGISTASGIPDFRGPHGVWTMEERGLAPKFDTTTTNSATTTTYPHDHDEYRTTR

SEQ ID NO: 834552 - protein, 268 aa, Homo sapiens
MASRGRRPEHGGPPELFYDETEARKYVRNSRMIDIQTRMAGRALELLYLPENKPCYLLDIGCGTGLSGSYLSDEGHYWVGLDISPAMLDEAVDREIEGDLLLGDMGQGIPFKPGTFDGCISISAVQWLCNANKKSENPAKRLYCFFASLFSVLVRGSRAVLQLYPENSEQLELITTQATKAGFSGGMVVDYPNSAKAKKFYLCLFSGPSTFIPEGLSENQDEVEPRESVFTNERFPLRMSRRGMVRKSRAWVLGEEGAAQAPGQGSQT

SEQ ID NO: 834553 - protein, 220 aa, Homo sapiens
MASRGRRPEHGGPPELFYDETEARKYVRNSRMIDIQTRMAGRALELLYLPENKPCYLLDIGCGTGLSGSYLSDEGHYWVGLDISPAMLDEAVDREIEGDLLLGDMGQGIPFKPGTFDGCISISAVQWLCNANKKSENPAKRLYCFFASLFSVLVRGSRAVLQLYPENSEQVSPSATGCAGELGDSTGKLSWGSDKESYADWREKEETCTLVWPLMAHLMT

SEQ ID NO: 834554 - protein, 291 aa, Homo sapiens
MASRGRRPEHGGPPELFYDETEARKYVRNSRMIDIQTRMAGRALELLYLPENKPCYLLDIGCGTGLSGSYLSDEGHYWVGLDISPAMLDEAVDREIEGDLLLGDMGQGIPFKPGTFDGCISISAVQWLCNANKKSENPAKRLYCFFASLFSVLVRGSRAVLQLYPENSEQLELITTQATKAGFSGGMVVDYPNSAKAKKFYLCLFSGPSTFIPEGLSENQDEVEPRESVFTNERKGGAFERRGIRGNRLGVPINDCRGGQGERKVGQGGAKGGQAPGGVRLKPVNGRKGSR

SEQ ID NO: 834555 - protein, 218 aa, Homo sapiens
MLSLIKKAGPPELFYDETEARKYVRNSRMIDIQTRMAGRALELLYLPENKPCYLLDIGCGTGLSGSYLSDEGHYWVGLDISPAMLDEAVDREIEGDLLLGDMGQGIPFKPGTFDGCISISAVQWLCNANKKSENPAKRLYCFFASLFSVLVRGSRAVLQLYPENSEQLELITTQATKAGFSGGMVVDYPNSAKAKKFYLCLFSGPSTFIPEAEWNRVK

SEQ ID NO: 834556 - protein, 268 aa, Homo sapiens; identical to SEQ ID NO: 834552

SEQ ID NO: 834557 - protein, 285 aa, Homo sapiens
MASRGRRPEHGGPPELFYDETEARKYVRNSRMIDIQTRMAGRALELLYLPENKPCYLLDIGCGTGLSGSYLSDEGHYWVGLDISPAMLDEAVDREIEGDLLLGDMGQGIPFKPGTFDGCISISAVQWLCNANKKSENPAKRLYCFFASLFSVLVRGSRAVLQLYPENSEQLELITTQATKAGFSGGMVVDYPNSAKAKKFYLCLFSGPSTFIPEGLSENQDEVEPRESVFTNEREGGAFERRGIRGHQTRRFPLRMSRRGMVRKSRAWVLGEEGAAQAPGQGSQT

SEQ ID NO: 834558 - protein, 234 aa, Homo sapiens [sequence omitted]

SEQ ID NO: 834559 - protein, 248 aa, Homo sapiens
MASRGRRPEHGGPPELFYDETEARKYVRNSRMIDIQTRMAGRALELLYLPENKPCYLLDIGCGTGLSGSYLSDEGHYWVGLDISPAMLDEAVDREIEGDLLLGDMGQGIPFKPGTFDGCISISAVQWLCNANKKSENPAKRLYCFFASLFSVLVRGSRAVLQLYPENSEQLELITTQATKAGFSGGMVVDYPNSAKAKKFYLCLFSGPSTFIPEGLSENQDEVEPRESVFTNERKGGAFERRGIRGLG

SEQ ID NO: 834560 - protein, 265 aa, Homo sapiens
MLSLIKKAGPPELFYDETEARKYVRNSRMIDIQTRMAGRALELLYLPENKPCYLLDIGCGTGLSGSYLSDEGHYWVGLDISPAMLDEAVDREIEGDLLLGDMGQGIPFKPGTFDGCISISAVQWLCNANKKSENPAKRLYCFFASLFSVLVRGSRAVLQLYPENSEQLELITTQATKAGFSGGMVVDYPNSAKAKKFYLCLFSGPSTFIPEGLSENQDEVEPRESVFTNERFPLRMSRRGMVRKSRAWVLGEEGAAQAPGQGSQT

SEQ ID NO: 834561 - protein, 220 aa, Homo sapiens; identical to SEQ ID NO: 834553

SEQ ID NO: 834562 - protein, 237 aa, Homo sapiens
MIDIQTRMAGRALELLYLPENKPCYLLDIGCGTGLSGSYLSDEGHYWVGLDISPAMLDEAVDREIEGDLLLGDMGQGIPFKPGTFDGCISISAVQWLCNANKKSENPAKRLYCFFASLFSVLVRGSRAVLQLYPENSEQLELITTQATKAGFSGGMVVDYPNSAKAKKFYLCLFSGPSTFIPEGLSENQDEVEPRESVFTNERFPLRMSRRGMVRKSRAWVLGEEGAAQAPGQGSQT

SEQ ID NO: 834563 - protein, 237 aa, Homo sapiens; identical to SEQ ID NO: 834562

SEQ ID NO: 834564 - protein, 274 aa, Homo sapiens
LRQVPGLGVRGRRRSMADPQSCFSDETEARKYFRNSRMIDIQTRMAGRALELLYLPENKPCYLLDIGCGTGLSGSYLSDEGHYWVGLDISPAMLDEAVDREIEGDLLLGDMGQGIPFKPGTFDGCISISAVQWLCNANKKSENPAKRLYCFFASLFSVLVRGSRAVLQLYPENSEQLELITTQATKAGFSGGMVVDYPNSAKAKKFYLCLFSGPSTFIPEGLSENQDEVEPRESVFTNERFPLRMSRRGMVRKSRAWVLGEEGAAQAPGQGSQT

SEQ ID NO: 834565 - protein, 250 aa, Homo sapiens
MASRGRRPEHGGPPELFYDETEARKYVRNSRMIDIQTRMAGRALELLYLPENKPCYLLDIGCGTGLSGSYLSDEGHYWVGLDISPAMLDEAVDREIEGDLLLGDMGQGIPFKPGTFDGCISISAVQWLCNANKKSVRGSRAVLQLYPENSEQLELITTQATKAGFSGGMVVDYPNSAKAKKFYLCLFSGPSTFIPEGLSENQDEVEPRESVFTNERFPLRMSRRGMVRKSRAWVLGEEGAAQAPGQGSQT

SEQ ID NO: 834566 - protein, 240 aa, Homo sapiens
MASRGRRPEHGGPPELFYDETEARKYVRNSRMIDIQTRMAGRALELLYLPENKPCYLLDIGCGTGLSGSYLSDEGHYWVGLDISPAMLDEAVDREIEGDLLLGDMGQGIPFKPGTFDGCISISAVQWLCNANKKSENPAKRLYCFFASLFSVLVRGSRAVLQLYPENSEQVPIKDVEAGNGEEESGMGAGRRRSGTGARAGKSDLTPSTPAASASPASKSPRGSGKALASALFYIVQLTK

SEQ ID NO: 834567 - protein, 131 aa, Homo sapiens
MKGTIGWAWISALPCWVRGSRAVLQLYPENSEQLELITTQATKAGFSGGMVVDYPNSAKAKKFYLCLFSGPSTFIPEGLSENQDEVEPRESVFTNERFPLRMSRRGMVRKSRAWVLGEEGAAQAPGQGSQT

SEQ ID NO: 834568 - protein, 76 aa, Homo sapiens
FALSPFKFYLCLFSGPSTFIPEGLSENQDEVEPRESVFTNERFPLRMSRRGMVRKSRAWVLGEEGAAQAPGQGSQT

SEQ ID NO: 834569 - protein, 140 aa, Homo sapiens
MASRGRRPEHGGPPELFYDETEARKYVRNSRMIDIQTRMAGRALELLYLPENKPCYLLDIGCGTGLSGSYLSDEGHYWVGLDISPAMLAFLLCSGSVMLTRSLKTLPSACTAFLLLFFLFSSGDPELSCSCTLRTQSSWS

SEQ ID NO: 834570 - protein, 268 aa, Homo sapiens; identical to SEQ ID NO: 834552

SEQ ID NO: 834571 - protein, 284 aa, Homo sapiens
IKAGTRPGRARPASEHGGPPELFYDETEARKYVRNSRMIDIQTRMAGRALELLYLPENKPCYLLDIGCGTGLSGSYLSDEGHYWVGLDISPAMLDEAVDREIEGDLLLGDMGQGIPFKPGTFDGCISISAVQWLCNANKKSENPAKRLYCFFASLFSVLVRGSRAVLQLYPENSEQLELITTQATKAGFSGGMVVDYPNSAKAKKFYLCLFSGPSTFIPEGLSENQDEVEPRESVFTNERFPLRMSRRGMVRKSRAWVLGEEGAAQAPGQGSQTETSKRAEGKP

SEQ ID NO: 834572 - protein, 192 aa, Homo sapiens
MADPQSCSRMIDIQTRMAGRALELLYLPENKPCYLLDIGCGTGLSGSYLSDEGHYWVGLDISPAMLDEAVDREIEGDLLLGDMGQGIPFKPGTFDGCISISAVQWLCNANKKSENPAKRLYCFFASLFSVLVRGSRAVLQLYPENSEQLELITTQATKAGFSGGMVVDYPNSAKAKKSTSACFWAFAFIPEG

SEQ ID NO: 834573 - protein, 251 aa, Homo sapiens
MASRGRRPEHGGPPELFYDETEARKYVRNSRMIDIQTRMAGRALELLYLPENKPCYLLDIGCGTGLSGSYLSDEGHYWVGLDISPAMLDEAVDREIEGDLLLGDMGQGIPFKPGTFDGCISISAVQWLCNANKKSENPAKRLYCFFASLFSVLVRGSRAVLQLYPENSEQLELITTQATKAGFSGGMVVDYPNSAKAKKFYLCLFSGPSTFIPEGLSENQDEVEPRESVFTNEREGGAFERRGIRGHQTRR

SEQ ID NO: 834574 - protein, 251 aa, Homo sapiens; identical to SEQ ID NO: 834573

SEQ ID NO: 834575 - protein, 284 aa, Homo sapiens
MASRGRRPEHGGPPELFYDETEARKYVRNSRMIDIQTRMAGRALELLYLPENKPCYLLDIGCGTGLSGSYLSDEGHYWVGLDISPAMLDEAVDREIEGDLLLGDMGQGIPFKPGTFDGCISISAVQWLCNANKKSENPAKRLYCFFASLFSVLVRGSRAVLQLYPENSEQLELITTQATKAGFSGGMVVDYPNSAKAKKFYLCLFSGPSTFIPEVPIKDVEAGNGEEESGMGAGRRRSGTGARAGKSDLTPSTPAASASPASKSPRGSGKALASALFYIVQLTK

SEQ ID NO: 834576 - protein, 285 aa, Homo sapiens
RPTYRTLLQLTRIVPRPAGVHLHGAHDGGPPELFYDETEARKYVRNSRMIDIQTRMAGRALELLYLPENKPCYLLDIGCGTGLSGSYLSDEGHYWVGLDISPAMLDEAVDREIEGDLLLGDMGQGIPFKPGTFDGCISISAVQWLCNANKKSENPAKRLYCFFASLFSVLVRGSRAVLQLYPENSEQLELITTQATKAGFSGGMVVDYPNSAKAKKFYLCLFSGPSTFIPEGLSENQDEVEPRESVFTNERFPLRMSRRGMVRKSRAWVLGEEGAAQAPGQGSQT

SEQ ID NO: 834577 - protein, 291 aa, Homo sapiens
MADPQSCFMTRQKPGNTFASEGSLNTAGRPGVGKRQVAPVAGVARKGRRIWGSRMIDIQTRMAGRALELLYLPENKPCYLLDIGCGTGLSGSYLSDEGHYWVGLDISPAMLDEAVDREIEGDLLLGDMGQGIPFKPGTFDGCISISAVQWLCNANKKSENPAKRLYCFFASLFSVLVRGSRAVLQLYPENSEQLELITTQATKAGFSGGMVVDYPNSAKAKKFYLCLFSGPSTFIPEGLSENQDEVEPRESVFTNERFPLRMSRRGMVRKSRAWVLGEEGAAQAPGQGSQT

SEQ ID NO: 834578 - protein, 274 aa, Homo sapiens
MADPQSCFMTRQKPGNTFASEGSLNTAGRPGVGKRSRMIDIQTRMAGRALELLYLPENKPCYLLDIGCGTGLSGSYLSDEGHYWVGLDISPAMLDEAVDREIEGDLLLGDMGQGIPFKPGTFDGCISISAVQWLCNANKKSENPAKRLYCFFASLFSVLVRGSRAVLQLYPENSEQLELITTQATKAGFSGGMVVDYPNSAKAKKFYLCLFSGPSTFIPEGLSENQDEVEPRESVFTNERFPLRMSRRGMVRKSRAWVLGEEGAAQAPGQGSQT

SEQ ID NO: 834579 - protein, 321 aa, Homo sapiens
LRQVPGLGVRGRRRSMADPQSCFMTRQKPGNTFASEGSLNTAGRPGVGKRQVAPVAGVARKGRRIWGCGKGRTRVGADFCLCSRMIDIQTRMAGRALELLYLPENKPCYLLDIGCGTGLSGSYLSDEGHYWVGLDISPAMLDEAVDREIEGDLLLGDMGQGIPFKPGTFDGCISISAVQWLCNANKKSENPAKRLYCFFASLFSVLVRGSRAVLQLYPENSEQLELITTQATKAGFSGGMVVDYPNSAKAKKFYLCLFSGPSTFIPEGLSENQDEVEPRESVFTNERFPLRMSRRGMVRKSRAWVLGEEGAAQAPGQGSQT

SEQ ID NO: 834580 - protein, 140 aa, Homo sapiens
MASRGRRPEHGGPPELFYDETEARKYVRNSRMIDIQTRMAGRALELLYLPENKPCYLLDIGCGTGLSGSYLSDEGHYWVGLDISPAMLDEAVDREIEGDLLLGDMGQGIPFKPGTFDGCIRSGDPELSCSCTLRTQSSWS

SEQ ID NO: 834581 - protein, 292 aa, Homo sapiens
MADPQSCFSDETEARKYFRNSRMIDIQTRMAGRALELLYLPENKPCYLLDIGLCVTVAEWNVIWSEGMRHILGWSHAIIDASWRIRLGLGTGENAEDMSQKAAARCHLRRSVVDRVVTHLQSRVTTSYGCVCHRAILVLMLSGHLVIDKHRKVLNDLVPTSAVYVLFSELTLVSLVLVRGSRAVLQLYPENSEQLELITTQATKAGFSGGMVVDYPNSAKAKKFYLCLFSGPSTFIPEGLSENQDEVEPRESVFTNERFPLRMSRRGMVRKSRAWVLGEEGAAQAPGQGSQT

SEQ ID NO: 834582 - protein, 87 aa, Homo sapiens
NPHPNRVTLTVNRAKAKKFYLCLFSGPSTFIPEGLSENQDEVEPRESVFTNERFPLRMSRRGMVRKSRAWVLGEEGAAQAPGQGSQT

SEQ ID NO: 834583 - protein, 72 aa, Homo sapiens
LLCRSQKGVSVPSRGTGPRPCRKGQAWVPGLLEWGRWFENSPGDLSALWFLQGLSENQDEVEPRESVFTNER

SEQ ID NO: 834584 - protein, 336 aa, Homo sapiens
VSHQGRQRQLHSASTQIRWEPSPAMASLGQILFWSIISIIIILAGAIALIIGFGISEVSVWLSAMKGLVVEVPRLPLALIFASCTAGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 834585 - protein, 306 aa, Homo sapiens
VSHQGRQRQLHSASTQIRWEPSPAMASLGQILFWSIISIIIILAGAIALIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 834586 - protein, 336 aa, Homo sapiens; identical to SEQ ID NO: 834584

SEQ ID NO: 834587 - protein, 415 aa, Homo sapiens
MTGERPSTALPDRRWGPRILGFWGGCRVWVFAAIFLLLSLAASWSKAENDFGLVQPLVTMEQLLWVSGRQIGSVDTFRIPLITATPRGTLLAFAEARKMSSSDEGAKFIALRRSMDQGSTWSPTAFIVNDGDVPDGLNLGAVVSDVETGVVFLFYSLCAHKAGCQVASTMLVWSKDDGVSWSTPRNLSLDIGTEVFAPGPGSGIQKQREPRKGRLIVCGHGTLERDGVFCLLSDDHGASWRYGSGVSGIPYGQPKQENDFNPDECQPYELPDGSVVINARNQNNYHCHCRIVLRSYDACDTLRPRDVTFDPELVDPVVAAGAVVTSSGIVFFSNPAHPEFRVNLTLRWSFSNGTSWRKETVQLWPGPSGYSSLATLEGSMDGEEQAPQLYVLYEKGRNHYTESISVAKISVYGTL

SEQ ID NO: 834588 - protein, 302 aa, Homo sapiens
MTGERPSTALPDRRWGPRILGFWGGCRVWVFAAIFLLLSLAASWSKAENDFGLVQPLVTMEQLLWVSGRQIGSVDTFRIPLITATPRGTLLAFAEARKMSSSDEGAKFIALRRSMDQGSTWSPTAFIVNDGDVPDGLNLGAVVSDVETGVVFLFYSLCAHKAGCQVASTMLVWSKDDGVSWSTPRNLSLDIGTEVFAPGPGSGIQKQREPRKGRLIVCGHGTLERDGVFCLLSDDHGASWRYGSGVSGIPYGQPKQENDFNPDECQRQPEKSVVKIQRPLPCRLSPRYEVKTKKQNMPSDLS

SEQ ID NO: 834589 - protein, 474 aa, Homo sapiens
MTGERPSTALPDRRWGPRILGFWGGCRVWVFAAIFLLLSLAASWSKAENDFGLVQPLVTMEQLLWVSGRQIGSVDTFRIPLITATPRGTLLAFAEARKMSSSDEGAKFIALRRSMDQGSTWSPTAFIVNDGDVPDGLNLGAVVSDVETGVVFLFYSLCAHKAGCQVASTMLVWSKDDGVSWSTPRNLSLDIGTEVFAPGPGSGIQKQREPRKGRLIVCGHGTLERDGVFCLLSDDHGASWRYGSGVSGIPYGQPKQENDFNPDECQGQEIHEMFPTHLTLPALQNIISRTDPGSDCSTQCHTPLLPSGTGHFPCSLPGGPVLSPQPYELPDGSVVINARNQNNYHCHCRIVLRSYDACDTLRPRDVTFDPELVDPVVAAGAVVTSSGIVFFSNPAHPEFRVNLTLRWSFSNGTSWRKETVQLWPGPSGYSSLATLEGSMDGEEQAPQLYVLYEKGRNHYTESISVAKISVYGTL

SEQ ID NO: 834590 - protein, 438 aa, Homo sapiens
ALCRRRLSVLFVTWAGVVYILCDWPVVHTSTALPDRRWGPRILGFWGGCRVWVFAAIFLLLSLAASWSKAENDFGLVQPLVTMEQLLWVSGRQIGSVDTFRIPLITATPRGTLLAFAEARKMSSSDEGAKFIALRRSMDQGSTWSPTAFIVNDGDVPDGLNLGAVVSDVETGVVFLFYSLCAHKAGCQVASTMLVWSKDDGVSWSTPRNLSLDIGTEVFAPGPGSGIQKQREPRKGRLIVCGHGTLERDGVFCLLSDDHGASWRYGSGVSGIPYGQPKQENDFNPDECQPYELPDGSVVINARNQNNYHCHCRIVLRSYDACDTLRPRDVTFDPELVDPVVAAGAVVTSSGIVFFSNPAHPEFRVNLTLRWSFSNGTSWRKETVQLWPGPSGYSSLATLEGSMDGEEQAPQLYVLYEKGRNHYTESISVAKISVYGTL

SEQ ID NO: 834591 - protein, 317 aa, Homo sapiens [sequence omitted]

SEQ ID NO: 834592 - protein, 415 aa, Homo sapiens; identical to SEQ ID NO: 834587

SEQ ID NO: 834593 - protein, 428 aa, Homo sapiens
MTGERPSTALPDRRWGPRILGFWGGCRVWVFAAIFLLLSLAASWSKAENDFGLVQPLVTMEQLLWVSGRQIGSVDTFRIPLITATPRGTLLAFAEARKMSSSDEGAKFIALRRSMDQGSTWSPTAFIVNDGDVPDGLNLGAVVSDVETGVVFLFYSLCAHKAGCQVASTMLVWSKDDGVSWSTPRNLSLDIGTEVFAPGPGSGIQKQREPRKGRLIVCGHGTLERDGVFCLLSDDHGASWRYGSGVSGIPYGQPKQENDFNPDECQPYELPDGSVVINARNQNNYHCHCRIVLRSYDACDTLRPRDVTFDPELVDPVVAAGAVVTSSGIVFFSNPAHPEFPWRAAWMERSRPPSSTSCMRKAGTTTQRASPWPKSVSMGHSELCHCHRGILPSGLCLQEHGSVEGLLETPERQFHLPLDSSLGYLVSE

SEQ ID NO: 834594 - protein, 308 aa, Homo sapiens
MTGERPSTALPDRRWGPRILGFWGGCRVWVFAAIFLLLSLAASWSKAENDFGLVQPLVTMEQLLWVSGRQIGSVDTFRIPLITATPRGTLLAFAEARKMSSSDEGAKFIALRRSMDQGSTWSPTAFIVNDGDVPDGLNLGAVVSDVETGVVFLFYSLCAHKAGCQVASTMLVWSKDDGVSWSTPRNLSLDIGTEVFAPGPGSGIQKQREPRKGRLIVCGHGTLERDGVFCLLSDDHGASWRYGSGVSGIPYGQPKQENDFNPDECQPYELPDGSVVINGKITFPLPGKSLPLGLKARRPLPQKSPALI

SEQ ID NO: 834595 - protein, 422 aa, Homo sapiens
MTGERPSTALPDRRWGPRILGFWGGCRVWVFAAIFLLLSLAASWSKAENDFGLVQPLVTMEQLLWVSGRQIGSVDTFRIPLITATPRGTLLAFAEARKMSSSDEGAKFIALRRSMDQGSTWSPTAFIVNDGDVPDGLNLGAVVSDVETGVVFLFYSLCAHKAGCQVASTMLVWSKDDGVSWSTPRNLSLDIGTEVFAPGPGSGIQKQREPRKGRLIVCGHGTLERDGVFCLLSDDHGASWRYGSGVSGIPYGQPKQENDFNPDECQGQEIHEMFPTHLTLPALQNIISRTDPGSDCSTQCHTPLLPSGTGHFPCSLPGGPVLSPQPYELPDGSVVINARNQNNYHCHCRIVLRSYDACDTLRPRDVTFDPELVDPVVAAGAVVTSSGIVFFSNPAHPEFRVNLTLRWSFSNGTSWRKETVQL

SEQ ID NO: 834596 - protein, 62 aa, Homo sapiens
SSGIVFFSNPAHPEFRECLMGGVSRESPVSRQGLGRDPLSLTLLLSPGVNLTLRWSFSNGTS

SEQ ID NO: 834597 - protein, 415 aa, Homo sapiens; identical to SEQ ID NO: 834587

SEQ ID NO: 834598 - protein, 415 aa, Homo sapiens; identical to SEQ ID NO: 834587

SEQ ID NO: 834599 - protein, 432 aa, Homo sapiens
MTGERPSTALPDRRWGPRILGFWGGCRVWVFAAIFLLLSLAASWSKAENDFGLVQPLVTMEQLLWVSGRQIGSVDTFRIPLITATPRGTLLAFAEARKMSSSDEGAKFIALRRSMDQGSTWSPTAFIVNDGDVPDGLNLGAVVSDVETGVVFLFYSLCAHKAGCQVASTMLVWSKDDGVSWSTPRNLSLDIGTEVFAPGPGSGIQKQREPRKGRLIVCGHGTLERDGVFCLLSDDHGASWRYGSGVSGIPYGQPKQENDFNPDECQPYELPDGSVVINARNQNNYHCHCRIVLRSYDACDTLRPRDVTFDPELVDPVVAAGAVVTSSGIVFFSNPAHPEFQADPEPCLMRRIHANWLSVYAPSNAEHALSLMAHGPQSVRTVISLCGKPVWRSSSSACEEEQAPQLYVLYEKGRNHYTESISVAKISVYGTL

SEQ ID NO: 834600 - protein, 321 aa, Homo sapiens
SLQDLHWIVDEGPSSSPCGGHGPGSTWSPTAFIVNDGDVPDGLNLGAVVSDVETGVVFLFYSLCAHKAGCQVASTMLVWSKDDGVSWSTPRNLSLDIGTEVFAPGPGSGIQKQREPRKGRLIVCGHGTLERDGVFCLLSDDHGASWRYGSGVSGIPYGQPKQENDFNPDECQPYELPDGSVVINARNQNNYHCHCRIVLRSYDACDTLRPRDVTFDPELVDPVVAAGAVVTSSGIVFFSNPAHPEFRVNLTLRWSFSNGTSWRKETVQLWPGPSGYSSLATLEGSMDGEEQAPQLYVLYEKGRNHYTESISVAKISVYGTL

SEQ ID NO: 834601 - protein, 363 aa, Homo sapiens
MTGERPSTALPDRRWGPRILGFWGGCRVWVFAAIFLLLSLAASWSKAENDFGLVQPLVTMEQLLWVSGRQIGSVDTFRIPLITATPRGTLLAFAEARKMSSSDEGAKFIALRRSMDQGSTWSPTAFIVNDGDVPDGLNLGAVVSDVETGVVFLFYSLCAHKAGCQVASTMLVWSKDDGVSWSTPRNLSLDIGTEVFAPGPGSGIQKQREPRKGRLIVCGHGTLERDGVFCLLSDDHGASWRYGSGVSGIPYGQPKQENDFNPDECQPYELPDGSVVINARNQNNYHCHCRIVLRSYDACDTLRPRDVTFDPELVDPVVAAGAVVTSSGIVFFSNPAHPEFRVNLTLRWSFSNGTSWRKETVQL

SEQ ID NO: 834602 - protein, 70 aa, Homo sapiens
EGGLATLSNMGRQYSQMRWPGPSGYSSLATLEGSMDGEEQAPQLYVLYEKGRNHYTESISVAKISVYGTL

SEQ ID NO: 834603 - protein, 294 aa, Homo sapiens
MTGERPSTALPDRRWGPRILGFWGGCRVWVFAAIFLLLSLAASWSKAENDFGLVQPLVTMEQLLWVSGRQIGSVDTFRIPLITATPRGTLLAFAEARKMSSSDEGAKFIALRRSMDQGSTWSPTAFIVNDGDVPDGLNLGAVVSDVETGVVFLFYSLCAHKAGCQVASTMLVWSKDDGVSWSTPRNLSLDIGTEVFAPGPGSGIQKQREPRKGRLIVCGHGTLERDGVFCLLSDDHGASWRYGSGVSGIPYGQPKQENDFNPDECQAEPPLWCCGKITDRAGESPQMAGYLVSE

SEQ ID NO: 834604 - protein, 751 aa, Homo sapiens
MAFRTICVLVGVFICSICVKGSSQPQARVYLTFDELRETKTSEYFSLSHHPLDYRILLMDEDQDRIYVGSKDHILSLNINNISQEALSVFWPASTIKVEECKMAGKDPTHGCGNFVRVIQTFNRTHLYVCGSGAFSPVCTYLNRGRRSEDQVFMIDSKCESGKGRCSFNPNVNTVSVMINEELFSGMYIDFMGTDAAIFRSLTKRNAVRTDQHNSKWLSEPMFVDAHVIPDGTDPNDAKVYFFFKEKLTDNNRSTKQIHSMIARICPNDTGGLRSLVNKWTTFLKARLVCSVTDEDGPETHFDELEDVFLLETDNPRTTLVYGIFTTSSSVFKGSAVCVYHLSDIQTVFNGPFAHKEGPNHQLISYQGRIPYPRPGTCPGGAFTPNMRTTKEFPDDVVTFIRNHPLMYNSIYPIHKRPLIVRIGTDYKYTKIAVDRVNAADGRYHVLFLGTDRGTVQKVVVLPTNNSVSGELILEELEVFKNHAPITTMKISSKKQQLYVSSNEGVSQVSLHRCHIYGTACADCCLARDPYCAWDGHSCSRFYPTGKRRSRRQDVRHGNPLTQCRGFNLKAYRNAAEIVQYGVKNNTTFLECAPKSPQASIKWLLQKDKDRRKEVKLNERIIATSQGLLIRSVQGSDQGLYHCIATENSFKQTIAKINFKVLDSEMVAVVTDKWSPWTWASSVRALPFHPKDIMGAFSHSEMQMINQYCKDTRQQHQQGDESQKMRGDYGKLKALINSRKSRNRRNQLPES

SEQ ID NO: 834605 - protein, 751 aa, Homo sapiens; identical to SEQ ID NO: 834604

SEQ ID NO: 834606 - protein, 751 aa, Homo sapiens; identical to SEQ ID NO: 834604

SEQ ID NO: 834607 - protein, 751 aa, Homo sapiens; identical to SEQ ID NO: 834604

SEQ ID NO: 834608 - protein, 152 aa, Homo sapiens
MAFRTICVLVGVFICSICVKGSSQPQARVYLTFDELRETKTSEYFSLSHHPLDYRILLMDEDQDRIYVGSKDHILSLNINNISQEALSVFWPASTIKVEECKMAGKDPTHGCGNFVRVIQTFNRTHLYVCGSGAFSPVCTYLNRGRRSEGNI

SEQ ID NO: 834609 - protein, 693 aa, Homo sapiens
MDEDQDRIYVGSKDHILSLNINNISQEALSVFWPASTIKVEECKMAGKDPTHGCGNFVRVIQTFNRTHLYVCGSGAFSPVCTYLNRGRRSEDQVFMIDSKCESGKGRCSFNPNVNTVSVMINEELFSGMYIDFMGTDAAIFRSLTKRNAVRTDQHNSKWLSEPMFVDAHVIPDGTDPNDAKVYFFFKEKLTDNNRSTKQIHSMIARICPNDTGGLRSLVNKWTTFLKARLVCSVTDEDGPETHFDELEDVFLLETDNPRTTLVYGIFTTSSSVFKGSAVCVYHLSDIQTVFNGPFAHKEGPNHQLISYQGRIPYPRPGTCPGGAFTPNMRTTKEFPDDVVTFIRNHPLMYNSIYPIHKRPLIVRIGTDYKYTKIAVDRVNAADGRYHVLFLGTDRGTVQKVVVLPTNNSVSGELILEELEVFKNHAPITTMKISSKKQQLYVSSNEGVSQVSLHRCHIYGTACADCCLARDPYCAWDGHSCSRFYPTGKRRSRRQDVRHGNPLTQCRGFNLKAYRNAAEIVQYGVKNNTTFLECAPKSPQASIKWLLQKDKDRRKEVKLNERIIATSQGLLIRSVQGSDQGLYHCIATENSFKQTIAKINFKVLDSEMVAVVTDKWSPWTWASSVRALPFHPKDIMGAFSHSEMQMINQYCKDTRQQHQQGDESQKMRGDYGKLKALINSRKSRNRRNQLPES

SEQ ID NO: 834610 - protein, 152 aa, Homo sapiens
KSVGRSLPIVSLYFSCPGGAFTPNMRTTKEFPDDVVTFIRNHPLMYNSIYPIHKRPLIVRIGTDYKYTKIAVDRVNAADGRYHVLFLGTDRGTVQKVVVLPTNNSVSGELILEELEVFKNHAPITTMKISSKKEEPKTRCETWKPTDSMQRI

SEQ ID NO: 834611 - protein, 751 aa, Homo sapiens; identical to SEQ ID NO: 834604

SEQ ID NO: 834612 - protein, 397 aa, Homo sapiens
MDSLATSINQFALELSKKLAESAQGKNIFFSSWSISTSLTIVYLGAKGTTAAQMAQVLQFNRDQGVKCDPESEKKRKMEFNLSNSEEIHSDFQTLISEILKPNDDYLLKTANAIYGEKTYAFHNKYLEDMKTYFGAEPQPVNFVEASDQIRKDINSWVERQTEGKIQNLLPDDSVDSTTRMILVNALYFKGIWEHQFLVQNTTEKPFRINETTSKPVQMMFMKKKLHIFHIEKPKAVGLQLYYKSRDLSLLILLPEDINGLEQLEKAITYEKLNEWTSADMMELYEVQLHLPKFKLEDSYDLKSTLSSMGMSDAFSQSKADFSGMSSARNLFLSNVFHKAFVEINEQGTEAAAGSGSEIDIRIRVPSIEFNANHPFLFFIRHNKTNTILFYGRLCSP

SEQ ID NO: 834613 - protein, 81 aa, Homo sapiens
MLRQIIGQAKKHPSLIPLFVFIGTGATGATLYLLRLALFNPDVCWDRNNPEPWNKLGPNDQYKFYSVNVDYSKLKKERPDF

SEQ ID NO: 834614 - protein, 81 aa, Homo sapiens; identical to SEQ ID NO: 834613

SEQ ID NO: 834615 - protein, 81 aa, Homo sapiens; identical to SEQ ID NO: 834613

SEQ ID NO: 834616 - protein, 132 aa, Homo sapiens
TWDVRTCLIANKVHRLRAWGIRWRDGSPGSESLEPSGRKTIAAATIMVAGHRRIVPYACESLHLVVISWEECSVHGRNYMYLLGSALFRIRDGFVWDRNNPEPWNKLGPNDQYKFYSVNVDYSKLKKERPDF

SEQ ID NO: 834617 - protein, 81 aa, Homo sapiens; identical to SEQ ID NO: 834613

SEQ ID NO: 834618 - protein, 81 aa, Homo sapiens; identical to SEQ ID NO: 834613

SEQ ID NO: 834619 - protein, 81 aa, Homo sapiens; identical to SEQ ID NO: 834613

SEQ ID NO: 834620 - protein, 81 aa, Homo sapiens; identical to SEQ ID NO: 834613

SEQ ID NO: 834621 - protein, 81 aa, Homo sapiens; identical to SEQ ID NO: 834613

SEQ ID NO: 834622 - protein, 68 aa, Homo sapiens
GESDMKIIRVLWWYYFSKLIEFMDTFFFILRKNNHQITVLHVYHHASMLNIWWFVINWVPMINTSSTQ

SEQ ID NO: 834623 - protein, 81 aa, Homo sapiens; identical to SEQ ID NO: 834613

SEQ ID NO: 834624 - protein, 81 aa, Homo sapiens; identical to SEQ ID NO: 834613

SEQ ID NO: 834625 - protein, 81 aa, Homo sapiens; identical to SEQ ID NO: 834613

SEQ ID NO: 834626 - protein, 81 aa, Homo sapiens; identical to SEQ ID NO: 834613

SEQ ID NO: 834627 - protein, 81 aa, Homo sapiens; identical to SEQ ID NO: 834613

SEQ ID NO: 834628 - protein, 81 aa, Homo sapiens; identical to SEQ ID NO: 834613

SEQ ID NO: 834629 - protein, 160 aa, Homo sapiens
FVFKVDSYYVAPVGVQWLFTGTIVAPYSLELLGSSDPPALASGVAGTTDIHRHAWPNFRNSFHLSSIPHTTFFLLLYTLLPKKILKRKKEKENMETSDKKYKFNLATISFLVVCCLTVLAILLITRKQRHEEKYLLFPSNKIVWTMPWEKHSGCYSSPKQ

SEQ ID NO: 834630 - protein, 1798 aa, Homo sapiens [sequence omitted]

SEQ ID NO: 834631 - protein, 850 aa, Homo sapiens
FIWDLELVTVPLLPRGLLGLLWGDGRGVLKIMFLKKSTLIFANLYPFRGAEVNQHMFSPTSAPALFLTKVPFSADCALATSPLAIFLNPRAHSSPGTPCSSRPLPWSCRTSNRKSLIVTSSTSPTLPRPHSPLHGHTGNSPLDSPRNFSPNAPAHFSFVPARRTDGRRWSLASLPSSGYGTNTPSSTVSSSCSSQEKLHQLPFQPTADELHFLTKHFSTESVPDEEGRQSPAMRPRSRSLSPGRSPVSFDSEIIMMNHVYKERFPKATAQMEERLAEFISSNTPDSVLPLADGALSFIHHQVIEMARDCLDKSRSGLITSQYFYELQENLEKLLQDAHERSESSEVAFVMQLVKKLMIIIARPARLLECLEFDPEEFYHLLEAAEGHAKEGQGIKCDIPRYIVSQLGLTRDPLEEMAQLSSCDSPDTPETDDSIEGHGASLPSKKTPSEEDFETIKLISNGAYGAVFLVRHKSTRQRFAMKKINKQNLILRNQIQQAFVERDILTFAENPFVVSMFCSFDTKRHLCMVMEYVEGGDCATLLKNIGALPVDMVRLYFAETVLALEYLHNYGIVHRDLKPDNLLITSMGHIKLTDFGLSKMGLMSLTTNLYEGHIEKDAREFLDKQVCGTPEYIAPEVILRQGYGKPVDWWAMGIILYEFLVGCVPFFGDTPEELFGQVISDEIVWPEGDEALPPDAQDLTSKLLHQNPLERLGTGSAYEVKQHPFFTGLDWTGLLRQKAEFIPQLESEDDTSYFDTRSERYHHMDSEDEEEVSEDGCLEIRQFSSCSPRFNKVYSSMERLSLLEERRTPPPTKRSLSEEKEDHSDGLAGLKGRDRSWVIGSPEIPEHHPSA

SEQ ID NO: 834632 - protein, 1993 aa, Homo sapiens
MKRSRCRDRPQPPPPDRREDGVQRAAELSQSLPPRRRAPPGRQRLEERTGPAGPEGKEQDVVTGVSPLLFRKLSNPDIFSSTGKVKLQRQLSQDDCKLWRGNLASSLSGKQLLPLSSSVHSSVGQVTWQSSGEASNLVRMRNQSLGQSAPSLTAGLKELSLPRRGSFCRTSNRKSLIVTSSTSPTLPRPHSPLHGHTGNSPLDSPRNFSPNAPAHFSFVPARRTDGRRWSLASLPSSGYGTNTPSSTVSSSCSSQEKLHQLPFQPTADELHFLTKHFSTESVPDEEGRQSPAMRPRSRSLSPGRSPVSFDSEIIMMNHVYKERFPKAHERSESSEVAFVMQLVKKLMIIIARPARLLECLEFDPEEFYHLLEAAEGHAKEGQGIKCDIPRYIVSQLGLTRDPLEEMAQLSSCDSPDTPETDDSIEGHGASLPSKKTPSEEDFETIKLISNGAYGAVFLVRHKSTRQRFAMKKINKQNLILRNQIQQAFVERDILTFAENPFVVSMFCSFDTKRHLCMVMEYVEGGDCATLLKNIGALPVDMVRLYFAETVLALEYLHNYGIVHRDLKPDNLLITSMGHIKLTDFGLSKMGLMSLTTNLYEGHIEKDAREFLDKQVCGTPEYIAPEVILRQGYGKPVDWWAMGIILYEFLVGCVPFFGDTPEELFGQVISGRYYAPGPVGKQSLNHKYDVCRQLVRPVSSCSELIMCVCDVCCFGDGCLCVSACTYMCTLCPLGLHMSLIDTWSLIYTWVFLSVYVHIPKCEGYVCVCFVEYKSRVSQSFAVPAVDQRSSYGLGTYENLRTGVPGKAFRGSRLGPFCLLSFHCSGTLFCISPLYPQFLLSLSPLMTSDEIVWPEGDEALPPDAQDLTSKLLHQNPLERLGTGRAGPANFSHYLEKGEGRLSHVPWRFRLRLRAAPLDPETLPCSVGRKGKMLELIPRYSFLKVWLLARFADLDSMLLILPPVPMSSLSTGSAYEVKQHPFFTGLDWTGLLRQKAEFIPQLESEDDTSYFDTRSERYHHMDSEDEEEVSEDGCLEIRQFSSCSPRFNKVYSSMERLSLLEERRTPPPTKRSLSEEKEDHSDGLAGLKGRDRSWVIGSPEILRKRLSVSESSHTESDSSPPMTVRRRCSGLLDAPRFPEGPEEASSTLRRQPQEGIWVLTPPSGEGVSGPVTEHSGEQRPKLDEEAVGRSSGSSPAMETRGRGTSQLAEGATAKAISDLAVRRARHRLLSGDSTEKRTARPVNKVIKSASATALSLLIPSEHHTCSPLASPMSPHSQSSNPSSRDSSPSRDFLPALGSMRPPIIIHRAGKKYGFTLRAIRVYMGDSDVYTVHHMVWHVEDGGPASEAGLRQGDLITHVNGEPVHGLVHTEVVELILKSGNKVAISTTPLENTSIKVGPARKGSYKAKMARRSKRSRGKDGQESRKRSSLFRKITKQASLLHTSRSLSSLNRSLSSGESGPGSPTHSHSLSPRSPTQGYRVTPDAVHSVGGNSSQSSSPSSSVPSSPAGSGHTRPSSLHGLAPKLQRQYRSPRRKSAGSIPLSPLAHTPSPPPPTASPQRSPSPLSGHVAQAFPTKLHLSPPLGRQLSRPKSAEPPRSPLLKRVQSAEKLAAALAASEKKLATSRKHSLDLPHSELKKELPPREVSPLEVVGARSVLSGKGALPGKGVLQPAPSRALGTLRQDRAERRESLQKQEAIREVDSSEDDTEEGPENSQGAQELSLAPHPEVSQSVAPKGAGESGEEDPFPSRDPRSLGPMVPSLLTGITLGPPRMESPSGPHRRLGSPQAIEEAASSSSAGPNLGQSGATDPIPPEGCWKAQHLHTQALTALSPSTSGLTPTSSCSPPSSTSGKLSMWSWKSLIEGPDRASPSRKATMAGGLANLQDLENTTPAQPKNLSPREQGKTQPPSAPRLAHPSYEDPSQGWLWESECAQAVKEDPALSITQVPDASGDRRQDVPCRGCPLTQKSEPSLRRGQEPGGHQKHRDLALVPDELLKQT

SEQ ID NO: 834633 - protein, 1069 aa, Homo sapiens
IHWWFHGRTHDEIVWPEGDEALPPDAQDLTSKLLHQNPLERLGTGSAYEVKQHPFFTGLDWTGLLRQKAEFIPQLESEDDTSYFDTRSERYHHMDSEDEEEVSEDGCLEIRQFSSCSPRFNKVYSSMERLSLLEERRTPPPTKRSLSEEKEDHSDGLAGLKGRDRSWVIGSPEILRKRLSVSESSHTESDSSPPMTVRRRCSGLLDAPRFPEGPEEASSTLRRQPQEGIWVLTPPSGEGVSGPVTEHSGEQRPKLDEEAVGRSSGSSPAMETRGRGTSQLAEGATAKAISDLAVRRARHRLLSGDSTEKRTARPVNKVIKSASATALSLLIPSEHHTCSPLASPMSPHSQSSNPSSRDSSPSRDFLPALGSMRPPIIIHRAGKKYGFTLRAIRVYMGDSDVYTVHHMVWHVEDGGPASEAGLRQGDLITHVNGEPVHGLVHTEVVELILKSGNKVAISTTPLENTSIKVGPARKGSYKAKMARRSKRSRGKDGQESRKRSSLFRKITKQASLLHTSRSLSSLNRSLSSGESGPGSPTHSHSLSPRSPTQGYRVTPDAVHSVGGNSSQSSSPSSSVPSSPAGSGHTRPSSLHGLAPKLQRQYRSPRRKSAGSIPLSPLAHTPSPPPPTASPQRSPSPLSGHVAQAFPTKLHLSPPLGRQLSRPKSAEPPRSPLLKRVQSAEKLAAALAASEKKLATSRKHSLDLPHSELKKELPPREVSPLEVVGARSVLSGKGALPGKGVLQPAPSRALGTLRQDRAERRESLQKQEAIREVDSSEDDTEEGPENSQGAQELSLAPHPEVSQSVAPKGAGESGEEDPFPSRDPRSLGPMVPSLLTGITLGPPRMESPSGPHRRLGSPQAIEEAASSSSAGPNLGQSGATDPIPPEGCWKAQHLHTQALTALSPSTSGLTPTSSCSPPSSTSGKLSMWSWKSLIEGPDRASPSRKATMAGGLANLQDLENTTPAQPKNLSPREQGKTQPPSAPRLAHPSYEDPSQGWLWESECAQAVKEDPALSITQVPDASGDRRQDVPCRGCPLTQKSEPSLRRGQEPGGHQKHRDLALVPDELLKQT

SEQ ID NO: 834634 - protein, 1154 aa, Homo sapiens
MKRSRCRDRPQPPPPDRREDGVQRAAELSQSLPPRRRAPPGRQRLEERTGPAGPEGKEQDVVTGVSPLLFRKLSNPDIFSSTGKVKLQRQLSQDDCKLWRGNLASSLSGKQLLPLSSSVHSSVGQVTWQSSGEASNLVRMRNQSLGQSAPSLTAGLKELSLPRRGSFCRTSNRKSLIVTSSTSPTLPRPHSPLHGHTGNSPLDSPRNFSPNAPAHFSFVPARRTDGRRWSLASLPSSGYGTNTPSSTVSSSCSSQEKLHQLPFQPTADELHFLTKHFSTESVPDEEGRQSPAMRPRSRSLSPGRSPVSFDSEIIMMNHVYKERFPKATAQMEERLAEFISSNTPDSVLPLADGALSFIHHQVIEMARDCLDKSRSGLITSQYFYELQENLEKLLQDAHERSESSEVAFVMQLVKKLMIIIARPARLLECLEFDPEEFYHLLEAAEGHAKEGQGIKCDIPRYIVSQLGLTRDPLEEMAQLSSCDSPDTPETDDSIEGHGASLPSKKTPSEEDFETIKLISNGAYGAVFLVRHKSTRQRFAMKKINKQNLILRNQIQQAFVERDILTFAENPFVVSMFCSFDTKRHLCMVMEYVEGGDCATLLKNIGALPVDMVRLYFAETVLALEYLHNYGIVHRDLKPDNLLITSMGHIKLTDFGLSKMGLMSLTTNLYEGHIEKDAREFLDKQVCGTPEYIAPEVILRQGYGKPVDWWAMGIILYEFLVGCVPFFGDTPEELFGQVISDEIVWPEGDEALPPDAQDLTSKLLHQNPLERLGTGSAYEVKQHPFFTGLDWTGLLRQKAEFIPQLESEDDTSYFDTRSERYHHMDSEDEEEVSEDGCLEIRQFSSCSPRFNKVYSSMERLSLLEERRTPPPTKRSLSEEKEDHSDGLAGLKGRDRSWVIGSPEILRKRLSVSESSHTESDSSPPMTVRRRCSGLLDAPRFPEGPEEASSTLRRQPQEGIWVLTPPSGEGVSGPVTEHSGEQRPKLDEEAVGRSSGSSPAMETRGRGTSQLAEGATAKAISDLAVRRARHRLLSGDSTEKRTARPVNKVIKSASATALSLLIPSEHHTCSPLASPMSPHSQSSNPSSRDSSPRSMASPCGPFASTWVTPMSTPCTIWCGTWRMEVRPVRQGFVKVTSSPMSMGNLCMAWCTRRWWS

SEQ ID NO: 834635 - protein, 843 aa, Homo sapiens
NGEPVHGLVHTEGVSGPVTEHSGEQRPKLDEEAVGRSSGSSPAMETRGRGTSQLAEGATAKAISDLAVRRARHRLLSGDSTEKRTARPVNKVIKSASATALSLLIPSEHHTCSPLASPMSPHSQSSNPSSRDSSPSRDFLPALGSMRPPIIIHRAGKKYGFTLRAIRVYMGDSDVYTVHHMVWHVEDGGPASEAGLRQGDLITHVNGEPVHGLVHTEVVELILKSGNKVAISTTPLENTSIKVGPARKGSYKAKMARRSKRSRGKDGQESRKRSSLFRKITKQASLLHTSRSLSSLNRSLSSGESGPGSPTHSHSLSPRSPTQGYRVTPDAVHSVGGNSSQSSSPSSSVPSSPAGSGHTRPSSLHGLAPKLQRQYRSPRRKSAGSIPLSPLAHTPSPPPPTASPQRSPSPLSGHVAQAFPTKLHLSPPLGRQLSRPKSAEPPRSPLLKRVQSAEKLAAALAASEKKLATSRKHSLDLPHSELKKELPPREVSPLEVVGARSVLSGKGALPGKGVLQPAPSRALGTLRQDRAERRESLQKQEAIREVDSSEDDTEEGPENSQGAQELSLAPHPEVSQSVAPKGAGESGEEDPFPSRDPRSLGPMVPSLLTGITLGPPRMESPSGPHRRLGSPQAIEEAASSSSAGPNLGQSGATDPIPPEGCWKAQHLHTQALTALSPSTSGLTPTSSCSPPSSTSGKLSMWSWKSLIEGPDRASPSRKATMAGGLANLQDLENTTPAQPKNLSPREQGKTQPPSAPRLAHPSYEDPSQGWLWESECAQAVKEDPALSITQVPDASGDRRQDVPCRGCPLTQKSEPSLRRGQEPGGHQKHRDLALVPDELLKQT

SEQ ID NO: 834636 - protein, 589 aa, Homo sapiens
MARRSKRSRGKDGQESRKRSSLFRKITKQASLLHTSRSLSSLNRSLSSGESGPGSPTHSHSLSPRSPTQGYRVTPDAVHSVGGNSSQSSSPSSSVPSSPAGSGHTRPSSLHGLAPKLQRQYRSPRRKSAGSIPLSPLAHTPSPPPPTASPQRSPSPLSGHVAQAFPTKLHLSPPLGRQLSRPKSAEPPRSPLLKRVQSAEKLAAALAASEKKLATSRKHSLDLPHSELKKELPPREVSPLEVVGARSVLSGKGALPGKGVLQPAPSRALGTLRQDRAERRESLQKQEAIREVDSSEDDTEEGPENSQGAQELSLAPHPEVSQSVAPKGAGESGEEDPFPSRDPRSLGPMVPSLLTGITLGPPRMESPSGPHRRLGSPQAIEEAASSSSAGPNLGQSGATDPIPPEGCWKAQHLHTQALTALSPSTSGLTPTSSCSPPSSTSGKLSMWSWKSLIEGPDRASPSRKATMAGGLANLQDLENTTPAQPKNLSPREQGKTQPPSAPRLAHPSYEDPSQGWLWESECAQAVKEDPALSITQVPDASGDRRQDVPCRGCPLTQKSEPSLRRGQEPGGHQKHRDLALVPDELLKQT

SEQ ID NO: 834637 - protein, 687 aa, Homo sapiens
MKRSRCRDRPQPPPPDRREDGVQRAAELSQSLPPRRRAPPGRQRLEERTGPAGPEGKEQDVVTGVSPLLFRKLSNPDIFSSTGKVKLQRQLSQDDCKLWRGNLASSLSGKQLLPLSSSVHSSVGQVTWQSSGEASNLVRMRNQSLGQSAPSLTAGLKELSLPRRGSFCRTSNRKSLIVTSSTSPTLPRPHSPLHGHTGNSPLDSPRNFSPNAPAHFSFVPARRTDGRRWSLASLPSSGYGTNTPSSTVSSSCSSQEKLHQLPFQPTADELHFLTKHFSTESVPDEEGRQSPAMRPRSRSLSPGRSPVSFDSEIIMMNHVYKERFPKAHERSESSEVAFVMQLVKKLMIIIARPARLLECLEFDPEEFYHLLEAAEGHAKEGQGIKCDIPRYIVSQLGLTRDPLEEMAQLSSCDSPDTPETDDSIEGHGASLPSKKTPSEEDFETIKLISNGAYGAVFLVRHKSTRQRFAMKKINKQNLILRNQIQQAFVERDILTFAENPFVVSMFCSFDTKRHLCMVMEYVEGGDCATLLKNIGALPVDMVRLYFAETVLALEYLHNYGIVHRDLKPDNLLITSMGHIKLTDFGLSKMGLMSLTTNLYEGHIEKDAREFLDKQVCGTPEYIAPEVILRQGYGKPVDWWAMGIILYEFLVGCVPFFGDTPEELFGQVISGRYYAPGPVGKQSLNPQI

SEQ ID NO: 834638 - protein, 104 aa, Homo sapiens
MGHLCHLKRHPLKRTSRPLSSSAMAPMGKGRGQGVARTEAGSAFDLFHVRVYAAQSSGQMPRGGPSHSQKPPGWAGVQIPLTSDHCSFPRQDSHASYYHASSIP

SEQ ID NO: 834639 - protein, 1798 aa, Homo sapiens [sequence omitted]

SEQ ID NO: 834640 - protein, 1888 aa, Homo sapiens
MKRSRCRDRPQPPPPDRREDGVQRAAELSQSLPPRRRAPPGRQRLEERTGPAGPEGKEQDVVTGVSPLLFRKLSNPDIFSSTGKVKLQRQLSQDDCKLWRGNLASSLSGKQLLPLSSSVHSSVGQVTWQSSGEASNLVRMRNQSLGQSAPSLTAGLKELSLPRRGSFCRTSNRKSLIVTSSTSPTLPRPHSPLHGHTGNSPLDSPRNFSPNAPAHFSFVPARRTDGRRWSLASLPSSGYGTNTPSSTVSSSCSSQEKLHQLPFQPTADELHFLTKHFSTESVPDEEGRQSPAMRPRSRSLSPGRSPVSFDSEIIMMNHVYKERFPKATAQMEERLAEFISSNTPDSVLPLADGALSFIHHQVIEMARDCLDKSRSGLITSQYFYELQENLEKLLQDAHERSESSEVAFVMQLVKKLMIIIARPARLLECLEFDPEEFYHLLEAAEGHAKEGQGIKCDIPRYIVSQLGLTRDPLEEMAQLSSCDSPDTPETDDSIEGHGASLPSKKTPSEEDFETIKLISNGAYGAVFLVRHKSTRQRFAMKKINKQNLILRNQIQQAFVERDILTFAENPFVVSMFCSFDTKRHLCMVMEYVEGGDCATLLKNIGALPVDMVRLYFAETVLALEYLHNYGIVHRDLKPDNLLITSMGHIKLTDFGLSKMGLMSLTTNLYEGHIEKDAREFLDKQVCGTPEYIAPEVILRQGYGKPVDWWAMGIILYEFLVGCVPFFGDTPEELFGQVISDEIVWPEGDEALPPDAQDLTSKLLHQNPLERLGTGSAYEVKQHPFFTGLDWTGLLRQKAEFIPQLESEDDTSYFDTRSERYHHMDSEDEEEVSEDGCLEIRQFSSCSPRFNKVYSSMERLSLLEERRTPPPTKRSLSEEKEDHSDGLAGLKGRDRSWVIGSPEILRKRLSVSESSHTESDSSPPMTVRRRCSGLLDAPRFPEGPEEASSTLRRQPQEGIWVLTPPSGEGVSGPVTEHSGEQRPKLDEEAVGRSSGSSPAMETRGRGTSQLAEGATAKAISDLAVRRARHRLLSGDSTEKRTARPVNKVIKSASATALSLLIPSEHHTCSPLASPMSPHSQSSNPSSRDSSPSRDFLPALGSMRPPIIIHRAGKKYGFTLRAIRVYMGDSDVYTVHHMVWHVEDGGPASEAGLRQGDLITHVNGEPVHGLVHTEVVELILKSGNKVAISTTPLENTSIKVGPARKGSYKAKMARRSKRSRGKDGQESRKRSSLFRKITKQASLLHTSRSLSSLNRSLSSGESGPGSPTHSHSLSPRSPTQGYRVTPDAVHSGTKGSLQISDNPWEIGKFLGPVLLLTDPTLSLSFSPPPERSCSLGEELIDGEGGAWFLGHNRAKPCLALESLLTANTALLLSVCLLSLYKVGGNSSQSSSPSSSVPSSPAGSGHTRPSSLHGLAPKLQRQYRSPRRKSAGSIPLSPLAHTPSPPPPTASPQRSPSPLSGHVAQAFPTKLHLSPPLGRQLSRPKSAEPPRSPLLKRVQSAEKLAAALAASEKKLATSRKHSLDLPHSELKKELPPREVSPLEVVGARSVLSGKGALPGKGVLQPAPSRALGTLRQDRAERRESLQKQEAIREVDSSEDDTEEGPENSQGAQELSLAPHPEVSQSVAPKGAGESGEEDPFPSRDPRSLGPMVPSLLTGITLGPPRMESPSGPHRRLGSPQAIEEAASSSSAGPNLGQSGATDPIPPEGCWKAQHLHTQALTALSPSTSGLTPTSSCSPPSSTSGKLSMWSWKSLIEGPDRASPSRKATMAGGLANLQDLENTTPAQPKNLSPREQGKTQPPSAPRLAHPSYEDPSQGWLWESECAQAVKEDPALSITQVPDASGDRRQDVPCRGCPLTQKSEPSLRRGQEPGGHQKHRDLALVPDELLKQT

SEQ ID NO: 834641 - protein, 1996 aa, Homo sapiens
MKRSRCRDRPQPPPPDRREDGVQRAAELSQSLPPRRRAPPGRQRLEERTGPAGPEGKEQDVVTGVSPLLFRKLSNPDIFSSTGKVKLQRQLSQDDCKLWRGNLASSLSGKQLLPLSSSVHSSVGQVTWQSSGEASNLVRMRNQSLGQSAPSLTAGLKELSLPRRGSFCRTSNRKSLIVTSSTSPTLPRPHSPLHGHTGNSPLDSPRNFSPNAPAHFSFVPARRTDGRRWSLASLPSSGYGTNTPSSTVSSSCSSQEKLHQLPFQPTADELHFLTKHFSTESVPDEEGRQSPAMRPRSRSLSPGRSPVSFDSEIIMMNHVYKERFPKATAQMEERLAEFISSNTPDSVLPLADGALSFIHHQVIEMARDCLDKSRSGLITSQYFYELQENLEKLLQDAHERSESSEVAFVMQLVKKLMIIIARPARLLECLEFDPEEFYHLLEAAEGHAKEGQGIKCDIPRYIVSQLGLTRDPLEEMAQLSSCDSPDTPETDDSIEGHGASLPSKKTPSEEDFETIKLISNGAYGAVFLVRHKSTRQRFAMKKINKQNLILRNQIQQAFVERDILTFAENPFVVSMFCSFDTKRHLCMVMEYVEGGDCATLLKNIGALPVDMVRLYFAETVLALEYLHNYGIVHRDLKPDNLLITSMGHIKLTDFGLSKMGLMSLTTNLYEGHIEKDAREFLDKQVCGTPEYIAPEVILRQGYGKPVDWWAMGIILYEFLVGCVPFFGDTPEELFGQVISDEIVWPEGDEALPPDAQDLTSKLLHQNPLERLGTGSAYEVKQHPFFTGLDWTGLLRQKAEFIPQLESEDDTSYFDTRSERYHHMDSEDEEEVSEDGCLEIRQFSSCSPRFNKVYSSMERLSLLEERRTPPPTKRSLSEEKEDHSDGLAGLKGRDRSWVIGSPEILRKRLSVSESSHTESDSSPPMTVRRRCSGLLDAPRFPEGPEEASSTLRRQPQEGIWVLTPPSGEGVSGPVTEHSGEQRPKLDEEAVGRSSGSSPAMETRGRGTSQLAEGATAKAISDLAVRRARHRLLSGDSTEKRTARPVNKVIKSASATALSLLIPSGEAPGELDKTHRKGLVISEALGGFCTWQVCVCVLSTDLTVVSEGVFGVWGCVYMCQKAGQHHVTSAGFGVESSHSNPGSITNRLLTLSKLLNFSKPKFLIQKCGYNRGQLIGCDISNIYDTAYIVPDTHINASCHFSSPPPSLGVWTRERASQVRGCGENGPEAQALSVTRVVLTSTDWTRGQAKALLTHYVLASPSPEHHTCSPLASPMSPHSQSSNPSSRDSSPSRDFLPALGSMRPPIIIHRAGKKYGFTLRAIRVYMGDSDVYTVHHMVWHVEDGGPASEAGLRQGDLITHVNGEPVHGLVHTEVVELILKSGNKVAISTTPLENTSIKVGPARKGSYKAKMARRSKRSRGKDGQESRKRSSLFRKITKQASLLHTSRSLSSLNRSLSSGESGPGSPTHSHSLSPRSPTQGYRVTPDAVHSVGGNSSQSSSPSSSVPSSPAGSGHTRPSSLHGLAPKLQRQYRSPRRKSAGSIPLSPLAHTPSPPPPTASPQRSPSPLSGHVAQAFPTKLHLSPPLGRQLSRPKSAEPPRSPLLKRVQSAEKLAAALAASEKKLATSRKHSLDLPHSELKKELPPREVSPLEVVGARSVLSGKGALPGKGVLQPAPSRALGTLRQDRAERRESLQKQEAIREVDSSEDDTEEGPENSQGAQELSLAPHPEVSQSVAPKGAGESGEEDPFPSRDPRSLGPMVPSLLTGITLGPPRMESPSGPHRRLGSPQAIEEAASSSSAGPNLGQSGATDPIPPEGCWKAQHLHTQALTALSPSTSGLTPTSSCSPPSSTSGKLSMWSWKSLIEGPDRASPSRKATMAGGLANLQDLENTTPAQPKNLSPREQGKTQPPSAPRLAHPSYEDPSQGWLWESECAQAVKEDPALSITQVPDASGDRRQDVPCRGCPLTQKSEPSLRRGQEPGGHQKHRDLALVPDELLKQT

SEQ ID NO: 834642 - protein, 1325 aa, Homo sapiens
MKRSRCRDRPQPPPPDRREDGVQRAAELSQSLPPRRRAPPGRQRLEERTGPAGPEGKEQDVVTGVSPLLFRKLSNPDIFSSTGKVKLQRQLSQDDCKLWRGNLASSLSGKQLLPLSSSVHSSVGQVTWQSSGEASNLVRMRNQSLGQSAPSLTAGLKELSLPRRGSFCRTSNRKSLIVTSSTSPTLPRPHSPLHGHTGNSPLDSPRNFSPNAPAHFSFVPARRTDGRRWSLASLPSSGYGTNTPSSTVSSSCSSQEKLHQLPFQPTADELHFLTKHFSTESVPDEEGRQSPAMRPRSRSLSPGRSPVSFDSEIIMMNHVYKERFPKATAQMEERLAEFISSNTPDSVLPLADGALSFIHHQVIEMARDCLDKSRSGLITSQYFYELQENLEKLLQDAHERSESSEVAFVMQLVKKLMIIIARPARLLECLEFDPEEFYHLLEAAEGHAKEGQGIKCDIPRYIVSQLGLTRDPLEEMAQLSSCDSPDTPETDDSIEGHGASLPSKKTPSEEDFETIKLISNGAYGAVFLVRHKSTRQRFAMKKINKQNLILRNQIQQAFVERDILTFAENPFVVSMFCSFDTKRHLCMVMEYVEGGDCATLLKNIGALPVDMVRLYFAETVLALEYLHNYGIVHRDLKPDNLLITSMGHIKLTDFGLSKMGLMSLTTNLYEGHIEKDAREFLDKQVCGTPEYIAPEVILRQGYGKPVDWWAMGIILYEFLVGCVPFFGDTPEELFGQVISDEIVWPEGDEALPPDAQDLTSKLLHQNPLERLGTGSAYEVKQHPFFTGLDWTGLLRQKAEFIPQLESEDDTSYFDTRSERYHHMDSEDEEEVSEDGCLEIRQFSSCSPRFNKVYSSMERLSLLEERRTPPPTKRSLSEEKEDHSDGLAGLKGRDRSWVIGSPEILRKRLSVSESSHTESDSSPPMTVRRRCSGLLDAPRFPEGPEEASSTLRRQPQEGIWVLTPPSGEGVSGPVTEHSGEQRPKLDEEAVGRSSGSSPAMETRGRGTSQLAEGATAKAISDLAVRRARHRLLSGDSTEKRTARPVNKVIKSASATALSLLIPSEHHTCSPLASPMSPHSQSSNPSSRDSSPSRDFLPALGSMRPPIIIHRAGKKYGFTLRAIRVYMGDSDVYTVHHMVWHVEDGGPASEAGLRQGDLITHVNGEPVHGLVHTEVVELILKSGNKVAISTTPLENTSIKVGPARKGSYKAKMARRSKRSRGKDGQESRKRSSLFRKITKQASLLHTSRSLSSLNRSLSSGESGPGSPTHSHSLSPRSPTQGYRVTPDAVHSGNSHGPRVRSHPVHHYSRGCSRLRNWQQHLPPLRRS

SEQ ID NO: 834643 - protein, 1798 aa, Homo sapiens [sequence omitted]

SEQ ID NO: 834644 - protein, 538 aa, Homo sapiens
MKRSRCRDRPQPPPPDRREDGVQRAAELSQSLPPRRRAPPGRQRLEERTGPAGPEGKEQDVVTGVSPLLFRKLSNPDIFSSTGKVKLQRQLSQDDCKLWRGNLASSLSGKQLLPLSSSVHSSVGQVTWQSSGEASNLVRMRNQSLGQSAPSLTAGLKELSLPRRGSFCRTSNRKSLIVTSSTSPTLPRPHSPLHGHTGNSPLDSPRNFSPNAPAHFSFVPARRTDGRRWSLASLPSSGYGTNTPSSTVSSSCSSQEKLHQLPFQPTADELHFLTKHFSTESVPDEEGRQSPAMRPRSRSLSPGRSPVSFDSEIIMMNHVYKERFPKAHERSESSEVAFVMQLVKKLMIIIARPARLLECLEFDPEEFYHLLEAAEGHAKEGQGIKCDIPRYIVSQLGLTRDPLEEMAQLSSCDSPDTPETDDSIEGHGASLPSKKTPSEEDFETIKLISNGAYGAVFLVRHKSTRQRFAMKKINKQNLILRNQIQQAFVERDILTFAENPFVVSMFCSFDTKRHLCMVMEYVEGTEAKVAWHGGQGTV

SEQ ID NO: 834645 - protein, 1527 aa, Homo sapiens
MPLANLSSFLPTFPGLQLHVQEASGNHLNPEPNQPAPSVDLDFLEDDILGSPATGGGGGGSGGADQPCDILQQSLQEANITEQTLEAEAELDLGPFQLPTLQPADGGAGPTGAGGAAAVAAGPQALFPGSTDLLGLQGPPTVLTHQALVPPQDVVNKALSVQPFLQPVGLGNVTLQPIPGLQGLPNGSPGGATAATLGLAPIQVVGQPVMALNTPTSQLLAKQVPVSGYLASAAGPSEPVTLASAGVSPQGAGLVIQKNLSAAVATTLNGNSVFGGAGAASAPTGTPSGQPLAVAPGLGSSPLVPAPNVILHRTPTPIQPKPAGVLPPKLYQLTPKPFAPAGATLTIQGEPGALPQQPKAPQNLTFMAAGKAGQNVVLSGFPAPALQANVFKQPPATTTGAAPPQPPGALSKPMSVHLLNQGSSIVIPAQHMLPGQNQFLLPGAPAVQLPQQLSALPANVGGQILAAAAPHTGGQLIANPILTNQNLAGPLSLGPVLAPHSGAHSAHILSAAPIQVGQPALFQMPVSLAAGSLPTQSQPAPAGPAATTVLQGVTLPPSAVAMLNTPDGLVQPATPAAATGEAAPVLTVQPAPQAPPAVSTPLPLGLQQPQAQQPPQAPTPQAAAPPQATTPQPSPGLASSPEKIVLGQPPSATPTAILTQDSLQMFLPQERSQQPLSAEGPHLSVPASVIVSAPPPAQDPAPATPVAKGAGLGPQAPDSQASPAPAPQIPAAAPLKGPGPSSSPSLPHQAPLGDSPHLPSPHPTRPPSRPPSRPQSVSRPPSEPPLHPCPPPQAPPTLPGIFVIQNQLGVPPPASNPAPTAPGPPQPPLRPQSQPPEGPLPPAPHLPPSSTSSAVASSSETSSRLPAPTPSDFQLQFPPSQGPHKSPTPPPTLHLVPEPAAPPPPPPRTFQMVTTPFPALPQPKALLERFHQVPSGIILQNKAGGAPAAPQTSTSLGPLTSPAASVLVSGQAPSGTPTAPSHAPAPAPMAATGLPPLLPAENKAFASNLPTLNVAKAASSGPGKPSGLQYESKLSGLKKPPTLQPSKEACFLEHLHKHQGSVLHPDYKTAFPSFEDALHRLLPYHVYQGALPSPSDYHKVDEEFETVSTQLLKRTQAMLNKYRLLLLEESRRVSPSAEMVMIDRMFIQEEKTTLALDKQLAKEKPDEYVSSSRSLGLPIAASSEGHRLPGHGPLSSSAPGASTQPPPHLPTKLVIRHGGAGGSPSVTWARASSSLSSSSSSSSAASSLDADEDGPMPSRNRPPIKTYEARSRIGLKLKIKQEAGLSKVVHNTALDPVHQPPPPPATLKVAEPPPRPPPPPPPTGQMNGTVDHPPPAAPERKPLGTAPHCPRLPLRKTYRENVGGPGAPEGTPAGRARGGSPAPLPAKVDEATSGLIRELAAVEDELYQRMLKGPPPEPAASAAQGTGDPDWEAPGLPPAKRRKSESPDVDQASFSSDSPQDDTLTEHLQSAIDSILNLQQAPGRTPAPSYPHAASAGTPASPPPLHRPEAYPPSSHNGGLGARTLTR

SEQ ID NO: 834646 - protein, 1560 aa, Homo sapiens [sequence omitted]

SEQ ID NO: 834647 - protein, 1560 aa, Homo sapiens [sequence omitted]

SEQ ID NO: 834648 - protein, 1609 aa, Homo sapiens
PHQRSHVAVNPGLSLVAIRILGSPRAVAINPEPWYTASCWCLFALTWLDGLVGAGGWDAALPALLTFDLWMGRVLLQLDSDDLLDNPGEAQSAFYEGPGLHVQEASGNHLNPEPNQPAPSVDLDFLEDDILGSPATGGGGGGSGGADQPCDILQQSLQEANITEQTLEAEAELDLGPFQLPTLQPADGGAGPTGAGGAAAVAAGPQALFPGSTDLLGLQGPPTVLTHQALVPPQDVVNKALSVQPFLQPVGLGNVTLQPIPGLQGLPNGSPGGATAATLGLAPIQVVGQPVMALNTPTSQLLAKQVPVSGYLASAAGPSEPVTLASAGVSPQGAGLVIQKNLSAAVATTLNGNSVFGGAGAASAPTGTPSGQPLAVAPGLGSSPLVPAPNVILHRTPTPIQPKPAGVLPPKLYQLTPKPFAPAGATLTIQGEPGALPQQPKAPQNLTFMAAGKAGQNVVLSGFPAPALQANVFKQPPATTTGAAPPQPPGALSKPMSVHLLNQGSSIVIPAQHMLPGQNQFLLPGAPAVQLPQQLSALPANVGGQILAAAAPHTGGQLIANPILTNQNLAGPLSLGPVLAPHSGAHSAHILSAAPIQVGQPALFQMPVSLAAGSLPTQSQPAPAGPAATTVLQGVTLPPSAVAMLNTPDGLVQPATPAAATGEAAPVLTVQPAPQAPPAVSTPLPLGLQQPQAQQPPQAPTPQAAAPPQATTPQPSPGLASSPEKIVLGQPPSATPTAILTQDSLQMFLPQERSQQPLSAEGPHLSVPASVIVSAPPPAQDPAPATPVAKGAGLGPQAPDSQASPAPAPQIPAAAPLKGPGPSSSPSLPHQAPLGDSPHLPSPHPTRPPSRPPSRPQSVSRPPSEPPLHPCPPPQAPPTLPGIFVIQNQLGVPPPASNPAPTAPGPPQPPLRPQSQPPEGPLPPAPHLPPSSTSSAVASSSETSSRLPAPTPSDFQLQFPPSQGPHKSPTPPPTLHLVPEPAAPPPPPPRTFQMVTTPFPALPQPKALLERFHQVPSGIILQNKAGGAPAAPQTSTSLGPLTSPAASVLVSGQAPSGTPTAPSHAPAPAPMAATGLPPLLPAENKAFASNLPTLNVAKAASSGPGKPSGLQYESKLSGLKKPPTLQPSKEACFLEHLHKHQGSVLHPDYKTAFPSFEDALHRLLPYHVYQGALPSPSDYHKVDEEFETVSTQLLKRTQAMLNKYRLLLLEESRRVSPSAEMVMIDRMFIQEEKTTLALDKQLAKEKPDEYVSSSRSLGLPIAASSEGHRLPGHGPLSSSAPGASTQPPPHLPTKLVIRHGGAGGSPSVTWARASSSLSSSSSSSSAASSLDADEDGPMPSRNRPPIKTYEARSRIGLKLKIKQEAGLSKVVHNTALDPVHQPPPPPATLKVAEPPPRPPPPPPPTGQMNGTVDHPPPAAPERKPLGTAPHCPRLPLRKTYRENVGGPGAPEGTPAGRARGGSPAPLPAKVDEATSGLIRELAAVEDELYQRMLKGPPPEPAASAAQGTGDPDWEAPGLPPAKRRKSESPDVDQASFSSDSPQDDTLTEHLQSAIDSILNLQQAPGRTPAPSYPHAASAGTPASPPPLHRPEAYPPSSHNGGLGARTLTR

SEQ ID NO: 834649 - protein, 454 aa, Homo sapiens
MGRTYIVEETVGQYLSNINLQGKAFVSGLLIGQCSSQKDYVILATRTPPKEEQSENLKHPKAKLDNLDEEWATEHACQVSRMLPGGLLVLGVFIITTLELANDFQNALRRLMFAVEKSINRKRLWNFTEEEVSERVTLHICASTKKIFCRTYDIHDPKSSARPADWKYQSGLSSSWLSLECTVHINIHIPLSATSVSYTLEKNTKNGLTRWAKEIENGVYLINGQVKDEDCDLLEGQKKSSRGNTQATSHSFDVRVLTQLLLNSDHRSTATVQICSGSVNLKGAVKCRAYIHSSKPKVKDAVQAVKRDILNTVADRCEMLFEDLLLNEIPEKKDSEKEFHVLPYRVFVPLPGSTVMLCDYKFDDESAEEIRDHFMEMLDHTIQIEDLEIAEETNTACMSSSMNSQASLDNTDDEQPKQPIKTTMLLKIQQNIGVIAAFTVAVLAAGISFHYFSD

SEQ ID NO: 834650 - protein, 454 aa, Homo sapiens; identical to SEQ ID NO: 834649

SEQ ID NO: 834651 - protein, 454 aa, Homo sapiens; identical to SEQ ID NO: 834649

SEQ ID NO: 834652 - protein, 373 aa, Homo sapiens
MLPGGLLVLGVFIITTLELANDFQNALRRLMFAVEKSINRKRLWNFTEEEVSERVTLHICASTKKIFCRTYDIHDPKSSARPADWKYQSGLSSSWLSLECTVHINIHIPLSATSVSYTLEKNTKNGLTRWAKEIENGVYLINGQVKDEDCDLLEGQKKSSRGNTQATSHSFDVRVLTQLLLNSDHRSTATVQICSGSVNLKGAVKCRAYIHSSKPKVKDAVQAVKRDILNTVADRCEMLFEDLLLNEIPEKKDSEKEFHVLPYRVFVPLPGSTVMLCDYKFDDESAEEIRDHFMEMLDHTIQIEDLEIAEETNTACMSSSMNSQASLDNTDDEQPKQPIKTTMLLKIQQNIGVIAAFTVAVLAAGISFHYFSD

SEQ ID NO: 834653 - protein, 454 aa, Homo sapiens; identical to SEQ ID NO: 834649

SEQ ID NO: 834654 - protein, 373 aa, Homo sapiens; identical to SEQ ID NO: 834652

SEQ ID NO: 834655 - protein, 134 aa, Homo sapiens
MKIVVIVQAKVASPSLMEIKINSRQFSLSSYIKTLILFSVIGKSYDYGIDMWSVGCTLYELYTGKILFPGKTNNHMLKLAMDLKGKMPNKMIRKGVFKDQHFDQNLNFMYIEVDKVTERVSVLNAACNSYFIVN

SEQ ID NO: 834656 - protein, 121 aa, Homo sapiens
HFPYPPPSGSRRHRRRGVRKFKMAAAETQSLREQPEMEDANSEKSINEENGEVSEDQSQNKHSRHKKKKHKHRSKHKKHKHSSEEDKDKKHKHKHKHKIKKKPRGSFGAPGPIVFPPGGSR

SEQ ID NO: 834657 - protein, 1029 aa, Homo sapiens
HFPYPPPSGSRRHRRRGVRKFKMAAAETQSLREQPEMEDANSEKSINEENGEVSEDQSQNKHSRHKKKKHKHRSKHKKHKHSSEEDKDKKHKHKHKHKKHKRKEVIDASDKEGMSPAKRTKLDDLALLEDLEKQRALIKAELDNELMEGKVQSGMGLILQGYESGSEEEGEIHEKARNGNRSSTRSSSTKGKLELVDNKITTKKRSKSRSKERTRHRSDKKKSKGGIEIVKEKTTRSKSKERKKSKSPSKRSKSQDQARKSKSPTLRRRSQEKIGKARSPTDDKVKIEDKSKSKDRKKSPIINESRSRDRGKKSRSPVDLRGKSKDRRSRSKERKSKRSETDKEKKPIKSPSKDASSGKENRSPSRRPGRSPKRRSLSPKPRDKSRRSRSPLLNDRRSKQSKSPSRTLSPGRRAKSRSLERKRREPERRRLSSPRTRPRDDILSRRERSKDASPINRWSPTRRRSRSPIRRRSRSPLRRSRSPRRRSRSPRRRDRGRRSRSRLRRRSRSRGGRRRRSRSKVKEDKFKGSLSEGMKVEQESSSDDNLEDFDVEEEDEEALIEQRRIQRQAIVQKYKYLAEDSNMSVPSEPSSPQSSTRTRSPSPDDILERVAADVKEYERENVDTFEASVKAKHNLMTVEQNNGSSQKKLLAPDMFTESDDMFAAYFDSARLRAAGIGKDFKENPNLRDNWTDAEGYYRVNIGEVLDKRYNVYGYTGQGVFSNVVRARDNARANQEVAVKIIRNNELMQKTGLKELEFLKKLNDADPDDKFHCLRLFRHFYHKQHLCLVFEPLSMNLREVLKKYGKDVGLHIKAVRSYSQQLFLALKLLKRCNILHADIKPDNILVNESKTILKLCDFGSASHVADNDITPYLVSRFYRAPEIIIGKSYDYGIDMWSVGCTLYELYTGKILFPGKTNNHMLKLAMDLKGKMPNKMIRKGVFKDQHFDQNLNFMYIEVDKVTEREKVTVMSTINPTKDLLADLIGCQRLPEDQRKKVHQLKDLLDQILMLDPAKRISINQALQHAFIQEKI

SEQ ID NO: 834658 - protein, 1029 aa, Homo sapiens; identical to SEQ ID NO: 834657

SEQ ID NO: 834659 - protein, 1029 aa, Homo sapiens; identical to SEQ ID NO: 834657

SEQ ID NO: 834660 - protein, 1029 aa, Homo sapiens; identical to SEQ ID NO: 834657

SEQ ID NO: 834661 - protein, 1029 aa, Homo sapiens; identical to SEQ ID NO: 834657

SEQ ID NO: 834662 - protein, 1029 aa, Homo sapiens; identical to SEQ ID NO: 834657

SEQ ID NO: 834663 - protein, 1029 aa, Homo sapiens; identical to SEQ ID NO: 834657

SEQ ID NO: 834664 - protein, 1029 aa, Homo sapiens; identical to SEQ ID NO: 834657

SEQ ID NO: 834665 - protein, 163 aa, Homo sapiens
LIPRGSRESTPRAPEIIIGKSYDYGIDMWSVGCTLYELYTGKILFPGKTNNHMLKLAMDLKGKMPNKMIRKGVFKDQHFDQNLNFMYIEVDKVTEREKVTVMSTINPTKDLLADLIGCQRLPEDQRKKVHQLKDLLDQILMLDPAKRISINQALQHAFIQEKI

SEQ ID NO: 834666 - protein, 724 aa, Homo sapiens
HFPYPPPSGSRRHRRRGVRKFKMAAAETQSLREQPEMEDANSEKSINEENGEVSEDQSQNKHSRHKKKKHKHRSKHKKHKHSSEEDKDKKHKHKHKHKKHKRKEVIDASDKEGMSPAKRTKLDDLALLEDLEKQRALIKAELDNELMEGKVQSGMGLILQGYESGSEEEGEIHEKARNGNRSSTRSSSTKGKLELVDNKITTKKRSKSRSKERTRHRSDKKKSKGGIEIVKEKTTRSKSKERKKSKSPSKRSKSQDQARKSKSPTLRRRSQEKIGKARSPTDDKVKIEDKSKSKDRKKSPIINESRSRDRGKKSRSPVDLRGKSKDRRSRSKERKSKRSETDKEKKPIKSPSKDASSGKENRSPSRRPGRSPKRRSLSPKPRDKSRRSRSPLLNDRRSKQSKSPSRTLSPGRRAKSRSLERKRREPERRRLSSPRTRPRDDILSRRERSKDASPINRWSPTRRRSRSPIRRRSRSPLRRSRSPRRRSRSPRRRDRGRRSRSRLRRRSRSRGGRRRRSRSKVKEDKFKGSLSEGMKVEQESSSDDNLEDFDVEEEDEEALIEQRRIQRQAIVQKYKYLAEDSNMSVPSEPSSPQSSTRTRSPSPDDILERVAADVKEYERENVDTFEASVKAKHNLMTVEQNNGSSQKKLLAPDMFTESDDMFAAYFDSARLRAAGIGKDFKENPNLRDNWTDAEGYYRVNIGEVLDKRYNVYGCSCWSREDDSR

SEQ ID NO: 834667 - protein, 539 aa, Homo sapiens
MAAAETQSLREQPEMEDANSEKSINEENGEVSEDQSQNKHSRHKKKKHKHRSKHKKHKHSSEEDKDKKHKHKHKHKKHKRKEVIDASDKEGMSPAKRTKLDDLALLEDLEKQRALIKAELDNELMEGKVQSGMGLILQGYESGSEEEGEIHEKARNGNRSSTRSSSTKGKLELVDNKITTKKRSKSRSKERTRHRSDKKKSKGGIEIVKEKTTRSKSKERKKSKSPSKRSKSQDQARKSKSPTLRRRSQEKIGKARSPTDDKVKIEDKSKSKDRKKSPIINESRSRDRGKKSRSPVDLRGKSKDRRSRSKERKSKRSETDKEKKPIKSPSKDASSGKENRSPSRRPGRSPKRRSLSPKPRDKSRRSRSPLLNDRRSKQSKSPSRTLSPGRRAKSRSLERKRREPERRRLSSPRTRPRDDILSRRERSKDASPINRWSPTRRRSRSPIRRRSRSPLRRSRSPRRRSRSPRRRDRGRRSRSRLRRRSRSRGGRRRRSRSKVKEDKFKGSLSEGMKVVPVSVRLDDNVQYHDVEEADERSDG

SEQ ID NO: 834668 - protein, 371 aa, Homo sapiens
HFPYPPPSGSRRHRRRGVRKFKMAAAETQSLREQPEMEDANSEKSINEENGEVSEDQSQNKHSRHKKKKHKHRSKHKKHKHSSEEDKDKKHKHKHKHKKHKRKEVIDASDKEGMSPAKRTKLDDLALLEDLEKQRALIKAELDNELMEGKVQSGMGLILQGYESGSEEEGEIHEKARNGNRSSTRSSSTKGKLELVDNKITTKKRSKSRSKERTRHRSDKKKSKGGIEIVKEKTTRSKSKERKKSKSPSKRSKSQDQARKSKSPTLRRRSQEKIGKARSPTDDKVKIEDKSKSKDRKKSPIINESRSRDRGKKSRSPVDLRGKSKDRRSRSKERKSKRSETDKEKKPINSSKISLEEAPQNCAKKIAQCIR

SEQ ID NO: 834669 - protein, 1029 aa, Homo sapiens; identical to SEQ ID NO: 834657

SEQ ID NO: 834670 - protein, 1029 aa, Homo sapiens; identical to SEQ ID NO: 834657

SEQ ID NO: 834671 - protein, 1029 aa, Homo sapiens; identical to SEQ ID NO: 834657

SEQ ID NO: 834672 - protein, 1029 aa, Homo sapiens; identical to SEQ ID NO: 834657

SEQ ID NO: 834673 - protein, 1015 aa, Homo sapiens
TRGSTHASDGRAGTQSLREQPEMEDANSEKSINEENGEVSEDQSQNKHSRHKKKKHKHRSKHKKHKHSSEEDKDKKHKHKHKHKKHKRKEVIDASDKEGMSPAKRTKLDDLALLEDLEKQRALIKAELDNELMEGKVQSGMGLILQGYESGSEEEGEIHEKARNGNRSSTRSSSTKGKLELVDNKITTKKRSKSRSKERTRHRSDKKKSKGGIEIVKEKTTRSKSKERKKSKSPSKRSKSQDQARKSKSPTLRRRSQEKIGKARSPTDDKVKIEDKSKSKDRKKSPIINESRSRDRGKKSRSPVDLRGKSKDRRSRSKERKSKRSETDKEKKPIKSPSKDASSGKENRSPSRRPGRSPKRRSLSPKPRDKSRRSRSPLLNDRRSKQSKSPSRTLSPGRRAKSRSLERKRREPERRRLSSPRTRPRDDILSRRERSKDASPINRWSPTRRRSRSPIRRRSRSPLRRSRSPRRRSRSPRRRDRGRRSRSRLRRRSRSRGGRRRRSRSKVKEDKFKGSLSEGMKVEQESSSDDNLEDFDVEEEDEEALIEQRRIQRQAIVQKYKYLAEDSNMSVPSEPSSPQSSTRTRSPSPDDILERVAADVKEYERENVDTFEASVKAKHNLMTVEQNNGSSQKKLLAPDMFTESDDMFAAYFDSARLRAAGIGKDFKENPNLRDNWTDAEGYYRVNIGEVLDKRYNVYGYTGQGVFSNVVRARDNARANQEVAVKIIRNNELMQKTGLKELEFLKKLNDADPDDKFHCLRLFRHFYHKQHLCLVFEPLSMNLREVLKKYGKDVGLHIKAVRSYSQQLFLALKLLKRCNILHADIKPDNILVNESKTILKLCDFGSASHVADNDITPYLVSRFYRAPEIIIGKSYDYGIDMWSVGCTLYELYTGKILFPGKTNNHMLKLAMDLKGKMPNKMIRKGVFKDQHFDQNLNFMYIEVDKVTEREKVTVMSTINPTKDLLADLIGCQRLPEDQRKKVHQLKDLLDQILMLDPAKRISINQALQHAFIQEKI

SEQ ID NO: 834674 - protein, 1029 aa, Homo sapiens; identical to SEQ ID NO: 834657

SEQ ID NO: 834675 - protein, 1029 aa, Homo sapiens; identical to SEQ ID NO: 834657

SEQ ID NO: 834676 - protein, 1029 aa, Homo sapiens; identical to SEQ ID NO: 834657

SEQ ID NO: 834677 - protein, 977 aa, Homo sapiens
HFPYPPPSGSRRHRRRGVRKFKMAAAETQSLREQPEMEDANSEKSINEENGEVSEDQSQNKHSRHKKKKHKHRSKHKKHKHSSEEDKDKKHKHKHKHKKHKRKEVIDASDKEGMSPAKRTKLDDLALLEDLEKQRALIKAELDNELMEGKVQSGMGLILQGYESGSEEEGEIHEKARNGNRSSTRSSSTKGKLELVDNKITTKKRSKSRSKERTRHRSDKKKSKGGIEIVKEKTTRSKSKERKKSKSPSKRSKSQDQARKSKSPTLRRRSQEKIGKARSPTDDKVKIEDKSKSKDRKKSPIINESRSRDRGKKSRSPVDLRGKSKDRRSRSKERKSKRSETDKEKKPIKSPSKDASSGKENRSPSRRPGRSPKRRSLSPKPRDKSRRSRSPLLNDRRSKQSKSPSRTLSPGRRAKSRSLERKRREPERRRLSSPRTRPRDDILSRRERSKDASPINRWSPTRRRSRSPIRRRSRSPLRRSRSPRRRSRSPRRRDRGRRSRSRLRRRSRSRGGRRRRSRSKVKEDKFKGSLSEGMKVEQESSSDDNLEDFDVEEEDEEALIEQRRIQRQAIVQKYKYLAEDSNMSVPSEPSSPQSSTRTRSPSPDDILERVAADVKEYERENVDTFEASVKAKHNLMTVEQNNGSSQKKLLAPDMFTESDDMFAAYFDSARLRAAGIGKDFKENPNLRDNWTDAEGYYRVNIGEVLDKRYNVYGYTGQGVFSNVVRARDNARANQEVAVKIIRNNELMQKTGLKELEFLKKLNDADPDDKFHCLRLFRHFYHKQHLCLVFEPLSMNLREVLKKYGKDVGLHIKAVRSYSQQLFLALKLLKRCNILHADIKPDNILVNESKTILKLCDFGSASHVADNDITPYLVSRFYRAPEIIIGKSYDYGIDMWSVGCTLYELYTGKILFPGKTNNHMLKLAMDLKGKMPNKMIRKGVFKDQHFDQNLNFMYIEVDKVTERVSVLNAACNSYFIVN

SEQ ID NO: 834678 - protein, 656 aa, Homo sapiens
HFPYPPPSGSRRHRRRGVRKFKMAAAETQSLREQPEMEDANSEKSINEENGEVSEDQSQNKHSRHKKKKHKHRSKHKKHKHSSEEDKDKKHKHKHKHKKHKRKEVIDASDKEGMSPAKRTKLDDLALLEDLEKQRALIKAELDNELMEGKVQSGMGLILQGYESGSEEEGEIHEKARNGNRSSTRSSSTKGKLELVDNKITTKKRSKSRSKERTRHRSDKKKSKGGIEIVKEKTTRSKSKERKKSKSPSKRSKSQDQARKSKSPTLRRRSQEKIGKARSPTDDKVKIEDKSKSKDRKKSPIINESRSRDRGKKSRSPVDLRGKSKDRRSRSKERKSKRSETDKEKKPIKSPSKDASSGKENRSPSRRPGRSPKRRSLSPKPRDKSRRSRSPLLNDRRSKQSKSPSRTLSPGRRAKSRSLERKRREPERRRLSSPRTRPRDDILSRRERSKDASPINRWSPTRRRSRSPIRRRSRSPLRRSRSPRRRSRSPRRRDRGRRSRSRLRRRSRSRGGRRRRSRSKVKEDKFKGSLSEGMKVEQESSSDDNLEDFDVEEEDEEALIEQRRIQRQAIVQKYKYLAEDSNMSVPSEPSSPQSSTRTRSPSPDDILERVAADVKEYERENVDTFEASVKAKHNLMTVEQNNGERVLSWRRFSLNC

SEQ ID NO: 834679 - protein, 193 aa, Homo sapiens
MGKQNSKLRPEVLQDLRENTEFTDHELQEWYKGFLKDCPTGHLTVDEFKKIYANFFPYGDASKFAEHVFRTFDTNGDGTIDFREFIIALSVTSRGKLEQKLKWAFSMYDLDGNGYISRSEMLEIVQAIYKMVSSVMKMPEDESTPEKRTDKIFRQMDTNNDGKLSLEEFIRGAKSDPSIVRLLQCDPSSASQF

SEQ ID NO: 834680 - protein, 193 aa, Homo sapiens; identical to SEQ ID NO: 834679

SEQ ID NO: 834681 - protein, 193 aa, Homo sapiens; identical to SEQ ID NO: 834679

SEQ ID NO: 834682 - protein, 193 aa, Homo sapiens; identical to SEQ ID NO: 834679

SEQ ID NO: 834683 - protein, 193 aa, Homo sapiens; identical to SEQ ID NO: 834679

SEQ ID NO: 834684 - protein, 193 aa, Homo sapiens; identical to SEQ ID NO: 834679

SEQ ID NO: 834685 - protein, 158 aa, Homo sapiens
GDLEDPISGQDEFKKIYANFFPYGDASKFAEHVFRTFDTNGDGTIDFREFIIALSVTSRGKLEQKLKWAFSMYDLDGNGYISRSEMLEIVQAIYKMVSSVMKMPEDESTPEKRTDKIFRQMDTNNDGKLSLEEFIRGAKSDPSIVRLLQCDPSSASQF

SEQ ID NO: 834686 - protein, 109 aa, Homo sapiens
MGKQNSKLRPEVLQDLRENTEFTDHELQEWYKGFLKDCPTGHLTVDEFKKIYANFFPYGDASKFAEHVFRTFDTNGDGTIDFREFIIALSVTSRGKLEQKPVGFGCRLA

SEQ ID NO: 834687 - protein, 193 aa, Homo sapiens; identical to SEQ ID NO: 834679

SEQ ID NO: 834688 - protein, 193 aa, Homo sapiens; identical to SEQ ID NO: 834679

SEQ ID NO: 834689 - protein, 193 aa, Homo sapiens; identical to SEQ ID NO: 834679

SEQ ID NO: 834690 - protein, 193 aa, Homo sapiens; identical to SEQ ID NO: 834679

SEQ ID NO: 834691 - protein, 193 aa, Homo sapiens; identical to SEQ ID NO: 834679

SEQ ID NO: 834692 - protein, 193 aa, Homo sapiens; identical to SEQ ID NO: 834679

SEQ ID NO: 834693 - protein, 143 aa, Homo sapiens
MGKQNSKLRPEVLQDLRENTEFTDHELQEWYKGFLKDCPTGHLTVDEFKKIYANFFPYGDASKFAEHVFRTFDTNGDGTIDFREFIIALSVTSRGKLEQKLKWAFSMYDLDGNGYISRSEMLEIVQASTNGVSVMRCRDESPG

SEQ ID NO: 834694 - protein, 527 aa, Homo sapiens
AAHCGSSSSYPAPRASPEKTRAESTMSGGPMGGRPGGRGAPAVQQNIPSTLLQDHENQRLFEMLGRKCLTLATAVVQLYLALPPGAEHWTKEHCGAVCFVKDNPQKSYFIRLYGLQAGRLLWEQELYSQLVYSTPTPFFHTFAGDDCQAGLNFADEDEAQAFRALVQEKIQKRNQRQSGDRRQLPPPPTPANEERRGGLPPLPLHPGGDQGGPPVGPLSLGLATVDIQNPDITSSRYRGLPAPGPSPADKKRSGKKKISKADIGAPSGFKHVSHVGWDPQNGFDVNNLDPDLRSLFSRAGISEAQLTDAETSKLIYDFIEDQGGLEAVRQEMRRQEPLPPPPPPSRGGNQLPRPPIVGGNKGRSGPLPPVPLGIAPPPPTPRGPPPPGRGGPPPPPPPATGRSGPLPPPPPGAGGPPMPPPPPPPPPPPSSGNGPAPPPLPPALVPAGGLAPGGGRGALLDQIRQGIQLNKTPGAPESSALQPPPQSSEGLVGALMHVMQKRSRAIHSSDEGEDQAGDEDEDDEWDD

SEQ ID NO: 834695 - protein, 544 aa, Homo sapiens
AAHCGSSSSYPAPRASPEKTRAESTMSGGPMGGRPGGRGAPAVQQNIPSTLLQDHENQRLFEMLGRKCLTLATAVVQLYLALPPGAEHWTKEHCGAVCFVKDNPQKSYFIRLYGLQAGRLLWEQELYSQLVYSTPTPFFHTFAGDDCQAGLNFADEDEAQAFRALVQEKIQKRNQRQSGDRRQLPPPPTPANEERRGGLPPLPLHPGGDQGGPPVGPLSLGLATVDIQNPDITSSRYRGLPAPGPSPADKKRSGKKKISKADIGAPSGFKHVSHVGWDPQNGFDVNNLDPDLRSLFSRAGISEAQLTDAETSKLIYDFIEDQGGLEAVRQEMRRQEPLPPPPPPSRGGNQLPRPPIVGGNKGRSGPLPPVPLGIAPPPPTPRGPPPPGRGGPPPPPPPATGRSGPLPPPPPGAGGPPMPPPPPPPPPPPSSGNGPAPPPLPPALVPAGGLAPGGGRGALLDQIRQGIQLNKTPGAPESSALQPPPQSSEGLVGALMHVMQKRSRAIHSSGELILPGPQTWLPGLALASKQSQQSPPIVTSAPSV

SEQ ID NO: 834696 - protein, 527 aa, Homo sapiens; identical to SEQ ID NO: 834694

SEQ ID NO: 834697 - protein, 504 aa, Homo sapiens
AAHCGSSSSYPAPRASPEKTRAESTMSGGPMGGRPGGRGAPAVQQNIPSTLLQDHENQRLFEMLGRKCLTLATAVVQLYLALPPGAEHWTKEHCGAVCFVKDNPQKSYFIRLYGLQAGRLLWEQELYSQLVYSTPTPFFRALVQEKIQKRNQRQSGDRRQLPPPPTPANEERRGGLPPLPLHPGGDQGGPPVGPLSLGLATVDIQNPDITSSRYRGLPAPGPSPADKKRSGKKKISKADIGAPSGFKHVSHVGWDPQNGFDVNNLDPDLRSLFSRAGISEAQLTDAETSKLIYDFIEDQGGLEAVRQEMRRQEPLPPPPPPSRGGNQLPRPPIVGGNKGRSGPLPPVPLGIAPPPPTPRGPPPPGRGGPPPPPPPATGRSGPLPPPPPGAGGPPMPPPPPPPPPPPSSGNGPAPPPLPPALVPAGGLAPGGGRGALLDQIRQGIQLNKTPGAPESSALQPPPQSSEGLVGALMHVMQKRSRAIHSSDEGEDQAGDEDEDDEWDD

SEQ ID NO: 834698 - protein, 226 aa, Homo sapiens
AAHCGSSSSYPAPRASPEKTRAESTMSGGPMGGRPGGRGAPAVQQNIPSTLLQDHENQRLFEMLGRKCLTLATAVVQLYLALPPGAEHWTKEHCGAVCFVKDNPQKSYFIRLYGLQAGRLLWEQELYSQLVYSTPTPFFHTFAGDDCQAGLNFADEDEAQAFRALVQEKIQKRNQRQSGDRRQLPPPPTPANEERRGGLPPLPLHPGGDQGGMSATWGGTPRMDLT

SEQ ID NO: 834699 - protein, 258 aa, Homo sapiens
AAHCGSSSSYPAPRASPEKTRAESTMSGGPMGGRPGGRGAPAVQQNIPSTLLQDHENQRLFEMLGRKCLTLATAVVQLYLALPPGAEHWTKEHCGAVCFVKDNPQKSYFIRLYGLQAGRLLWEQELYSQLVYSTPTPFFHTFAGDDCQAGLNFADEDEAQAFRALVQEKIQKRNQRQSGVATVDIQNPDITSSRYRGLPAPGPSPADKKRSGKKKISKADIGAPSGFKHVSHVGWDPQNGFDVSNFRVSWTPLNFHPP

SEQ ID NO: 834700 - protein, 527 aa, Homo sapiens; identical to SEQ ID NO: 834694

SEQ ID NO: 834701 - protein, 148 aa, Homo sapiens [sequence omitted]

SEQ ID NO: 834702 - protein, 1827 aa, Homo sapiens
MADERKDEAKAPHWTSAPLTEASAHSHPPEIKDQGGAGEGLVRSANGFPYREDEEGAFGEHGSQGTYSNTKENGINGELTSADRETAEEVSARIVQVVTAEAVAVLKGEQEKEAQHKDQTAALPLAAEETANLPPSPPPSPASEQTVTVEEDLLTASKMEFHDQQELTPSTAEPSDQKEKESEKQSKPGEDLKHAALVSQPETTKTYPDKKDMQGTEEEKAPLALFGHTLVASLEDMKQKTEPSLVVPGIDLPKEPPTPKEQKDWFIEMPTEAKKDEWGLVAPISPGPLTPMREKDVFDDIPKWEGKQFDSPMPSPFQGGSFTLPLDVMKNEIVTETSPFAPAFLQPDDKKSLQQTSGPATAKDSFKIEEPHEAKPDKMAEAPPSEAMTLPKDAHIPVVEEHVMGKVLEEEKEAINQETVQQRDTFTPSGQEPILTEKETELKLEEKTTISDKEAVPKESKPPKPADEEIGIIQTSTEHTFSEQKDQEPTTDMLKQDSFPVSLEQAVTDSAMTSKTLEKAMTEPSALIEKSSIQELFEMRVDDKDKIEGVGAATSAELDMPFYEDKSGMSKYFETSALKEEATKSIEPGSDYYELSDTRESVHESIDTMSPMHKNGDKEFQTGKESQPSPPAQEAGYSTLAQSYPSDLPEEPSSPQERMFTIDPKVYGEKRDLHSKNKDDLTLSRSLGLGGRSAIEQRSMSINLPMSCLDSIALGFNFGRGHDLSPLASDILTNTSGSMDEGDDYLPATTPALEKAPCFPVESKEEEQIEKVKATGEESTQAEISCESPFLAKDFYKNGTVMAPDLPEMLDLAGTRSRLASVSADAEVARRKSVPSETVVEDSRTGLPPVTDENHVIVKTDSQLEDLGYCVFNKYTVPLPSPVQDSENLSGESGTFYEGTDDKVRRDLATDLSLIEVKLAAAGRVKDEFSVDKEASAHISGDKSGLSKEFDQEKKANDRLDTVLEKSEEHADSKEHAKKTEEAGDEIETFGLGVTYEQALAKDLSIPTDASSEKAEKGLSSVPEIAEVEPSKKVEQGLDFAVQGQLDVKISDFGQMASGLNIDDRRATELKLEATQDMTPSSKAPQEADAFMGVESGHMKEGTKVSETEVKQKVAKPDLVHQEAVDKEESYESSGEHESLTMESLKADEGKKETSPESSLIQDEIAVKLSVEIPCPPAVSEADLATDERADVQMEFIQGPKEESKETPDISITPSDVAEPLHETIVSEPAEIQSEEEEIEAQGEYDKLLFRSDTLQITDLGVSGAREEFVETCPSEHKGVIESVVTIEDDFITVVQTTTDEGESGSHSVRFAALEQPEVERRPSPHDEEEFEVEEAAEAQAEPKDGSPEAPASPEREEVALSEYKTETYDDYKDETTIDDSIMDADSLWVDTQDDDRSIMTEQLETIPKEEKAEKEARRSSLEKHRKEKPFKTGRGRISTPERKVAKKEPSTVSRDEVRRKKAVYKKAELAKKTEVQAHSPSRKFILKPAIKYTRPTHLSCVKRKTTAAGGESALAPSVFKQAKDKVSDGVTKSPEKRSSLPRPSSILPPRRGVSGDRDENSFSLNSSISSSARRTTRSEPIRRAGKSGTSTPTTPGSTAITPGTPPSYSSRTPGTPGTPSYPRTPHTPGTPKSAILVPSEKKVAIIRTPPKSPATPKQLRLINQPLPDLKNVKSKIGSTDNIKYQPKGGQVQIVTKKIDLSHVTSKCGSLKNIRHRPGGGRVKIESVKLDFKEKAQAKVGSLDNAHHVPGGGNVKIDSQKLNFREHAKARVDHGAEIITQSPGRSSVASPRRLSNVSSSGSINLLESPQLATLAEDVTAALAKQGL

SEQ ID NO: 834703 - protein, 1827 aa, Homo sapiens; identical to SEQ ID NO: 834702

SEQ ID NO: 834704 - protein, 1827 aa, Homo sapiens; identical to SEQ ID NO: 834702

SEQ ID NO: 834705 - protein, 1858 aa, Homo sapiens
MADERKDEAKAPHWTSAPLTEASAHSHPPEIKDQGGAGEGLVRSANGFPYREDEEGAFGEHGSQGTYSNTKENGINGELTSADRETAEEVSARIVQVVTAEAVAVLKGEQEKEAQHKDQTAALPLAAEETANLPPSPPPSPASEQTVTVEEDLLTASKMEFHDQQELTPSTAEPSDQKEKESEKQSKPGEDLKHAALVSQPETTKTYPDKKDMQGTEEEKAPLALFGHTLVASLEDMKQKTEPSLVVPGIDLPKEPPTPKEQKDWFIEMPTEAKKDEWGLVAPISPGPLTPMREKDVFDDIPKWEGKQFDSPMPSPFQGGSFTLPLDVMKNEIVTETSPFAPAFLQPDDKKSLQQTSGPATAKDSFKIEEPHEAKPDKMAEAPPSEAMTLPKDAHIPVVEEHVMGKVLEEEKEAINQETVQQRDTFTPSGQEPILTEKETELKLEEKTTISDKEAVPKESKPPKPADEEIGIIQTSTEHTFSEQKDQEPTTDMLKQDSFPVSLEQAVTDSAMTSKTLEKAMTEPSALIEKSSIQELFEMRVDDKDKIEGVGAATSAELDMPFYEDKSGMSKYFETSALKEEATKSIEPGSDYYELSDTRESVHESIDTMSPMHKNGDKEFQTGKESQPSPPAQEAGYSTLAQSYPSDLPEEPSSPQERMFTIDPKVYGEKRDLHSKNKDDLTLSRSLGLGGRSAIEQRSMSINLPMSCLDSIALGFNFGRGHDLSPLASDILTNTSGSMDEGDDYLPATTPALEKAPCFPVESKEEEQIEKVKATGEESTQAEISCESPFLAKDFYKNGTVMAPDLPEMLDLAGTRSRLASVSADAEVARRKSVPSETVVEDSRTGLPPVTDENHVIVKTDSQLEDLGYCVFNKYTVPLPSPVQDSENLSGESGTFYEGTDDKVRRDLATDLSLIEVKLAAAGRVKDEFSVDKEASAHISGDKSGLSKEFDQEKKANDRLDTVLEKSEEHADSKEHAKKTEEAGDEIETFGLGVTYEQALAKDLSIPTDASSEKAEKGLSSVPEIAEVEPSKKVEQGLDFAVQGQLDVKISDFGQMASGLNIDDRRATELKLEATQDMTPSSKAPQEADAFMGVESGHMKEGTKVSETEVKQKVAKPDLVHQEAVDKEESYESSGEHESLTMESLKADEGKKETSPESSLIQDEIAVKLSVEIPCPPAVSEADLATDERADVQMEFIQGPKEESKETPDISITPSDVAEPLHETIVSEPAEIQSEEEEIEAQGEYDKLLFRSDTLQITDLGVSGAREEFVETCPSEHKGVIESVVTIEDDFITVVQTTTDEGESGSHSVRFAALEQPEVERRPSPHDEEEFEVEEAAEAQAEPKDGSPEAPASPEREEVALSEYKTETYDDYKDETTIDDSIMDADSLWVDTQDDDRSIMTEQLETIPKEEKAEKEARRSSLEKHRKEKPFKTGRGRISTPERKVAKKEPSTVSRDEVRRKKAVYKKAELAKKTEVQAHSPSRKFILKPAIKYTRPTHLSCVKRKTTAAGGESALAPSVFKQAKDKVSDGVTKSPEKRSSLPRPSSILPPRRGVSGDRDENSFSLNSSISSSARRTTRSEPIRRAGKSGTSTPTTPGSTAITPGTPPSYSSRTPGTPGTPSYPRTPHTPGTPKSAILVPSEKKVAIIRTPPKSPATPKQLRLINQPLPDLKNVKSKIGSTDNIKYQPKGGQVRILNKKIDFSKVQSRCGSKDNIKHSAGGGNVQIVTKKIDLSHVTSKCGSLKNIRHRPGGGRVKIESVKLDFKEKAQAKVGSLDNAHHVPGGGNVKIDSQKLNFREHAKARVDHGAEIITQSPGRSSVASPRRLSNVSSSGSINLLESPQLATLAEDVTAALAKQGL

SEQ ID NO: 834706 - protein, 1827 aa, Homo sapiens; identical to SEQ ID NO: 834702

SEQ ID NO: 834707 - protein, 1940 aa, Homo sapiens
MADERKDEAKAPHWTSAPLTEASAHSHPPEIKDQGGAGEGLVRSANGFPYREDEEGAFGEHGSQGTYSNTKENGINGELTSADRETAEEVSARIVQVVTAEAVAVLKGEQEKEAQHKDQTAALPLAAEETANLPPSPPPSPASEQTVTVEEEEETLESRMAEEEKPAALPEKECGAAKSSDQPKGLSKGQMESSAEAQIVPEESAPAGAPHEKSVKEVKEVSPEVKTPSSAGEDLLTASKMEFHDQQELTPSTAEPSDQKEKESEKQSKPGEDLKHAALVSQPETTKTYPDKKDMQGTEEEKAPLALFGHTLVASLEDMKQKTEPSLVVPGIDLPKEPPTPKEQKDWFIEMPTEAKKDEWGLVAPISPGPLTPMREKDVFDDIPKWEGKQFDSPMPSPFQGGSFTLPLDVMKNEIVTETSPFAPAFLQPDDKKSLQQTSGPATAKDSFKIEEPHEAKPDKMAEAPPSEAMTLPKDAHIPVVEEHVMGKVLEEEKEAINQETVQQRDTFTPSGQEPILTEKETELKLEEKTTISDKEAVPKESKPPKPADEEIGIIQTSTEHTFSEQKDQEPTTDMLKQDSFPVSLEQAVTDSAMTSKTLEKAMTEPSALIEKSSIQELFEMRVDDKDKIEGVGAATSAELDMPFYEDKSGMSKYFETSALKEEATKSIEPGSDYYELSDTRESVHESIDTMSPMHKNGDKEFQTGKESQPSPPAQEAGYSTLAQSYPSDLPEEPSSPQERMFTIDPKVYGEKRDLHSKNKDDLTLSRSLGLGGRSAIEQRSMSINLPMSCLDSIALGFNFGRGHDLSPLASDILTNTSGSMDEGDDYLPATTPALEKAPCFPVESKEEEQIEKVKATGEESTQAEISCESPFLAKDFYKNGTVMAPDLPEMLDLAGTRSRLASVSADAEVARRKSVPSETVVEDSRTGLPPVTDENHVIVKTDSQLEDLGYCVFNKYTVPLPSPVQDSENLSGESGTFYEGTDDKVRRDLATDLSLIEVKLAAAGRVKDEFSVDKEASAHISGDKSGLSKEFDQEKKANDRLDTVLEKSEEHADSKEHAKKTEEAGDEIETFGLGVTYEQALAKDLSIPTDASSEKAEKGLSSVPEIAEVEPSKKVEQGLDFAVQGQLDVKISDFGQMASGLNIDDRRATELKLEATQDMTPSSKAPQEADAFMGVESGHMKEGTKVSETEVKQKVAKPDLVHQEAVDKEESYESSGEHESLTMESLKADEGKKETSPESSLIQDEIAVKLSVEIPCPPAVSEADLATDERADVQMEFIQGPKEESKETPDISITPSDVAEPLHETIVSEPAEIQSEEEEIEAQGEYDKLLFRSDTLQITDLGVSGAREEFVETCPSEHKGVIESVVTIEDDFITVVQTTTDEGESGSHSVRFAALEQPEVERRPSPHDEEEFEVEEAAEAQAEPKDGSPEAPASPEREEVALSEYKTETYDDYKDETTIDDSIMDADSLWVDTQDDDRSIMTEQLETIPKEEKAEKEARRSSLEKHRKEKPFKTGRGRISTPERKVAKKEPSTVSRDEVRRKKAVYKKAELAKKTEVQAHSPSRKFILKPAIKYTRPTHLSCVKRKTTAAGGESALAPSVFKQAKDKVSDGVTKSPEKRSSLPRPSSILPPRRGVSGDRDENSFSLNSSISSSARRTTRSEPIRRAGKSGTSTPTTPGSTAITPGTPPSYSSRTPGTPGTPSYPRTPHTPGTPKSAILVPSEKKVAIIRTPPKSPATPKQLRLINQPLPDLKNVKSKIGSTDNIKYQPKGGQVRILNKKIDFSKVQSRCGSKDNIKHSAGGGNVQIVTKKIDLSHVTSKCGSLKNIRHRPGGGRVKIESVKLDFKEKAQAKVGSLDNAHHVPGGGNVKIDSQKLNFREHAKARVDHGAEIITQSPGRSSVASPRRLSNVSSSGSINLLESPQLATLAEDVTAALAKQGL

SEQ ID NO: 834708 - protein, 1700 aa, Homo sapiens
MEFHDQQELTPSTAEPSDQKEKESEKQSKPGEDLKHAALVSQPETTKTYPDKKDMQGTEEEKAPLALFGHTLVASLEDMKQKTEPSLVVPGIDLPKEPPTPKEQKDWFIEMPTEAKKDEWGLVAPISPGPLTPMREKDVFDDIPKWEGKQFDSPMPSPFQGGSFTLPLDVMKNEIVTETSPFAPAFLQPDDKKSLQQTSGPATAKDSFKIEEPHEAKPDKMAEAPPSEAMTLPKDAHIPVVEEHVMGKVLEEEKEAINQETVQQRDTFTPSGQEPILTEKETELKLEEKTTISDKEAVPKESKPPKPADEEIGIIQTSTEHTFSEQKDQEPTTDMLKQDSFPVSLEQAVTDSAMTSKTLEKAMTEPSALIEKSSIQELFEMRVDDKDKIEGVGAATSAELDMPFYEDKSGMSKYFETSALKEEATKSIEPGSDYYELSDTRESVHESIDTMSPMHKNGDKEFQTGKESQPSPPAQEAGYSTLAQSYPSDLPEEPSSPQERMFTIDPKVYGEKRDLHSKNKDDLTLSRSLGLGGRSAIEQRSMSINLPMSCLDSIALGFNFGRGHDLSPLASDILTNTSGSMDEGDDYLPATTPALEKAPCFPVESKEEEQIEKVKATGEESTQAEISCESPFLAKDFYKNGTVMAPDLPEMLDLAGTRSRLASVSADAEVARRKSVPSETVVEDSRTGLPPVTDENHVIVKTDSQLEDLGYCVFNKYTVPLPSPVQDSENLSGESGTFYEGTDDKVRRDLATDLSLIEVKLAAAGRVKDEFSVDKEASAHISGDKSGLSKEFDQEKKANDRLDTVLEKSEEHADSKEHAKKTEEAGDEIETFGLGVTYEQALAKDLSIPTDASSEKAEKGLSSVPEIAEVEPSKKVEQGLDFAVQGQLDVKISDFGQMASGLNIDDRRATELKLEATQDMTPSSKAPQEADAFMGVESGHMKEGTKVSETEVKQKVAKPDLVHQEAVDKEESYESSGEHESLTMESLKADEGKKETSPESSLIQDEIAVKLSVEIPCPPAVSEADLATDERADVQMEFIQGPKEESKETPDISITPSDVAEPLHETIVSEPAEIQSEEEEIEAQGEYDKLLFRSDTLQITDLGVSGAREEFVETCPSEHKGVIESVVTIEDDFITVVQTTTDEGESGSHSVRFAALEQPEVERRPSPHDEEEFEVEEAAEAQAEPKDGSPEAPASPEREEVALSEYKTETYDDYKDETTIDDSIMDADSLWVDTQDDDRSIMTEQLETIPKEEKAEKEARRSSLEKHRKEKPFKTGRGRISTPERKVAKKEPSTVSRDEVRRKKAVYKKAELAKKTEVQAHSPSRKFILKPAIKYTRPTHLSCVKRKTTAAGGESALAPSVFKQAKDKVSDGVTKSPEKRSSLPRPSSILPPRRGVSGDRDENSFSLNSSISSSARRTTRSEPIRRAGKSGTSTPTTPGSTAITPGTPPSYSSRTPGTPGTPSYPRTPHTPGTPKSAILVPSEKKVAIIRTPPKSPATPKQLRLINQPLPDLKNVKSKIGSTDNIKYQPKGGQVRILNKKIDFSKVQSRCGSKDNIKHSAGGGNVQIVTKKIDLSHVTSKCGSLKNIRHRPGGGRVKIESVKLDFKEKAQAKVGSLDNAHHVPGGGNVKIDSQKLNFREHAKARVDHGAEIITQSPGRSSVASPRRLSNVSSSGSINLLESPQLATLAEDVTAALAKQGL

SEQ ID NO: 834709 - protein, 471 aa, Homo sapiens
MADERKDEAKAPHWTSAPLTEASAHSHPPEIKDQGGAGEGLVRSANGFPYREDEEGAFGEHGSQGTYSNTKENGINGELTSADRETAEEVSARIVQVVTAEAVAVLKGEQEKEAQHKDQTAALPLAAEETANLPPSPPPSPASEQTVTVEEAAGGESALAPSVFKQAKDKVSDGVTKSPEKRSSLPRPSSILPPRRGVSGDRDENSFSLNSSISSSARRTTRSEPIRRAGKSGTSTPTTPGSTAITPGTPPSYSSRTPGTPGTPSYPRTPHTPGTPKSAILVPSEKKVAIIRTPPKSPATPKQLRLINQPLPDLKNVKSKIGSTDNIKYQPKGGQVQIVTKKIDLSHVTSKCGSLKNIRHRPGGGRVKIESVKLDFKEKAQAKVGSLDNAHHVPGGGNVKIDSQKLNFREHAKARVDHGAEIITQSPGRSSVASPRRLSNVSSSGSINLLESPQLATLAEDVTAALAKQGL

SEQ ID NO: 834710 - protein, 502 aa, Homo sapiens
MADERKDEAKAPHWTSAPLTEASAHSHPPEIKDQGGAGEGLVRSANGFPYREDEEGAFGEHGSQGTYSNTKENGINGELTSADRETAEEVSARIVQVVTAEAVAVLKGEQEKEAQHKDQTAALPLAAEETANLPPSPPPSPASEQTVTVEEAAGGESALAPSVFKQAKDKVSDGVTKSPEKRSSLPRPSSILPPRRGVSGDRDENSFSLNSSISSSARRTTRSEPIRRAGKSGTSTPTTPGSTAITPGTPPSYSSRTPGTPGTPSYPRTPHTPGTPKSAILVPSEKKVAIIRTPPKSPATPKQLRLINQPLPDLKNVKSKIGSTDNIKYQPKGGQVRILNKKIDFSKVQSRCGSKDNIKHSAGGGNVQIVTKKIDLSHVTSKCGSLKNIRHRPGGGRVKIESVKLDFKEKAQAKVGSLDNAHHVPGGGNVKIDSQKLNFREHAKARVDHGAEIITQSPGRSSVASPRRLSNVSSSGSINLLESPQLATLAEDVTAALAKQGL

SEQ ID NO: 834711 - protein, 111 aa, Homo sapiens
MRIPSLSTVLSLLQHGGPPGQSQFAEQGRVVPQHPLPLGLLPSLLAPHQVILHAHQALLEPLAIPGPLTHQEPPSLPSWCRVRRRSPSYVLLQNLLRLPSSFGLLTNHCQT

SEQ ID NO: 834712 - protein, 1799 aa, Homo sapiens
MADERKDEAKAPHWTSAPLTEASAHSHPPEIKDQGGAGEGLVRSANGFPYREDEEGAFGEHGSQGTYSNTKENGINGELTSADRETAEEVSARIVQVVTAEAVAVLKGEQEKEAQHKDQTAALPLAAEETANLPPSPPPSPASEQTVTVEEDLLTASKMEFHDQQELTPSTAEPSDQKEKESEKQSKPGEDLKHAALVSQPETTKTYPDKKDMQGTEEEKAPLALFGHTLVASLEDMKQKTEPSLVVPGIDLPKEPPTPKEQKDWFIEMPTEAKKDEWGLVAPISPGPLTPMREKDVFDDIPKWEGKQFDSPMPSPFQGGSFTLPLDVMKNEIVTETSPFAPAFLQPDDKKSLQQTSGPATAKDSFKIEEPHEAKPDKMAEAPPSEAMTLPKDAHIPVVEEHVMGKVLEEEKEAINQETVQQRDTFTPSGQEPILTEKETELKLEEKTTISDKEAVPKESKPPKPADEEIGIIQTSTEHTFSEQKDQEPTTDMLKQDSFPVSLEQAVTDSAMTSKTLEKAMTEPSALIEKSSIQELFEMRVDDKDKIEGVGAATSAELDMPFYEDKSGMSKYFETSALKEEATKSIEPGSDYYELSDTRESVHESIDTMSPMHKNGDKEFQTGKESQPSPPAQEAGYSTLAQSYPSDLPEEPSSPQERMFTIDPKVYGEKRDLHSKNKDDLTLSRSLGLGGRSAIEQRSMSINLPMSCLDSIALGFNFGRGHDLSPLASDILTNTSGSMDEGDDYLPATTPALEKAPCFPVESKEEEQIEKVKATGEESTQAEISCESPFLAKDFYKNGTVMAPDLPEMLDLAGTRSRLASVSADAEVARRKSVPSETVVEDSRTGLPPVTDENHVIVKTDSQLEDLGYCVFNKYTVPLPSPVQDSENLSGESGTFYEGTDDKVRRDLATDLSLIEVKLAAAGRVKDEFSVDKEASAHISGDKSGLSKEFDQEKKANDRLDTVLEKSEEHADSKEHAKKTEEAGDEIETFGLGVTYEQALAKDLSIPTDASSEKAEKGLSSVPEIAEVEPSKKVEQGLDFAVQGQLDVKISDFGQMASGLNIDDRRATELKLEATQDMTPSSKAPQEADAFMGVESGHMKEGTKVSETEVKQKVAKPDLVHQEAVDKEESYESSGEHESLTMESLKADEGKKETSPESSLIQDEIAVKLSVEIPCPPAVSEADLATDERADVQMEFIQGPKEESKETPDISITPSDVAEPLHETIVSEPAEIQSEEEEIEAQGEYDKLLFRSDTLQITDLGVSGAREEFVETCPSEHKGVIESVVTIEDDFITVVQTTTDEGESGSHSVRFAALEQPEVERRPSPHDEEEFEVEEAAEAQAEPKDGSPEAPASPEREEVALSEYKTETYDDYKDETTIDDSIMDADSLWVDTQDDDRSIMTEQLETIPKEEKAEKEARRSSLEKHRKEKPFKTGRGRISTPERKVAKKEPSTVSRDEVRRKKAVYKKAELAKKTEVQAHSPSRKFILKPAIKYTRPTHLSCVKRKTTAAGGESALAPSVFKQAKDKVSDGVTKSPEKRSSLPRPSSILPPRRGVSGDRDENSFSLNSSISSSARRTTRSEPIRRAGKSGTSTPTTPGSTAITPGTPPSYSSRTPGTPGTPSYPRTPHTPGTPKSAILVPSEKKVAIIRTPPKSPATPKQLRLINQPLPDLKNVKSKIGSTDNIKYQPKGGQVRILNKKIDFSKVQSRCGSKDNIKHSAGGGNVQIVTKKIDLSHVTSKCGSLKNIRHRPGGGRVKIESVKLDFKEKAQAKVGSLDNAHHVPGGGNVKIDSPKVAFKKAA

SEQ ID NO: 834713 - protein, 1695 aa, Homo sapiens
MADERKDEAKAPHWTSAPLTEASAHSHPPEIKDQGGAGEGLVRSANGFPYREDEEGAFGEHGSQGTYSNTKENGINGELTSADRETAEEVSARIVQVVTAEAVAVLKGEQEKEAQHKDQTAALPLAAEETANLPPSPPPSPASEQTVTVEEDLLTASKMEFHDQQELTPSTAEPSDQKEKESEKQSKPGEDLKHAALVSQPETTKTYPDKKDMQGTEEEKAPLALFGHTLVASLEDMKQKTEPSLVVPGIDLPKEPPTPKEQKDWFIEMPTEAKKDEWGLVAPISPGPLTPMREKDVFDDIPKWEGKQFDSPMPSPFQGGSFTLPLDVMKNEIVTETSPFAPAFLQPDDKKSLQQTSGPATAKDSFKIEEPHEAKPDKMAEAPPSEAMTLPKDAHIPVVEEHVMGKVLEEEKEAINQETVQQRDTFTPSGQEPILTEKETELKLEEKTTISDKEAVPKESKPPKPADEEIGIIQTSTEHTFSEQKDQEPTTDMLKQDSFPVSLEQAVTDSAMTSKTLEKAMTEPSALIEKSSIQELFEMRVDDKDKIEGVGAATSAELDMPFYEDKSGMSKYFETSALKEEATKSIEPGSDYYELSDTRESVHESIDTMSPMHKNGDKEFQTGKESQPSPPAQEAGYSTLAQSYPSDLPEEPSSPQERMFTIDPKVYGEKRDLHSKNKDDLTLSRSLGLGGRSAIEQRSMSINLPMSCLDSIALGFNFGRGHDLSPLASDILTNTSGSMDEGDDYLPATTPALEKAPCFPVESKEEEQIEKVKATGEESTQAEISCESPFLAKDFYKNGTVMAPDLPEMLDLAGTRSRLASVSADAEVARRKSVPSETVVEDSRTGLPPVTDENHVIVKTDSQLEDLGYCVFNKYTVPLPSPVQDSENLSGESGTFYEGTDDKVRRDLATDLSLIEVKLAAAGRVKDEFSVDKEASAHISGDKSGLSKEFDQEKKANDRLDTVLEKSEEHADSKEHAKKTEEAGDEIETFGLGVTYEQALAKDLSIPTDASSEKAEKGLSSVPEIAEVEPSKKVEQGLDFAVQGQLDVKISDFGQMASGLNIDDRRATELKLEATQDMTPSSKAPQEADAFMGVESGHMKEGTKVSETEVKQKVAKPDLVHQEAVDKEESYESSGEHESLTMESLKADEGKKETSPESSLIQDEIAVKLSVEIPCPPAVSEADLATDERADVQMEFIQGPKEESKETPDISITPSDVAEPLHETIVSEPAEIQSEEEEIEAQGEYDKLLFRSDTLQITDLGVSGAREEFVETCPSEHKGVIESVVTIEDDFITVVQTTTDEGESGSHSVRFAALEQPEVERRPSPHDEEEFEVEEAAEAQAEPKDGSPEAPASPEREEVALSEYKTETYDDYKDETTIDDSIMDADSLWVDTQDDDRSIMTEQLETIPKEEKAEKEARRSSLEKHRKEKPFKTGRGRISTPERKVAKKEPSTVSRDEVRRKKAVYKKAELAKKTEVQAHSPSRKFILKPAIKYTRPTHLSCVKRKTTAAGGESALAPSVFKQAKDKVSDGVTKSPEKRSSLPRPSSILPPRRGVSGDRDENSFSLNSSISSSARRTTRSEPIRRAGKSGTSTPTTPGSTAITPGTPPSYSSRTPGTPGTPSYPRTPHTPGTPKSAILVPSEKKVAIIRTPPKSPATPKQLRLINQPLPDLKNVKSKIGSTDNIKYQPKGGQVRIA

SEQ ID NO: 834714 - protein, 307 aa, Homo sapiens
MADERKDEAKAPHWTSAPLTEASAHSHPPEIKDQGGAGEGLVRSANGFPYREDEEGAFGEHGSQGTYSNTKENGINGELTSADRETAEEVSARIVQVVTAEAVAVLKGEQEKEAQHKDQTAALPLAAEETANLPPSPPPSPASEQTVTVEEEEETLESRMAEEEKPAALPEKECGAAKSSDQPKGLSKGQMESSAEAQIVPEESAPAGAPHEKSVKEVKEVSPEVKTPSSAGEGVSFSGFACVLLQMISPVAYQPDAFPTLFRYFIAGSYDNKSTVVGLMCRECGLRKCCVAAGFPVLQLIPGFPLP

SEQ ID NO: 834715 - protein, 191 aa, Homo sapiens
MADERKDEAKAPHWTSAPLTEASAHSHPPEIKDQGGAGEGLVRSANGFPYREDEEGAFGEHGSQGTYSNTKENGINGELTSADRETAEEVSARIVQVVTAEAVAVLKGEQEKEAQHKDQTAALPLAAEETANLPPSPPPSPASEQTVTVEEAAGGESALAPSVFKQAKDKVSNSTLSKIPALQGSTKSPRY

SEQ ID NO: 834716 - protein, 1827 aa, Homo sapiens; identical to SEQ ID NO: 834702

SEQ ID NO: 834717 - protein, 1827 aa, Homo sapiens; identical to SEQ ID NO: 834702

SEQ ID NO: 834718 - protein, 1827 aa, Homo sapiens; identical to SEQ ID NO: 834702

SEQ ID NO: 834719 - protein, 1827 aa, Homo sapiens; identical to SEQ ID NO: 834702

SEQ ID NO: 834720 - protein, 1827 aa, Homo sapiens; identical to SEQ ID NO: 834702

SEQ ID NO: 834721 - protein, 111 aa, Homo sapiens; identical to SEQ ID NO: 834711

SEQ ID NO: 834722 - protein, 1640 aa, Homo sapiens
MADERKDEAKAPHWTSAPLTEASAHSHPPEIKDQGGAGEGLVRSANGFPYREDEEGAFGEHGSQGTYSNTKENGINGELTSADRETAEEVSARIVQVVTAEAVAVLKGEQEKEAQHKDQTAALPLAAEETANLPPSPPPSPASEQTVTVEEDLLTASKMEFHDQQELTPSTAEPSDQKEKESEKQSKPGEDLKHAALVSQPETTKTYPDKKDMQGTEEEKAPLALFGHTLVASLEDMKQKTEPSLVVPGIDLPKEPPTPKEQKDWFIEMPTEAKKDEWGLVAPISPGPLTPMREKDVFDDIPKWEGKQFDSPMPSPFQGGSFTLPLDVMKNEIVTETSPFAPAFLQPDDKKSLQQTSGPATAKDSFKIEEPHEAKPDKMAEAPPSEAMTLPKDAHIPVVEEHVMGKVLEEEKEAINQETVQQRDTFTPSGQEPILTEKETELKLEEKTTISDKEAVPKESKPPKPADEEIGIIQTSTEHTFSEQKDQEPTTDMLKQDSFPVSLEQAVTDSAMTSKTLEKAMTEPSALIEKSSIQELFEMRVDDKDKIEGVGAATSAELDMPFYEDKSGMSKYFETSALKEEATKSIEPGSDYYELSDTRESVHESIDTMSPMHKNGDKEFQTGKESQPSPPAQEAGYSTLAQSYPSDLPEEPSSPQERMFTIDPKVYGEKRDLHSKNKDDLTLSRSLGLGGRSAIEQRSMSINLPMSCLDSIALGFNFGRGHDLSPLASDILTNTSGSMDEGDDYLPATTPALEKAPCFPVESKEEEQIEKVKATGEESTQAEISCESPFLAKDFYKNGTVMAPDLPEMLDLAGTRSRLASVSADAEVARRKSVPSETVVEDSRTGLPPVTDENHVIVKTDSQLEDLGYCVFNKYTVPLPSPVQDSENLSGESGTFYEGTDDKVRRDLATDLSLIEVKLAAAGRVKDEFSVDKEASAHISGDKSGLSKEFDQEKKANDRLDTVLEKSEEHADSKEHAKKTEEAGDEIETFGLGVTYEQALAKDLSIPTDASSEKAEKGLSSVPEIAEVEPSKKVEQGLDFAVQGQLDVKISDFGQMASGLNIDDRRATELKLEATQDMTPSSKAPQEADAFMGVESGHMKEGTKVSETEVKQKVAKPDLVHQEAVDKEESYESSGEHESLTMESLKADEGKKETSPESSLIQDEIAVKLSVEIPCPPAVSEADLATDERADVQMEFIQGPKEESKETPDISITPSDVAEPLHETIVSEPAEIQSEEEEIEAQGEYDKLLFRSDTLQITDLGVSGAREEFVETCPSEHKGVIESVVTIEDDFITVVQTTTDEGESGSHSVRFAALEQPEVERRPSPHDEEEFEVEEAAEAQAEPKDGSPEAPASPEREEVALSEYKTETYDDYKDETTIDDSIMDADSLWVDTQDDDRSIMTEQLETIPKEEKAEKEARRSSLEKHRKEKPFKTGRGRISTPERKVAKKEPSTVSRDEVRRKKAVYKKAELAKKTEVQAHSPSRKFILKPAIKYTRPTHLSCVKRKTTAAGGESALAPSVFKQAKDKVSDGVTKSPEKRSSLPRPSSILPPRRGVSGDRDENSFSLNSSISSSARRTTRSEPIRRAGKSGTSTPTTPGSTAITPGTPPSYSSHTHTHTHTPTVIQQAWNNQPIYNIPSVFY

SEQ ID NO: 834723 - protein, 1694 aa, Homo sapiens
MADERKDEAKAPHWTSAPLTEASAHSHPPEIKDQGGAGEGLVRSANGFPYREDEEGAFGEHGSQGTYSNTKENGINGELTSADRETAEEVSARIVQVVTAEAVAVLKGEQEKEAQHKDQTAALPLAAEETANLPPSPPPSPASEQTVTVEEDLLTASKMEFHDQQELTPSTAEPSDQKEKESEKQSKPGEDLKHAALVSQPETTKTYPDKKDMQGTEEEKAPLALFGHTLVASLEDMKQKTEPSLVVPGIDLPKEPPTPKEQKDWFIEMPTEAKKDEWGLVAPISPGPLTPMREKDVFDDIPKWEGKQFDSPMPSPFQGGSFTLPLDVMKNEIVTETSPFAPAFLQPDDKKSLQQTSGPATAKDSFKIEEPHEAKPDKMAEAPPSEAMTLPKDAHIPVVEEHVMGKVLEEEKEAINQETVQQRDTFTPSGQEPILTEKETELKLEEKTTISDKEAVPKESKPPKPADEEIGIIQTSTEHTFSEQKDQEPTTDMLKQDSFPVSLEQAVTDSAMTSKTLEKAMTEPSALIEKSSIQELFEMRVDDKDKIEGVGAATSAELDMPFYEDKSGMSKYFETSALKEEATKSIEPGSDYYELSDTRESVHESIDTMSPMHKNGDKEFQTGKESQPSPPAQEAGYSTLAQSYPSDLPEEPSSPQERMFTIDPKVYGEKRDLHSKNKDDLTLSRSLGLGGRSAIEQRSMSINLPMSCLDSIALGFNFGRGHDLSPLASDILTNTSGSMDEGDDYLPATTPALEKAPCFPVESKEEEQIEKVKATGEESTQAEISCESPFLAKDFYKNGTVMAPDLPEMLDLAGTRSRLASVSADAEVARRKSVPSETVVEDSRTGLPPVTDENHVIVKTDSQLEDLGYCVFNKYTVPLPSPVQDSENLSGESGTFYEGTDDKVRRDLATDLSLIEVKLAAAGRVKDEFSVDKEASAHISGDKSGLSKEFDQEKKANDRLDTVLEKSEEHADSKEHAKKTEEAGDEIETFGLGVTYEQALAKDLSIPTDASSEKAEKGLSSVPEIAEVEPSKKVEQGLDFAVQGQLDVKISDFGQMASGLNIDDRRATELKLEATQDMTPSSKAPQEADAFMGVESGHMKEGTKVSETEVKQKVAKPDLVHQEAVDKEESYESSGEHESLTMESLKADEGKKETSPESSLIQDEIAVKLSVEIPCPPAVSEADLATDERADVQMEFIQGPKEESKETPDISITPSDVAEPLHETIVSEPAEIQSEEEEIEAQGEYDKLLFRSDTLQITDLGVSGAREEFVETCPSEHKGVIESVVTIEDDFITVVQTTTDEGESGSHSVRFAALEQPEVERRPSPHDEEEFEVEEAAEAQAEPKDGSPEAPASPEREEVALSEYKTETYDDYKDETTIDDSIMDADSLWVDTQDDDRSIMTEQLETIPKEEKAEKEARRSSLEKHRKEKPFKTGRGRISTPERKVAKKEPSTVSRDEVRRKKAVYKKAELAKKTEVQAHSPSRKFILKPAIKYTRPTHLSCVKRKTTAAGGESALAPSVFKQAKDKVSDGVTKSPEKRSSLPRPSSILPPRRGVSGDRDENSFSLNSSISSSARRTTRSEPIRRAGKSGTSTPTTPGSTAITPGTPPSYSSRTPGTPGTPSYPRTPHTPGTPKSAILVPSEKKVAIIRTPPKSPATPKQLRLINQPLPDLKNVKSKIGSTDNIKYQPKGGQDFL

SEQ ID NO: 834724 - protein, 68 aa, Homo sapiens
EIADKLVECKDSSPSGLSVLQARLTELAEAAILNKRPGLLGGRRGPDSLAEQPPRLRGEGEVLYGWEG

SEQ ID NO: 834725 - protein, 727 aa, Homo sapiens
MLRIPVRKALVGLSKSPKGCVRTTATAASNLIEVFVDGQSVMVEPGTTVLQACEKVGMQIPRFCYHERLSVAGNCRMCLVEIEKAPKVVAACAMPVMKGWNILTNSEKSKKAREGVMEFLLANHPLDCPICDQGGECDLQDQSMMFGNDRSRFLEGKRAVEDKNIGPLVKTIMTRCIQCTRCIRFASEIAGVDDLGTTGRGNDMQVGTYIEKMFMSELSGNIIDICPVGALTSKPYAFTARPWETRKTESIDVMDAVGSNIVVSTRTGEVMRILPRMHEDINEEWISDKTRFAYDGLKRQRLTEPMVRNEKGLLTYTSWEDALSRVAGMLQSFQGKDVAAIAGGLVDAEALVALKDLLNRVDSDTLCTEEVFPTAGAGTDLRSNYLLNTTIAGVEEADVVLLVGTNPRFEAPLFNARIRKSWLHNDLKVALIGSPVDLTYTYDHLGDSPKILQDIASGSHPFSQVLKEAKKPMVVLGSSALQRNDGAAILAAVSSIAQKIRMTSGVTGDWKVMNILHRIASQVAALDLGYKPGVEAIRKNPPKVLFLLGADGGCITRQDLPKDCFIIYQGHHGDVGAPIADVILPGAAYTEKSATYVNTEGRAQQTKVAVTPPGLAREDWKIIRALSEIAGMTLPYDTLDQVRNRLEEVSPNLVRYDDIEGANYFQQANELSKLVNQQLLADPLVPPQLTIKDFYMTDSISRASQTMAKCVKAVTEGAQAVEEPSIC

SEQ ID NO: 834726 - protein, 758 aa, Homo sapiens
RDAWAERVGRPTRRQNRQFSRTASAAPGRSNMLRIPVRKALVGLSKSPKGCVRTTATAASNLIEVFVDGQSVMVEPGTTVLQACEKVGMQIPRFCYHERLSVAGNCRMCLVEIEKAPKVVAACAMPVMKGWNILTNSEKSKKAREGVMEFLLANHPLDCPICDQGGECDLQDQSMMFGNDRSRFLEGKRAVEDKNIGPLVKTIMTRCIQCTRCIRFASEIAGVDDLGTTGRGNDMQVGTYIEKMFMSELSGNIIDICPVGALTSKPYAFTARPWETRKTESIDVMDAVGSNIVVSTRTGEVMRILPRMHEDINEEWISDKTRFAYDGLKRQRLTEPMVRNEKGLLTYTSWEDALSRVAGMLQSFQGKDVAAIAGGLVDAEALVALKDLLNRVDSDTLCTEEVFPTAGAGTDLRSNYLLNTTIAGVEEADVVLLVGTNPRFEAPLFNARIRKSWLHNDLKVALIGSPVDLTYTYDHLGDSPKILQDIASGSHPFSQVLKEAKKPMVVLGSSALQRNDGAAILAAVSSIAQKIRMTSGVTGDWKVMNILHRIASQVAALDLGYKPGVEAIRKNPPKVLFLLGADGGCITRQDLPKDCFIIYQGHHGDVGAPIADVILPGAAYTEKSATYVNTEGRAQQTKVAVTPPGLAREDWKIIRALSEIAGMTLPYDTLDQVRNRLEEVSPNLVRYDDIEGANYFQQANELSKLVNQQLLADPLVPPQLTIKDFYMTDSISRASQTMAKCVKAVTEGAQAVEEPSIC

SEQ ID NO: 834727 - protein, 686 aa, Homo sapiens
MVEPGTTVLQACEKVGMQIPRFCYHERLSVAGNCRMCLVEIEKAPKVVAACAMPVMKGWNILTNSEKSKKAREGVMEFLLANHPLDCPICDQGGECDLQDQSMMFGNDRSRFLEGKRAVEDKNIGPLVKTIMTRCIQCTRCIRFASEIAGVDDLGTTGRGNDMQVGTYIEKMFMSELSGNIIDICPVGALTSKPYAFTARPWETRKTESIDVMDAVGSNIVVSTRTGEVMRILPRMHEDINEEWISDKTRFAYDGLKRQRLTEPMVRNEKGLLTYTSWEDALSRVAGMLQSFQGKDVAAIAGGLVDAEALVALKDLLNRVDSDTLCTEEVFPTAGAGTDLRSNYLLNTTIAGVEEADVVLLVGTNPRFEAPLFNARIRKSWLHNDLKVALIGSPVDLTYTYDHLGDSPKILQDIASGSHPFSQVLKEAKKPMVVLGSSALQRNDGAAILAAVSSIAQKIRMTSGVTGDWKVMNILHRIASQVAALDLGYKPGVEAIRKNPPKVLFLLGADGGCITRQDLPKDCFIIYQGHHGDVGAPIADVILPGAAYTEKSATYVNTEGRAQQTKVAVTPPGLAREDWKIIRALSEIAGMTLPYDTLDQVRNRLEEVSPNLVRYDDIEGANYFQQANELSKLVNQQLLADPLVPPQLTIKDFYMTDSISRASQTMAKCVKAVTEGAQAVEEPSIC

SEQ ID NO: 834728 - protein, 255 aa, Homo sapiens
MVVLGSSALQRNDGAAILAAVSSIAQKIRMTSGVTGDWKVMNILHRIASQVAALDLGYKPGVEAIRKNPPKVLFLLGADGGCITRQDLPKDCFIIYQGHHGDVGAPIADVILPGAAYTEKSATYVNTEGRAQQTKVAVTPPGLAREDWKIIRALSEIAGMTLPYDTLDQVRNRLEEVSPNLVRYDDIEGANYFQQANELSKLVNQQLLADPLVPPQLTIKDFYMTDSISRASQTMAKCVKAVTEGAQAVEEPSIC

SEQ ID NO: 834729 - protein, 424 aa, Homo sapiens
MLRIPVRKALVGLSKSPKGCVRTTATAASNLIEVFVDGQSVMVEPGTTVLQACEKVGMQIPRFCYHERLSVAGNCRMCLVEIEKAPKVVAACAMPVMKGWNILTNSEKSKKAREGVMEFLLANHPLDCPICDQGGECDLQDQSMMFGNDRSRFLEGKRAVEDKNIGPLVKTIMTRCIQCTRCIRFASEIAGVDDLGTTGRGNDMQVGTYIEKMFMSELSGNIIDICPVGALTSKPYAFTARPWETRKTESIDVMDAVGSNIVVSTRTGEVMRILPRMHEDINEEWISDKTRFAYDGLKRQRLTEPMVRNEKGLLTYTSWEDALSRVAGMLQSFQGKDVAAIAGGLVDAEALVALKDLLNRVDSDTLCTEEVFPTAGAGTDLRSNSSIKQWCLKTWVCTNQKNNICLFHTSKCSIKKIIGTSTRP

SEQ ID NO: 834730 - protein, 558 aa, Homo sapiens
MLRIPVRKALVGLSKSPKGCVRTTATAASNLIEVFVDGQSVMVEPGTTVLQACEKVGMQIPRFCYHERLSVAGNCRMCLVEIEKAPKVVAACAMPVMKGWNILTNSEKSKKAREGVMEFLLANHPLDCPICDQGGECDLQDQSMMFGNDRSRFLEGKRAVEDKNIGPLVKTIMTRCIQCTRCIRFASEIAGVDDLGTTGRGNDMQVGTYIEKMFMSELSGNIIDICPVGALTSKPYAFTARPWETRKTESIDVMDAVGSNIVVSTRTGEVMRILPRMHEDINEEWISDKTRFAYDGLKRQRLTEPMVRNEKGLLTYTSWEDALSRVAGMLQSFQGKDVAAIAGGLVDAEALVALKDLLNRVDSDTLCTEEVFPTAGAGTALLRFQAYRSSNTYNLHGCCAQRPDAWLRIWLGTTPYATQRHHLILHCLRIRQRAGLHYTAPYTRGPYQGRSSWTLTLSHYDTNLRHTSPEDILHSTSASRAKPIRIKPTSSTGTLTQHHTAGTKSQFMAHPRTTKRTGRQPTYLGTLDAHAIAQTRSRTDLRERNLARPDTVMNTTNT

SEQ ID NO: 834731 - protein, 77 aa, Homo sapiens
VTRGRSAWVDPRVGEQASAAPGRSNMLRIPVRKALVGLSKSPKGCGEYFLKFAFVDIRPYFCKFISLWHSLSKTLNP

SEQ ID NO: 834732 - protein, 727 aa, Homo sapiens; identical to SEQ ID NO: 834725

SEQ ID NO: 834733 - protein, 286 aa, Homo sapiens
MLRIPVRKALVGLSKSPKGCVRTTATAASNLIEVFVDGQSVMVEPGTTVLQACEKVGMQIPRFCYHERLSVAGNCRMCLVEIEKAPKVVAACAMPVMKGWNILTNSEKSKKAREGVMEFLLANHPLDCPICDQGGECDLQDQSMMFGNDRSRFLEGKRAVEDKNIGPLVKTIMTRCIQCTRCIRFASENAELMIGEPQPRTELHVGPLDEGPRLTAGNSDIAVGPNLSLLKGRLEQEPHPVIGGAALLGSHGSEEISRRVAPRLYTPSGNPPQRTPGLPEKQQVAK

SEQ ID NO: 834734 - protein, 727 aa, Homo sapiens; identical to SEQ ID NO: 834725

SEQ ID NO: 834735 - protein, 727 aa, Homo sapiens; identical to SEQ ID NO: 834725

SEQ ID NO: 834736 - protein, 593 aa, Homo sapiens
MLRIPVRKALVGLSKSPKGCVRTTATAASNLIEVFVDGQSVMVEPGTTVLQACEKVGMQIPRFCYHERLSVAGNCRMCLVEIEKAPKVVAACAMPVMKGWNILTNSEKSKKAREGVMEFLLANHPLDCPICDQGGECDLQDQSMMFGNDRSRFLEGKRAVEDKNIGPLVKTIMTRCIQCTRCIRFASEIAGVDDLGTTGRGNDMQVGTYIEKMFMSELSGNIIDICPVGALTSKPYAFTARPWETRKTESIDVMDAVGSNIVVSTRTGEVMRILPRMHEDINEEWISDKTRFAYDGLKRQRLTEPMVRNEKGLLTYTSWEDALSRVAGMLQSFQGKDVAAIAGGLVDAEALVALKDLLNRVDSDTLCTEEVFPTAGAGTDLRSNYLLNTTIAGVEEADVVLLVGTNPRFEAPLFNARIRKSWLHNDLKVALIGSPVDLTYTYDHLGDSPKILQDIASGSHPFSQVLKEAKKPMVVLGSSALQRNDGAAILAAVSSIAQKIRMTSGVTGDWKVMNILHRIASQVAALDLGYKPGVEAIRKNPPKVLFLLGADGGCITRQDLPKDCFIIYQDIMVMLRLPIDSISGILLESSLQV

SEQ ID NO: 834737 - protein, 1194 aa, Homo sapiens
MASQVLVYPPYVYQTQSSAFCSVKKLKVEPSSCVFQERNYPRTYVNGRNFGNSHPPTKGSAFQTKIPFNRPRGHNFSLQTSAVVLKNTAGATKVIAAQAQQAHVQAPQIGAWRNRLHFLEGPQRCGLKRKSEELDNHSSAMQIVDELSILPAMLQTNMGNPVTVVTATTGSKQNCTTGEGDYQLVQHEVLCSMKNTYEVLDFLGRGTFGQVVKCWKRGTNEIVAIKILKNHPSYARQGQIEVSILARLSTENADEYNFVRAYECFQHRNHTCLVFEMLEQNLYDFLKQNKFSPLPLKVIRPILQQVATALKKLKSLGLIHADLKPENIMLVDPVRQPYRVKVIDFGSASHVSKTVCSTYLQSRYYRAPEIILGLPFCEAIDMWSLGCVIAELFLGWPLYPGALEYDQIRYISQTQGLPGEQLLNVGTKSTRFFCKETDMSHSGWRLKTLEEHEAETGMKSKEARKYIFNSLDDVAHVNTVMDLEGSDLLAEKADRREFVSLLKKMLLIDADLRITPAETLNHPFVNMKHLLDFPHSNHVKSCFHIMDICKSHLNSCDTNNHNKTSLLRPVASSSTATLTANFTKIGTLRSQALTTSAHSVVHHGIPLQAGTAQFGCGDAFQQTLIICPPAIQGIPATHGKPTSYSIRVDNTVPLVTQAPAVQPLQIRPGVLSQTWSGRTQQMLVPAWQQVTPLAPATTTLTSESVAGSHRLGDWGKMISCSNHYNSVMPQPLLTNQITLSAPQPVSVGIAHVVWPQPATTKKNKQCQNRSNSLQNTNIPHSAFISPKIINGKDVEEVSCIETQDNQNSEGEARNCCETSIRQDSDSSVSDKQRQTIIIADSPSPAVSVITISSDTDEEETSQRHSLRECKGSLDCEACQSTLNIDRMCSLSSPDSTLSTSSSGQSSPSPCKRPNSMSDEEQESSCDTVDGSPTSDSSGHDSPFAESTFVEDTHENTELVSSADTETKPAVCSVVVPPVELENGLNADEHMANTDSICQPLIKGRSAPGRLNQPSAVGTRQQKLTSAFQQQHLNFSQVQHFGSGHQEWNGNFGHRRQQAYIPTSVTSNPFTLSHGSPNHTAVHAHLAGNTHLGGQPTLLPYPSSATLSSAAPVAHLLASPCTSRPMLQHPTYNISHPSGIVHQVPVGLNPRLLPSPTIHQTQYKPIFPPHSYIAASPAYTGFPLSPTKLSQYPYM

SEQ ID NO: 834738 - protein, 385 aa, Homo sapiens
MASQVLVYPPYVYQTQSSAFCSVKKLKVEPSSCVFQERNYPRTYVNGRNFGNSHPPTKGSAFQTKIPFNRPRGHNFSLQTSAVVLKNTAGATKVIAAQAQQAHVQAPQIGAWRNRLHFLEGPQRCGLKRKSEELDNHSSAMQIVDELSILPAMLQTNMGNPVTVVTATTGSKQNCTTGEGDYQLVQHEVLCSMKNTYEVLDFLGRGTFGQVVKCWKRGTNEIVAIKILKNHPSYARQGQIEVSILARLSTENADEYNFVRAYECFQHRNHTCLVFEMLEQNLYDFLKQNKFSPLPLKVIRPILQQVATALKKLKSLGLIHADLKPENIMLVDPVRQPYRVKVIDFGSASHVSKTVCSTYLQSRYYRYGLTSLGLPTICLSNSVKC

SEQ ID NO: 834739 - protein, 1215 aa, Homo sapiens
MASQVLVYPPYVYQTQSSAFCSVKKLKVEPSSCVFQERNYPRTYVNGRNFGNSHPPTKGSAFQTKIPFNRPRGHNFSLQTSAVVLKNTAGATKVIAAQAQQAHVQAPQIGAWRNRLHFLEGPQRCGLKRKSEELDNHSSAMQIVDELSILPAMLQTNMGNPVTVVTATTGSKQNCTTGEGDYQLVQHEVLCSMKNTYEVLDFLGRGTFGQVVKCWKRGTNEIVAIKILKNHPSYARQGQIEVSILARLSTENADEYNFVRAYECFQHRNHTCLVFEMLEQNLYDFLKQNKFSPLPLKVIRPILQQVATALKKLKSLGLIHADLKPENIMLVDPVRQPYRVKVIDFGSASHVSKTVCSTYLQSRYYRAPEIILGLPFCEAIDMWSLGCVIAELFLGWPLYPGALEYDQIRYISQTQGLPGEQLLNVGTKSTRFFCKETDMSHSGWRLKTLEEHEAETGMKSKEARKYIFNSLDDVAHVNTVMDLEGSDLLAEKADRREFVSLLKKMLLIDADLRITPAETLNHPFVNMKHLLDFPHSNHVKSCFHIMDICKSHLNSCDTNNHNKTSLLRPVASSSTATLTANFTKIGTLRSQALTTSAHSVVHHGIPLQAGTAQFGCGDAFQQTLIICPPAIQGIPATHGKPTSYSIRVDNTVPLVTQAPAVQPLQIRPGVLSQTWSGRTQQMLVPAWQQVTPLAPATTTLTSESVAGSHRLGDWGKMISCSNHYNSVMPQPLLTNQITLSAPQPVSVGIAHVVWPQPATTKKNKQCQNRGILVKLMEWEPGREEINAFSWSNSLQNTNIPHSAFISPKIINGKDVEEVSCIETQDNQNSEGEARNCCETSIRQDSDSSVSDKQRQTIIIADSPSPAVSVITISSDTDEEETSQRHSLRECKGSLDCEACQSTLNIDRMCSLSSPDSTLSTSSSGQSSPSPCKRPNSMSDEEQESSCDTVDGSPTSDSSGHDSPFAESTFVEDTHENTELVSSADTETKPAVCSVVVPPVELENGLNADEHMANTDSICQPLIKGRSAPGRLNQPSAVGTRQQKLTSAFQQQHLNFSQVQHFGSGHQEWNGNFGHRRQQAYIPTSVTSNPFTLSHGSPNHTAVHAHLAGNTHLGGQPTLLPYPSSATLSSAAPVAHLLASPCTSRPMLQHPTYNISHPSGIVHQVPVGLNPRLLPSPTIHQTQYKPIFPPHSYIAASPAYTGFPLSPTKLSQYPYM

SEQ ID NO: 834740 - protein, 1149 aa, Homo sapiens
MASQVLVYPPYVYQTQSSAFCSVKKLKVEPSSCVFQERNYPRTYVNGRNFGNSHPPTKGSAFQTKIPFNRPRGHNFSLQTSAVVLKNTAGATKVIAAQAQQAHVQAPQIGAWRNRLHFLEGPQRCGLKRKSEELDNHSSAMQIVDELSILPAMLQTNMGNPVTVVTATTGSKQNCTTGEGDYQLVQHEVLCSMKNTYEVLDFLGRGTFGQVVKCWKRGTNEIVAIKILKNHPSYARQGQIEVSILARLSTENADEYNFVRAYECFQHRNHTCLVFEMLEQNLYDFLKQNKFSPLPLKVIRPILQQVATALKKLKSLGLIHADLKPENIMLVDPVRQPYRVKVIDFGSASHVSKTVCSTYLQSRYYRAPEIILGLPFCEAIDMWSLGCVIAELFLGWPLYPGALEYDQIRYISQTQGLPGEQLLNVGTKSTRFFCKETDMSHSGWRLKTLEEHEAETGMKSKEARKYIFNSLDDVAHVNTVMDLEGSDLLAEKADRREFVSLLKKMLLIDADLRITPAETLNHPFVNMKHLLDFPHSNHVKSCFHIMDICKSHLNSCDTNNHNKTSLLRPVASSSTATLTANFTKIGTLRSQALTTSAHSVVHHGIPLQAGTAQFGCGDAFQQTLIICPPAIQGIPATHGKPTSYSIRVDNTVPLVTQAPAVQPLQIRPGVLSQTWSGRTQQMLVPAWQQVTPLAPATTTLTSESVAGSHRLGDWGKMISCSNHYNSVMPQPLLTNQITLSAPQPVSVGIAHVVWPQPATTKKNKQCQNRSNSLQNTNIPHSAFISPKIINGKDVEEVSCIETQDNQNSEGEARNCCETSIRQDSDSSVSDKQRQTIIIADSPSPAVSVITISSDTDEEETSQRHSLRECKGSLDCEACQSTLNIDRMCSLSSPDSTLSTSSSGQSSPSPCKRPNSMSDEEQESSCDTVDGSPTSDSSGHDSPFAESTFVEDTHENTELVSSADTETKPAVCSVVVPPVELENGLNADEHMANTDSICQPLIKGRSAPGRLNQPSAVGTRQQKLTSAFQQQHLNFSQVQHFGSGHQEWNGNFGHRRQQAYIPTSVTSNPFTLSHGSPNHTAVHAHLAGNTHLGGQPTLLPYPSSATLSSAAPVAHLLASPCTSRPMLQLLGRLRQKNCLNQGSTPISAIG

SEQ ID NO: 834741 - protein, 749 aa, Homo sapiens
LNLQLNGMYSKHLQRNEQILEFATEMDDVAHVNTVMDLEGSDLLAEKADRREFVSLLKKMLLIDADLRITPAETLNHPFVNMKHLLDFPHSNHVKSCFHIMDICKSHLNSCDTNNHNKTSLLRPVASSSTATLTANFTKIGTLRSQALTTSAHSVVHHGIPLQAGTAQFGCGDAFQQTLIICPPAIQGIPATHGKPTSYSIRVDNTVPLVTQAPAVQPLQIRPGVLSQTWSGRTQQMLVPAWQQVTPLAPATTTLTSESVAGSHRLGDWGKMISCSNHYNSVMPQPLLTNQITLSAPQPVSVGIAHVVWPQPATTKKNKQCQNRSNSLQNTNIPHSAFISPKIINGKDVEEVSCIETQDNQNSEGEARNCCETSIRQDSDSSVSDKQRQTIIIADSPSPAVSVITISSDTDEEETSQRHSLRECKGSLDCEACQSTLNIDRMCSLSSPDSTLSTSSSGQSSPSPCKRPNSMSDEEQESSCDTVDGSPTSDSSGHDSPFAESTFVEDTHENTELVSSADTETKPAVCSVVVPPVELENGLNADEHMANTDSICQPLIKGRSAPGRLNQPSAVGTRQQKLTSAFQQQHLNFSQVQHFGSGHQEWNGNFGHRRQQAYIPTSVTSNPFTLSHGSPNHTAVHAHLAGNTHLGGQPTLLPYPSSATLSSAAPVAHLLASPCTSRPMLQHPTYNISHPSGIVHQVPVGLNPRLLPSPTIHQTQYKPIFPPHSYIAASPAYTGFPLSPTKLSQYPYM

SEQ ID NO: 834742 - protein, 344 aa, Homo sapiens
MQLEIKVALNFIISYLYNKLPRRRADLFGEELERLLKKKYEGHWYPEKPLKGSGFRCVHIGEMVDPVVELAAKRSGLAVEDVRANVPEELSVWIDPFEVSYQIGEKGAVKVLYLDDSEGCGAPELDKEIKSSFNPDAQVFVPIGSQDSSLSNSPSPSFGQSPSPTFIPRSAQPITFTTASFAATKFGSTKMKKGGGAASGGGVASSGAGGQQPPQQPRMARSPTNSLLKHKSLSLSMHSLNFITANPAPQSQLSPNAKEFVYNGGGSPSLFFDAADGQGSGTPGPFGGSGAGTCNSSSFDMAQVFGGGANSLFLEKTPFVEGLSYNLNTMQYPSQQFQPVVLAN

SEQ ID NO: 834743 - protein, 344 aa, Homo sapiens; identical to SEQ ID NO: 834742

SEQ ID NO: 834744 - protein, 344 aa, Homo sapiens; identical to SEQ ID NO: 834742

SEQ ID NO: 834745 - protein, 341 aa, Homo sapiens
MQLEIKVALNFIISYLYNKLPRRRADLFGEELERLLKKKYEGHWYPEKPLKGSGFRCVHIGEMVDPVVELAAKRSGLAVEDVRANVPEELSVWIDPFEVSYQIGEKGAVKVLYLDDSEGCGAPELDKEIKSSFNPDAQVFVPIGSQDSSLSNSPSPSFGQSPSPTFIPRSAQPITFTTASFAATKFGSTKMKKGGGAASGGGVASSGAGGQQPPQQPRMARSPTNSLLKHKSLSLSMHSLNFITANPAPQSQLSPNAKEFVYNGGGSPSLFFDAADGQGSGTPGPFGGSGAGTCNSSSFDMAQVFGGGANSLFLEKTPFVEGGIEASLERSPGSRVMNFFL

SEQ ID NO: 834746 - protein, 344 aa, Homo sapiens; identical to SEQ ID NO: 834742

SEQ ID NO: 834747 - protein, 344 aa, Homo sapiens; identical to SEQ ID NO: 834742

SEQ ID NO: 834748 - protein, 344 aa, Homo sapiens; identical to SEQ ID NO: 834742

SEQ ID NO: 834749 - protein, 344 aa, Homo sapiens; identical to SEQ ID NO: 834742

SEQ ID NO: 834750 - protein, 158 aa, Homo sapiens
AGRCGLLAEASRGSGDAGPGGQDRLPATAHTVCRCATRTTLRSAIPASSPLVRPPALGPPAAEPDLLRAEKKLLRVIVHSPLLRPPTLNDEKDFGPLARRRPGRKGERPPPRAQATLEGEAAPRPVERPAAAETRSRLEPKAVHVPCADSLPRKGPCS

SEQ ID NO: 834751 - protein, 198 aa, Homo sapiens
MSFIFEWIYNGFSSVLQFLGLYKKSGKLVFLGLDNAGKTTLLHMLKDDRLGQHVPTLHPTSEELTIAGMTFTTFDLGGHEQARRVWKNYLPAINGIVFLVDCADHSRLVESKVELNALMTDETISNVPILILGNKIDRTDAISEEKLREIFGLYGQTTGKGNVTLKELNARPMEVFMCSVLKRQGYGEGFRWLSQYID

SEQ ID NO: 834752 - protein, 198 aa, Homo sapiens; identical to SEQ ID NO: 834751

SEQ ID NO: 834753 - protein, 198 aa, Homo sapiens; identical to SEQ ID NO: 834751

SEQ ID NO: 834754 - protein, 179 aa, Homo sapiens
MSFIFEWIYNGFSSVLQFLGLYKKSGKLVFLGLDNAGKTTLLHMLKDDRLGQHVPTLHPTSEELTIAGMTFTTFDLGGHEQDCADHSRLVESKVELNALMTDETISNVPILILGNKIDRTDAISEEKLREIFGLYGQTTGKGNVTLKELNARPMEVFMCSVLKRQGYGEGFRWLSQYID

SEQ ID NO: 834755 - protein, 198 aa, Homo sapiens; identical to SEQ ID NO: 834751

SEQ ID NO: 834756 - protein, 135 aa, Homo sapiens
MSFIFEWIYNGFSSVLQFLGLYKKSGKLVFLGLDNAGKTTLLHMLKDDRLGQHVPTLHPTSEELTIAGMTFTTFDLGGHEQARRVWKNYLPAINGIVFLVDCADHSRLVESKVELNRQRCAIETSKTMLFLTNQS

SEQ ID NO: 834757 - protein, 68 aa, Homo sapiens
FFSPPAHGPFVDVRNAHCVGNRDLGHYVPGRGVTYIRRVAGGPGCCWLVCSEGGSEPAAVLPEEPLRP

SEQ ID NO: 834758 - protein, 198 aa, Homo sapiens; identical to SEQ ID NO: 834751

SEQ ID NO: 834759 - protein, 198 aa, Homo sapiens; identical to SEQ ID NO: 834751

SEQ ID NO: 834760 - protein, 198 aa, Homo sapiens; identical to SEQ ID NO: 834751

SEQ ID NO: 834761 - protein, 121 aa, Homo sapiens
MSFIFEWIYNGFSSVLQFLGLYKKSGKLVFLGLDNAGKTTLLHMLKDDRLGQHVPTLHPTSEELTIAGMTFTTFDLGGHEQARRVWKNYLPAINGIVFLVDCADHSRLVESKVELNVCFVL

SEQ ID NO: 834762 - protein, 119 aa, Homo sapiens
LHPEDYDTLQEENDETASPADVFYDVSKENENSMVPQGAPVGSLSVKNKAHCLQDFLMDVEKDELDSGEKIHLNPVGSDKVNGQSLETGSERECTNILEGDESDSLTDYDIVGGKESFT

SEQ ID NO: 834763 - protein, 480 aa, Homo sapiens
MAARCSTRWLLVVVGTPRLPAISGRGARPPREGVVGAWLSRKLSVPAFASSLTSCGPRALLTLRPGVSLTGTKHYPFICTASFHTSAPLAKEDYYQILGVPRNASQKEIKKAYYQLAKKYHPDTNKDDPKAKEKFSQLAEAYEVLSDEVKRKQYDAYGSAGFDPGASGSQHSYWKGGPTVDPEELFRKIFGEFSSSSFGDFQTVFDQPQEYFMELTFNQAAKGVNKEFTVNIMDTCERCNGKGNEPGTKVQHCHYCGGSGMETINTGPFVMRSTCRRCGGRGSIIISPCVVCRGAGQAKQKKRVMIPVPAGVEDGQTVRMPVGKREIFITFRVQKSPVFRRDGADIHSDLFISIAQALLGGTARAQGLYETINVTIPPGTQTDQKIRMGGKGIPRINSYGYGDHYIHIKIRVPKRLTSRQQSLILSYAEDETDVEGTVNGVTLTSSGGSTMDSSAGSKARREAGEDEEGFLSKLKKMFTS

SEQ ID NO: 834764 - protein, 453 aa, Homo sapiens [sequence omitted]

SEQ ID NO: 834765 - protein, 480 aa, Homo sapiens; identical to SEQ ID NO: 834763

SEQ ID NO: 834766 - protein, 480 aa, Homo sapiens; identical to SEQ ID NO: 834763

SEQ ID NO: 834767 - protein, 478 aa, Homo sapiens
MAARCSTRWLLVVVGTPRLPAISGRGARPPREGVVGAWLSRKLSVPAFASSLTSCGPRALLTLRPGVSLTGGVLLLSPRLECNGAILAHCNLSLPGTKHYPFICTASFHTSAPLAKEDYYQILGVPRNASQKEIKKAYYQLAKKYHPDTNKDDPKAKEKFSQLAEAYEVLSDEVKRKQYDAYGSAGFDPGASGSQHSYWKGGPTVDPEELFRKIFGEFSSSSFGDFQTVFDQPQEYFMELTFNQAAKGVNKEFTVNIMDTCERCNGKGNEPGTKVQHCHYCGGSGMETINTGPFVMRSTCRRCGGRGSIIISPCVVCRGAGQAKQKKRVMIPVPAGVEDGQTVRMPVGKREIFITFRVQKSPVFRRDGADIHSDLFISIAQALLGGTARAQGLYETINVTIPPGTQTDQKIRMGGKGIPRINSYGYGDHYIHIKIRVPKRLTSRQQSLILSYAEDETDVEGTVNGVTLTSSGKRSTGN

SEQ ID NO: 834768 - protein, 398 aa, Homo sapiens
MAEPQAERPRLCVFPDLLRPPSAADIETWCQPHRAKEDYYQILGVPRNASQKEIKKAYYQLAKKYHPDTNKDDPKAKEKFSQLAEAYEVLSDEVKRKQYDAYGSAGFDPGASGSQHSYWKGGPTVDPEELFRKIFGEFSSSSFGDFQTVFDQPQEYFMELTFNQAAKGVNKEFTVNIMDTCERCNGKGNEPGTKVQHCHYCGGSGMETINTGPFVMRSTCRRCGGRGSIIISPCVVCRGAGQAKQKKRVMIPVPAGVEDGQTVRMPVGKREIFITFRVQKSPVFRRDGADIHSDLFISIAQALLGGTARAQGLYETINVTIPPGTQTDQKIRMGGKGIPRINSYGYGDHYIHIKIRVPKRLTSRQQSLILSYAEDETDVEGTVNGVTLTSSGKRSTGN

SEQ ID NO: 834769 - protein, 480 aa, Homo sapiens; identical to SEQ ID NO: 834763

SEQ ID NO: 834770 - protein, 145 aa, Homo sapiens
MAARCSTRWLLVVVGTPRLPAISGRGARPPREGVVGAWLSRKLSVPAFASSLTSCGPRALLTLRPGVSLTGTKHYPFICTASFHTSAPLAKEDYYQILGVPRNASQKEIKKAYYQLAKKYHPDTNKDDPKAKEKFSQLAEAYEVI

SEQ ID NO: 834771 - protein, 108 aa, Homo sapiens
MLGLLYSPPAVVGPACPWSQRASQAEPGLELRSPHVLPAWKLPSCVDSAGLCKPGGCSRGSACSPCHLGTHFGLLCSSQQVGFSPLSWHSCFPGINRRSPQGCVPLKC

SEQ ID NO: 834772 - protein, 453 aa, Homo sapiens [sequence omitted]

SEQ ID NO: 834773 - protein, 453 aa, Homo sapiens [sequence omitted]

SEQ ID NO: 834774 - protein, 453 aa, Homo sapiens [sequence omitted]

SEQ ID NO: 834775 - protein, 423 aa, Homo sapiens
TAKPYQFVCSFTDIAWWVMYSQFSFVENIPRVIFFVFSFLGTKHYPFICTASFHTSAPLAKEDYYQILGVPRNASQKEIKKAYYQLAKKYHPDTNKDDPKAKEKFSQLAEAYEVLSDEVKRKQYDAYGSAGFDPGASGSQHSYWKGGPTVDPEELFRKIFGEFSSSSFGDFQTVFDQPQEYFMELTFNQAAKGVNKEFTVNIMDTCERCNGKGNEPGTKVQHCHYCGGSGMETINTGPFVMRSTCRRCGGRGSIIISPCVVCRGAGQAKQKKRVMIPVPAGVEDGQTVRMPVGKREIFITFRVQKSPVFRRDGADIHSDLFISIAQALLGGTARAQGLYETINVTIPPGTQTDQKIRMGGKGIPRINSYGYGDHYIHIKIRVPKRLTSRQQSLILSYAEDETDVEGTVNGVTLTSSGKRSTGN

SEQ ID NO: 834776 - protein, 297 aa, Homo sapiens
MAARCSTRWLLVVVGTPRLPAISGRGARPPREGVVGAWLSRKLSVPAFASSLTSCGPRALLTLRPGVSLTGTKHYPFICTASFHTSAPLAKEDYYQILGVPRNASQKEIKKAYYQLAKKYHPDTNKDDPKAKEKFSQLAEAYEVLSDEVKRKQYDAYGSAGFDPGASGSQHSYWKGGPTVDPEELFRKIFGEFSSSSFGDFQTVFDQPQEYFMELTFNQAAKGVNKEFTVNIMDTCERCNGKGNEPGTKVQHCHYCGGSGMVRLCPRLHLPRLAPLTEKSWLWHCSQRTYAGNWGSW

SEQ ID NO: 834777 - protein, 106 aa, Homo sapiens
MAARCSTRWLLVVVGTPRLPAISGRGARPPREGVVGAWLSRKLSVPAFASSLTSCGPRALLTLRPGVSLTGGVLLCRPGWSAMARSWLTATSASQVQTILMPQPPK

SEQ ID NO: 834778 - protein, 705 aa, Homo sapiens
MVTMINDSDYVSVAPHSAALNVVHSEKDYVFAAVFNSTMVYSLPILVNIISNYYLYHLNVTETIQIWSTPFFQEITDIVFKIELYFQAALLGIIVTAMPPYFAMENAENHKIKAYTQLKLSGLLPSAYWIGQAVVDIPLFFIILILMLGSLLAFHYGLYFYTVKFLAVVFCLIGYVPSVILFTYIASFTFKKILNTKEFWSFIYSVAALACIAITEITFFMGYTIATILHYAFCIIIPIYPLLGCLISFIKISWKNVRKNVDTYNPWDRLSVAVISPYLQCVLWIFLLQYYEKKYGGRSIRKDPFFRNLSTKSKNRKLPEPPDNEDEDEDVKAERLKVKELMGCQCCEEKPSIMVSNLHKEYDDKKDFLLSRKVKKVATKYISFCVKKGEILGLLGPNGAGKSTIINILVGDIEPTSGQVFLGDYSSETSEDDDSLKCMGYCPQINPLWPDTTLQEHFEIYGAVKGMSASDMKEVISRITHALDLKEHLQKTVKKLPAGIKRKLCFALSMLGNPQITLLDEPSTGMDPKAKQHMWRAIRTAFKNRKRAAILTTHYMEEAEAVCDRVAIMVSGQLRCIGTVQHLKSKFGKGYFLEIKLKDWIENLEVDRLQREIQYIFPNASRQESFSSILAYKIPKEDVQSLSQSFFKLEEAKHAFAIEEYSFSQATLEQVFVELTKEQEEEDNSCGTLNSTLWWERTQEDRVVF

SEQ ID NO: 834779 - protein, 657 aa, Homo sapiens
MVTMINDSDYVSVAPHSAALNVVHSEKDYVFAAVFNSTMVYSLPILVNIISNYYLYHLNVTETIQIWSTPFFQEITDIVFKIELYFQAALLGIIVTAMPPYFAMENAENHKIKAYTQLKLSGLLPSAYWIGQAVVDIPLFFIILILMLGSLLAFHYGLYFYTVKFLAVVFCLIGYVPSVILFTYIASFTFKKILNTKEFWSFIYSVAALACIAITEITFFMGYTIATILHYAFCIIIPIYPLLGCLISFIKISWKNVRKNVDTYNPWDRLSVAVISPYLQCVLWIFLLQYYEKKYGGRSIRKDPFFRNLSTKSKNRKLPEPPDNEDEDEDVKAERLKVKELMGCQCCEEKPSIMVSNLHKEYDDKKDFLLSRKVKKVATKYISFCVKKGEILGLLGPNGAGKSTIINILVGDIEPTSGQVFLGDYSSETSEDDDSLKCMGYCPQINPLWPDTTLQEHFEIYGAVKGMSASDMKEVISRITHALDLKEHLQKTVKKLPAGIKRKLCFALSMLGNPQITLLDEPSTGMDPKAKQHMWRAIRTAFKNRKRAAILTTHYMEEAEAVCDRVAIMVSGQLRCIGTVQHLKSKFGKGYFLEIKLKDWIENLEVDRLQREIQYIFPNASRQESFSSILAYKIPKEDVQSLSQSFFKLEEGFCRTH

SEQ ID NO: 834780 - protein, 705 aa, Homo sapiens; identical to SEQ ID NO: 834778

SEQ ID NO: 834781 - protein, 434 aa, Homo sapiens
MVTMINDSDYVSVAPHSAALNVVHSEKDYVFAAVFNSTMVYSLPILVNIISNYYLYHLNVTETIQIWSTPFFQEITDIVFKIELYFQAALLGIIVTAMPPYFAMENAENHKIKAYTQLKLSGLLPSAYWIGQAVVDIPLFFIILILMLGSLLAFHYGLYFYTVKFLAVVFCLIGYVPSVILFTYIASFTFKKILNTKEFWSFIYSVAALACIAITEITFFMGYTIATILHYAFCIIIPIYPLLGCLISFIKISWKNVRKNVDTYNPWDRLSVAVISPYLQCVLWIFLLQYYEKKYGGRSIRKDPFFRNLSTKSKNRKLPEPPDNEDEDEDVKAERLKVKELMGCQCCEEKPSIMVSNLHKEYDDKKDFLLSRKVKKVATKYISFCVKKGEILGLLGPNGAGKSTIINILVGDIEPTSGQVFLGDYLMGTVYIVG

SEQ ID NO: 834782 - protein, 109 aa, Homo sapiens
LCRGPARIEALAGVPMYRNEFTAWYRRMSVVYGIGTWSVLGSLLYYSRTMAKSSDQKDGSASEVPSELSERPKGFYVETVVTYKEDFVPNTEKILNYWKSWTGGPGTEP

SEQ ID NO: 834783 - protein, 109 aa, Homo sapiens; identical to SEQ ID NO: 834782

SEQ ID NO: 834784 - protein, 109 aa, Homo sapiens; identical to SEQ ID NO: 834782

SEQ ID NO: 834785 - protein, 784 aa, Homo sapiens
MSDQKKEEEEEAAAAAAMATEGGKTSEPENNNKKPKTSGSQDSQPSPLALLAATCSKIGTPGENQATGQQQIIIDPSQGLVQLQNQPQQLELVTTQLAGNAWQLVASTPPASKENNVSQPASSSSSSSSSNNGSASPTKTKSGNSSTPGQFQVIQVQNPSGSVQYQVIPQLQTVEGQQIQINPTSSSSLQDLQGQIQLISAGNNQAILTAANRTASGNILAQNLANQTVPVQIRPGVSIPLQLQTLPGTQAQVVTTLPINIGGVTLALPVINNVAAGGGTGQVGQPAATADSGTSNGNQLVSTPTNTTTSASTMPESPSSSTTCTTTASTSLTSSDTLVSSADTGQYASTSASSSERTIEESQTPAATESEAQSSSQLHANGMQNQQDQSNSLQQVQIVGQPILQQIQIQQPQQQIIQAIPPQSFQLQSGQTIQTIQQQPLQNVQLQAVNPTQVLIRAPTLTPSGQISWQTVQVQNIQSLSNLQVQNAGLSQQLTITPVSSSGGTTLAQIAPVAVAGAPITLNTAQLASVPNLQTVSVANLGAAGVQVQGVPVTITSVAGQQQGQDGVKVQQATIAPVTVAVGGIANATIGAVSPDQLTQVHLQQGQQTSDQEVQPGKRLRRVACSCPNCREGEGRGSNEPGKKKQHICHIEGCGKVYGKTSHLRAHLRWHTGERPFICNWMFCGKRFTRSDELQRHRRTHTGEKRFECPECSKRFMRSDHLSKHVKTHQNKKGGGTALAIVTSGELDSSVTEVLGSPRIVTVAAISQDSNPATPNVSTNMEEF

SEQ ID NO: 834786 - protein, 183 aa, Homo sapiens
GSPPGATQVPRREAAQLGKQPAPVVSGPAARVLPASPPRRGGAPTPRSRGPAAGGRAAHRGSAAAAEDQLLEEAERQREEPRGEGEGGDRQEAANAAECLHTSLCLPWLVKEPSGSQRGGRAGWGEQRPRVRPREGRRRERRRRRFQHEEESWPGGQHEEEMTAGFCYGTWNKPSTPGSSPYS

SEQ ID NO: 834787 - protein, 749 aa, Homo sapiens [sequence omitted]

SEQ ID NO: 834788 - protein, 932 aa, Homo sapiens [sequence omitted]

SEQ ID NO: 834789 - protein, 527 aa, Homo sapiens
MAFFDSLVRREIEGWSSDSDSDLSESTILQLHAGVSERSGYTDSESSASLPRSPPPTVDESADNAFHLGPLRVTTTNTVASTPPTPTCEDAASRQQRLSALRRYQDKRLLALSNESDSEENVCEVELDTDLFPRPRSPSPEDESSSSSSSSSSEDEEELNERRASTWQRNAMRRRQKTTREDKPSAPIKPTNTYIGEDNYDYPQIKVDDLSSSPTSSPERSTSTLEIQPSRASPTSDIESVERKIYKAYKWLRYSYISYSNNKDGETSLVTGEADEGRAGTSHKDNPAPSSSKEACLNIAMAQRNQDLPPEGCSKDTFKEETPRTPSNGPGHEHSSHAWAEVPEGTSQDTGNSGSVEHPFETKKLNGKALSSRAEEPPSPPVPKASGSTLNSGSGNCPRTQSDDSEERSLETICANHNNGRLHPRPPHPHNNGQNLGELEVVAYSSPGHSDTDRDNSSLTGTLLHKDCCGSEMACETPNAGTREDPTDTPATDSSRAVHGHSGLKRQRIELEDTDSENSSSEKKLKT

SEQ ID NO: 834790 - protein, 472 aa, Homo sapiens
MRSVVGFLSQRGLHGDPLLTQDFQRRRLRGCRNLYKKDLLGHFGCVNAIEFSNNGGQWLVSGGDDRRVLLWHMEQAIHSRVKPIQLKGEHHSNIFCLAFNSGNTKVFSGGNDEQVILHDVESSETLDVFAHEDAVYGLSVSPVNDNIFASSSDDGRVLIWDIRESPHGEPFCLANYPSAFHSVMFNPVEPRLLATANSKEGVGLWDIRKPQSSLLRYGGNLSLQSAMSVRFNSNGTQLLALRRRLPPVLYDIHSRLPVFQFDNQGYFNSCTMKSCCFAGDRDQYILSGSDDFNLYMWRIPADPEAGGIGRVVNGAFMVLKGHRSIVNQVRFNPHTYMICSSGVEKIIKIWSPYKQPGCTGDLDGRIEDDSRCLYTHEEYISLVLNSGSGLSHDYANQSVQEDPRMMAFFDSLVRREIEGWSSDSDSDLSESTILQLHAGVSERSGYTDSESSASLPRSPLPSIQHSTTGLNV

SEQ ID NO: 834791 - protein, 326 aa, Homo sapiens
MKRRAGLGGSMRSVVGFLSQRGLHGDPLLTQDFQRRRLRGCRNLYKKDLLGHFGCVNAIEFSNNGGQWLVSGGDDRRVLLWHMEQAIHSRVKPIQLKGEHHSNIFCLAFNSGNTKVFSGGNDEQVILHDVESSETLDVFAHEDAVYGLSVSPVNDNIFASSSDDGRVLIWDIRESPHGEPFCLANYPSAFHSVMFNPVEPRLLATANSKEGVGLWDIRKPQSSLLRYGGNLSLQSAMSVRFNSNGTQLLALRRRLPPVLYDIHSRLPVFQFDNQGYFNSCTMKSCCFAGDRDQHHNWKWRAQAVSFQPFLSLTRNGDADVDLKLAV

SEQ ID NO: 834792 - protein, 932 aa, Homo sapiens [sequence omitted]

SEQ ID NO: 834793 - protein, 860 aa, Homo sapiens
MEQAIHSRVKPIQLKGEHHSNIFCLAFNSGNTKVFSGGNDEQVILHDVESSETLDVFAHEDAVYGLSVSPVNDNIFASSSDDGRVLIWDIRESPHGEPFCLANYPSAFHSVMFNPVEPRLLATANSKEGVGLWDIRKPQSSLLRYGGNLSLQSAMSVRFNSNGTQLLALRRRLPPVLYDIHSRLPVFQFDNQGYFNSCTMKSCCFAGDRDQYILSGSDDFNLYMWRIPADPEAGGIGRVVNGAFMVLKGHRSIVNQVRFNPHTYMICSSGVEKIIKIWSPYKQPGCTGDLDGRIEDDSRCLYTHEEYISLVLNSGSGLSHDYANQSVQEDPRMMAFFDSLVRREIEGWSSDSDSDLSESTILQLHAGVSERSGYTDSESSASLPRSPPPTVDESADNAFHLGPLRVTTTNTVASTPPTPTCEDAASRQQRLSALRRYQDKRLLALSNESDSEENVCEVELDTDLFPRPRSPSPEDESSSSSSSSSSEDEEELNERRASTWQRNAMRRRQKTTREDKPSAPIKPTNTYIGEDNYDYPQIKVDDLSSSPTSSPERSTSTLEIQPSRASPTSDIESVERKIYKAYKWLRYSYISYSNNKDGETSLVTGEADEGRAGTSHKDNPAPSSSKEACLNIAMAQRNQDLPPEGCSKDTFKEETPRTPSNGPGHEHSSHAWAEVPEGTSQDTGNSGSVEHPFETKKLNGKALSSRAEEPPSPPVPKASGSTLNSGSGNCPRTQSDDSEERSLETICANHNNGRLHPRPPHPHNNGQNLGELEVVAYSSPGHSDTDRDNSSLTGTLLHKDCCGSEMACETPNAGTREDPTDTPATDSSRAVHGHSGLKRQRIELEDTDSENSSSEKKLKT

SEQ ID NO: 834794 - protein, 890 aa, Homo sapiens
MRSVVGFLSQRGLHGDPLLTQDFQRRRLRGCRNLYKKDLLGHFGCVNAIEFSNNGGQWLVSGGDDRRVLLWHMEQAIHSRVKPIQLKGEHHSNIFCLAFNSGNTKVFSGGNDEQVILHDVESSETLDVFAHEDAVYGLSVSPVNDNIFASSSDDGRVLIWDIRESPHGEPFCLANYPSAFHSVMFNPVEPRLLATANSKEGVGLWDIRKPQSSLLRYGGNLSLQSAMSVRFNSNGTQLLALRRRLPPVLYDIHSRLPVFQFDNQGYFNSCTMKSCCFAGDRDQYILSGSDDFNLYMWRIPADPEADLEPITSSQDVLETSTVGLRTIPAASITHEEYISLVLNSGSGLSHDYANQSVQEDPRMMAFFDSLVRREIEGWSSDSDSDLSESTILQLHAGVSERSGYTDSESSASLPRSPPPTVDESADNAFHLGPLRVTTTNTVASTPPTPTCEDAASRQQRLSALRRYQDKRLLALSNESDSEENVCEVELDTDLFPRPRSPSPEDESSSSSSSSSSEDEEELNERRASTWQRNAMRRRQKTTREDKPSAPIKPTNTYIGEDNYDYPQIKVDDLSSSPTSSPERSTSTLEIQPSRASPTSDIESVERKIYKAYKWLRYSYISYSNNKDGETSLVTGEADEGRAGTSHKDNPAPSSSKEACLNIAMAQRNQDLPPEGCSKDTFKEETPRTPSNGPGHEHSSHAWAEVPEGTSQDTGNSGSVEHPFETKKLNGKALSSRAEEPPSPPVPKASGSTLNSGSGNCPRTQSDDSEERSLETICANHNNGRLHPRPPHPHNNGQNLGELEVVAYSSPGHSDTDRDNSSLTGTLLHKDCCGSEMACETPNAGTREDPTDTPATDSSRAVHGHSGLKRQRIELEDTDSENSSSEKKLKT

SEQ ID NO: 834795 - protein, 932 aa, Homo sapiens [sequence omitted]

SEQ ID NO: 834796 - protein, 357 aa, Homo sapiens
MRSVVGFLSQRGLHGDPLLTQDFQRRRLRGCRNLYKKDLLGHFGCVNAIEFSNNGGQWLVSGGDDRRVLLWHMEQAIHSRVKPIQLKGEHHSNIFCLAFNSGNTKVFSGGNDEQVILHDVESSETLDVFAHEDAVYGLSVSPVNDNIFASSSDDGRVLIWDIRESPHGEPFCLANYPSAFHSVMFNPVEPRLLATANSKEGVGLWDIRKPQSSLLRYGGNLSLQSAMSVRFNSNGTQLLALRRRLPPVLYDIHSRLPVFQFDNQGYFNSCTMKSCCFAGDRDQYILSGSDDFNLYMWRIPADPEAGGIGRVVNGAFMVLKGHRSIVNQVRFNPHTYMICSSGVEKIIKVRHLPLLSF

SEQ ID NO: 834797 - protein, 333 aa, Homo sapiens
MRSVVGFLSQRGLHGDPLLTQDFQRRRLRGCRNLYKKDLLGHFGCVNAIEFSNNGGQWLVSGGDDRRVLLWHMEQAIHSRVKPIQLKGEHHSNIFCLAFNSGNTKVFSGGNDEQVILHDVESSETLDVFAHEDAVYGLSVSPVNDNIFASSSDDGRVLIWDIRESPHGEPFCLANYPSAFHSVMFNPVEPRLLATANSKEGVGLWDIRKPQSSLLRYGGNLSLQSAMSVRFNSNGTQLLALRRRLPPVLYDIHSRLPVFQFDNQGYFNSCTMKSCCFAGDRDQYILSGSDDFNLYMWRIPADPEAGKYILHMNVLLLLALLTFGMLCPEGTDL

SEQ ID NO: 834798 - protein, 119 aa, Homo sapiens
GGPVWTARDSITLLRRAHHLRLKILYFWNCSILLVTVGNLLLCLIYKLNFRYVCTGKNVVYSIVYMYRKKTYYLWFQVSTAGLRTYPPQVRGDCCTKNIGRPLDYIHSFLNRRKIPGTV

SEQ ID NO: 834799 - protein, 119 aa, Homo sapiens; identical to SEQ ID NO: 834798

SEQ ID NO: 834800 - protein, 327 aa, Homo sapiens
HFRSAREEGSRGGREGAGKMVVTRSARAKASIQAASAESSGQKSFAANGIQAHPESSTGSDARTTAESQTTGKQSLIPRTPKARKRKSRTTGSLPKGTEPSTDGETSEAESNYSVSEHHDTILRVTRRRQILIACSPVSSVRKKPKVTPTKESYTEEIVSEAESHVSGISRIVLPTEKTTGARRSKAKSLTDPSQESHTEAISDAETSSSDISFSGIATRRTRSMQRKLKAQTEKKDSKIVPGNEKQIVGTPVNSEDSDTRQTSHLQARSLSEINKPNFYNNDFDDDFSHRSSEIFTGAKGKVNPKNTDGRNWRKATTHSMATTTED

SEQ ID NO: 834801 - protein, 788 aa, Homo sapiens
HFRSAREEGSRGGREGAGKMVVTRSARAKASIQAASAESSGQKSFAANGIQAHPESSTGSDARTTAESQTTGKQSLIPRTPKARKRKSRTTGSLPKGTEPSTDGETSEAESNYSVSEHHDTILRVTRRRQILIACSPVSSVRKKPKVTPTKESYTEEIVSEAESHVSGISRIVLPTEKTTGARRSKAKSLTDPSQESHTEAISDAETSSSDISFSGIATRRTRSMQRKLKAQTEKKDSKIVPGNEKQIVGTPVNSEDSDTRQTSHLQARSLSEINKPNFYNNDFDDDFSHRSSENILTVHEQANVESLKETKQNCKDLDEDANGITDEGKEINEKSSQLKNLSELQDTSLQQLVSQRHSTPQNKNAVSVHSNLNSEAVMKSLTQTFATVEVGRWNNNKKSPIKASDLTKFGDCGGSDDEEESTVISVSEDMNSEGNVDFECDTKLYTSAPNTSQGKDNSVLLVLSSDESQQSENSENEEDTLCFVENSGQRESLSGDTGSLSCDNALFVIDTTPGMSADKNFYLEEEDKASEVAIEEEKEEEEDEKSEEDSSDHDENEDEFSDEEDFLNSTKAKLLKLTSSSIDPGLSIKQLGGLYINFNADKLQSNKRTLTQIKEKKKNELLQKAVITPDFEKNHCVPPYSESKYQLQKKRRRPKKGKKKKKGTGKERQKTAGDGWFGMKAPEMTNELKNDLKALKMRASMDPKRFYKKNDRDGFPKYFQIGTIVDNPADFYHSRIPKKQRKRTIVEELLADSEFRRYNRRKYSEIMAEKAANAAGKKFRKKKKFRN

SEQ ID NO: 834802 - protein, 782 aa, Homo sapiens
HFRSAREEGSRGGREGAGKMVVTRSARAKASIQAASAESSGQKCVFSGLQSFAANGIQAHPESSTGSDARTTAESQTTGKQSLIPRTPKARKRKSRTTGSLPKGTEPSTDGETSEAESNYSVSEHHDTILRVTRRRQILIACSPVSSVRKKPKVTPTKESYTEEIVSEAESHVSGISRIVLPTEKTTGARRSKAKSLTDPSQESHTEAISDAETSSSDISFSGIATRRTRSMQRKLKAQTEKKDSKIVPGNEKQIVGTPVNSEDSDTRQTSHLQARSLSEINKPNFYNNDFDDDFSHRSSENILTVHEQANVESLKETKQNCKDLDEDANGITDEGKEINEKSSQLKNLSELQDTSLQQLVSQRHSTPQNKNAVSVHSNLNSEAVMKSLTQTFATVEVGRWNNNKKSPIKASDLTKFGDCGGSDDEEESTVISVSEDMNSEGNVDFECDTKLYTSAPNTSQGKDNSVLLVLSSDESQQSENSENEEDTLCFVENSGQRESLSGDTGSLSCDNALFVIDTTPGMSADKNFYLEEEDKASEVAIEEEKEEEEDEKSEEDSSDHDENEDEFSDEEDFLNSTKAKLLKLTSSSIDPGLSIKQLGGLYINFNADKLQSNKRTLTQIKEKKKNELLQKAVITPDFEKNHCVPPYSESKYQLQKKRRKERQKTAGDGWFGMKAPEMTNELKNDLKALKMRASMDPKRFYKKNDRDGFPKYFQIGTIVDNPADFYHSRIPKKQRKRTIVEELLADSEFRRYNRRKYSEIMAEKAANAAGKKFRKKKKFRN

SEQ ID NO: 834803 - protein, 109 aa, Homo sapiens [sequence omitted]

SEQ ID NO: 834804 - protein, 775 aa, Homo sapiens
HFRSAREEGSRGGREGAGKMVVTRSARAKASIQAASAESSGQKSFAANGIQAHPESSTGSDARTTAESQTTGKQSLIPRTPKARKRKSRTTGSLPKGTEPSTDGETSEAESNYSVSEHHDTILRVTRRRQILIACSPVSSVRKKPKVTPTKESYTEEIVSEAESHVSGISRIVLPTEKTTGARRSKAKSLTDPSQESHTEAISDAETSSSDISFSGIATRRTRSMQRKLKAQTEKKDSKIVPGNEKQIVGTPVNSEDSDTRQTSHLQARSLSEINKPNFYNNDFDDDFSHRSSENILTVHEQANVESLKETKQNCKDLDEDANGITDEGKEINEKSSQLKNLSELQDTSLQQLVSQRHSTPQNKNAVSVHSNLNSEAVMKSLTQTFATVEVGRWNNNKKSPIKASDLTKFGDCGGSDDEEESTVISVSEDMNSEGNVDFECDTKLYTSAPNTSQGKDNSVLLVLSSDESQQSENSENEEDTLCFVENSGQRESLSGDTGSLSCDNALFVIDTTPGMSADKNFYLEEEDKASEVAIEEEKEEEEDEKSEEDSSDHDENEDEFSDEEDFLNSTKAKLLKLTSSSIDPGLSIKQLGGLYINFNADKLQSNKRTLTQIKEKKKNELLQKAVITPDFEKNHCVPPYSESKYQLQKKRRKERQKTAGDGWFGMKAPEMTNELKNDLKALKMRASMDPKRFYKKNDRDGFPKYFQIGTIVDNPADFYHSRIPKKQRKRTIVEELLADSEFRRYNRRKYSEIMAEKAANAAGKKFRKKKKFRN

SEQ ID NO: 834805 - protein, 775 aa, Homo sapiens; identical to SEQ ID NO: 834804

SEQ ID NO: 834806 - protein, 551 aa, Homo sapiens
MQRKLKAQTEKKDSKIVPGNEKQIVGTPVNSEDSDTRQTSHLQARSLSEINKPNFYNNDFDDDFSHRSSENILTVHEQANVESLKETKQNCKDLDEDANGITDEGKEINEKSSQLKNLSELQDTSLQQLVSQRHSTPQNKNAVSVHSNLNSEAVMKSLTQTFATVEVGRWNNNKKSPIKASDLTKFGDCGGSDDEEESTVISVSEDMNSEGNVDFECDTKLYTSAPNTSQGKDNSVLLVLSSDESQQSENSENEEDTLCFVENSGQRESLSGDTGSLSCDNALFVIDTTPGMSADKNFYLEEEDKASEVAIEEEKEEEEDEKSEEDSSDHDENEDEFSDEEDFLNSTKAKLLKLTSSSIDPGLSIKQLGGLYINFNADKLQSNKRTLTQIKEKKKNELLQKAVITPDFEKNHCVPPYSESKYQLQKKRRKERQKTAGDGWFGMKAPEMTNELKNDLKALKMRASMDPKRFYKKNDRDGFPKYFQIGTIVDNPADFYHSRIPKKQRKRTIVEELLADSEFRRYNRRKYSEIMAEKAANAAGKKFRKKKKFRN

SEQ ID NO: 834807 - protein, 221 aa, Homo sapiens
GLGTRLGGGGRSAKMQLKPMEINPEMLNKVLSRLGVAGQWRFVDVLGLEEESLGSVPAPACALLLLFPLTAQHENFRKKQIEELKGQEVSPKVYFMKQTIGNSCGTIGLIHAVANNQDKLGFEDGSVLKQFLSETEKMSPEDRAKCFEKNEAIQAAHDAVAQEGQCRVDDKVNFHFILFNNVDGHLYELDGRMPFPVNHGASSEDTLLEGRCQGLQRIHRA

SEQ ID NO: 834808 - protein, 207 aa, Homo sapiens
MQLKPMEINPEMLNKVLSRLGVAGQWRFVDVLGLEEESLGSVPAPACALLLLFPLTAQHENFRKKQIEELKGQEVSPKVYFMKQTIGNSCGTIGLIHAVANNQDKLGFEDGSVLKQFLSETEKMSPEDRAKCFEKNEAIQAAHDAVAQEGQCRVDDKVNFHFILFNNVDGHLYELDGRMPFPVNHGASSEDTLLEGRCQGLQRIHRA

SEQ ID NO: 834809 - protein, 207 aa, Homo sapiens; identical to SEQ ID NO: 834808

SEQ ID NO: 834810 - protein, 207 aa, Homo sapiens; identical to SEQ ID NO: 834808

SEQ ID NO: 834811 - protein, 207 aa, Homo sapiens; identical to SEQ ID NO: 834808

SEQ ID NO: 834812 - protein, 207 aa, Homo sapiens; identical to SEQ ID NO: 834808

SEQ ID NO: 834813 - protein, 207 aa, Homo sapiens; identical to SEQ ID NO: 834808

SEQ ID NO: 834814 - protein, 207 aa, Homo sapiens; identical to SEQ ID NO: 834808

SEQ ID NO: 834815 - protein, 207 aa, Homo sapiens; identical to SEQ ID NO: 834808

SEQ ID NO: 834816 - protein, 207 aa, Homo sapiens; identical to SEQ ID NO: 834808

SEQ ID NO: 834817 - protein, 221 aa, Homo sapiens; identical to SEQ ID NO: 834807

SEQ ID NO: 834818 - protein, 205 aa, Homo sapiens
GEETYRLGRGLGAVLSRLGVAGQWRFVDVLGLEEESLGSVPAPACALLLLFPLTAQHENFRKKQIEELKGQEVSPKVYFMKQTIGNSCGTIGLIHAVANNQDKLGFEDGSVLKQFLSETEKMSPEDRAKCFEKNEAIQAAHDAVAQEGQCRVDDKVNFHFILFNNVDGHLYELDGRMPFPVNHGASSEDTLLEGRCQGLQRIHRA

SEQ ID NO: 834819 - protein, 201 aa, Homo sapiens
HASPTRRNKVLSRLGVAGQWRFVDVLGLEEESLGSVPAPACALLLLFPLTAQHENFRKKQIEELKGQEVSPKVYFMKQTIGNSCGTIGLIHAVANNQDKLGFEDGSVLKQFLSETEKMSPEDRAKCFEKNEAIQAAHDAVAQEGQCRVDDKVNFHFILFNNVDGHLYELDGRMPFPVNHGASSEDTLLEGRCQGLQRIHRA

SEQ ID NO: 834820 - protein, 191 aa, Homo sapiens
MQLKPMEINPEMLNKVLSRLGVAGQWRFVDVLGLEEESLGSVPAPACALLLLFPLTAQHENFRKKQIEELKGQEVSPKVYFMKQTIGNSCGTIGLIHAVANNQDKLGFEDGSVLKQFLSETEKMSPEDRAKCFEKNEVDDKVNFHFILFNNVDGHLYELDGRMPFPVNHGASSEDTLLEGRCQGLQRIHRA

SEQ ID NO: 834821 - protein, 110 aa, Homo sapiens
MKQTIGNSCGTIGLIHAVANNQDKLGFEDGSVLKQFLSETEKMSPEDRAKCFEKNEVDDKVNFHFILFNNVDGHLYELDGRMPFPVNHGASSEDTLLEGRCQGLQRIHRA

SEQ ID NO: 834822 - protein, 324 aa, Homo sapiens
NKQPTQARYEAGGESAEECVWPALYSCSLGGSASCFSSSSSSLGYFCRALREDAAQADGDQPRDAEQNAEQSEWRLAPSLAPSPASAEAGAPTGSGCWQGPSRPLRAPETAGLGRGLGAFPGPLHLAGDSTKPVTGRRRGLRPVASERQAELPRAWRGQHRLGCTGFAGATCGPRFVLCHCAGPGGGGRAGLGLLPGSGAGAEGARLLAPPPGRCPRPACPRAPGRLVSSPQVLSRLGVAGQWRFVDVLGLEEESLGSVPAPACALLLLFPLTAQHENFRKKQIEELKGQEVSPKVYFMKQTIGNSCGTIGLIHAPSVCLVSDI

SEQ ID NO: 834823 - protein, 174 aa, Homo sapiens
FSLCFFSVFLIHSSSSLGYFCRALREDAAQADGDQPRDAEQRRGAGSTDSAARASRAPRVGRALCCVIAPARVGVAGRDWGSSQARVRARRARASWPRPLAGARDPRVPVRLAALSPLRRCCPGWGSPASGASWTCWGWKRSLWARCQRLPARCCCCFPSRPSMRTSGKSRLKS

SEQ ID NO: 834824 - protein, 206 aa, Homo sapiens
KAVEAVGIGRGLNKVLSRLGVAGQWRFVDVLGLEEESLGSVPAPACALLLLFPLTAQHENFRKKQIEELKGQEVSPKVYFMKQTIGNSCGTIGLIHAVANNQDKLGFEDGSVLKQFLSETEKMSPEDRAKCFEKNEAIQAAHDAVAQEGQCRVDDKVNFHFILFNNVDGHLYELDGRMPFPVNHGASSEDTLLEGRCQGLQRIHRA

SEQ ID NO: 834825 - protein, 207 aa, Homo sapiens; identical to SEQ ID NO: 834808

SEQ ID NO: 834826 - protein, 207 aa, Homo sapiens; identical to SEQ ID NO: 834808

SEQ ID NO: 834827 - protein, 207 aa, Homo sapiens; identical to SEQ ID NO: 834808

SEQ ID NO: 834828 - protein, 207 aa, Homo sapiens; identical to SEQ ID NO: 834808

SEQ ID NO: 834829 - protein, 207 aa, Homo sapiens; identical to SEQ ID NO: 834808

SEQ ID NO: 834830 - protein, 126 aa, Homo sapiens
MKQTIGNSCGTIGLIHAVANNQDKLGFEDGSVLKQFLSETEKMSPEDRAKCFEKNEAIQAAHDAVAQEGQCRVDDKVNFHFILFNNVDGHLYELDGRMPFPVNHGASSEDTLLEGRCQGLQRIHRA

SEQ ID NO: 834831 - protein, 207 aa, Homo sapiens; identical to SEQ ID NO: 834808

SEQ ID NO: 834832 - protein, 383 aa, Homo sapiens
FSLCFFSVFLIHSSSSLGYFCRALREDAAQADGDQPRDAEQNAEQSEWRLAPSLAPSPASAEAGAPTGSGGLGRGLGAFPGPLHLAGDSTKPVTGRRRGLRPVASERQAELPRAWRGQHRLGCTGFAGATCGPRFVLCHCAGPGGGGRAGLGLLPGSGAGAEGARLLAPPPGRCPRPACPRAPGRLVSSPQVLSRLGVAGQWRFVDVLGLEEESLGSVPAPACALLLLFPLTAQHENFRKKQIEELKGQEVSPKVYFMKQTIGNSCGTIGLIHAVANNQDKLGFEDGSVLKQFLSETEKMSPEDRAKCFEKNEAIQAAHDAVAQEGQCRVDDKVNFHFILFNNVDGHLYELDGRMPFPVNHGASSEDTLLEGRCQGLQRIHRA

SEQ ID NO: 834833 - protein, 126 aa, Homo sapiens; identical to SEQ ID NO: 834830

SEQ ID NO: 834834 - protein, 234 aa, Homo sapiens
MQLKPMEINPEMLNKVLSRLGVAGQWRFVDVLGLEEESLGSVPAPACALLLLFPLTAQHENFRKKQIEELKGQEVSPKVYFMKQTIGNSCGTIGLIHAVANNQDKLGFEDGSVLKQFLSETEKMSPEDRAKCFEKNEAIQAAHDAVAQEGQCRVDDKVNFHFILFNNVDGHLYELDGRMPFPVNHGASSEDTLLEGHLWNASLLNDAAKVCREFTEREQGRSPASLPWLSARAA

SEQ ID NO: 834835 - protein, 182 aa, Homo sapiens
MQLKPMEINPEMLNKVLSRLGVAGQWRFVDVLGLEEESLGSVPAPACALLLLFPLTAQHENFRKKQIEELKGQEVSPKVYFMKQTIGNSCGTIGLIHAVANNQDKLGFEDGSVLKQFLSETEKMSPEDRAKCFEKNEAIQAAHDAVAQEGQCRDAAKVCREFTEREQGRSPASLPWLSARAA

SEQ ID NO: 834836 - protein, 80 aa, Homo sapiens
NQPAWNTNEALRRSSIIFCASGIAWRVDDKVNFHFILFNNVDGHLYELDGRMPFPVNHGASSEDTLLEGRCQGLQRIHRA

SEQ ID NO: 834837 - protein, 234 aa, Homo sapiens
MQLKPMEINPEMLNKVLSRLGVAGQWRFVDVLGLEEESLGSVPAPACALLLLFPLTAQHENFRKKQIEELKGQEVSPKVYFMKQTIGNSCGTIGLIHAVANNQDKLGFEDGSVLKQFLSETEKMSPEDRAKCFEKNEAIQAAHDAVAQEGQCRVDDKVNFHFILFNNVDGHLYELAFNMKIYTPPCSLKCFSTCETQAVLLFCRHAFPSATPRHLSTSRVHSCPLGHCGVSFRW

SEQ ID NO: 834838 - protein, 151 aa, Homo sapiens
MQLKPMEINPEMLNKVLSRLGVAGQWRFVDVLGLEEESLGSVPAPACALLLLFPLTAQHENFRKKQIEELKGQEVSPKVYFMKQTIGNSCGTIGLIHAVANNQDKLGFEDGSVLKQFLSETEKMSTGPLWCELQMVKHSPQCMSCIRYLTL

SEQ ID NO: 834839 - protein, 107 aa, Homo sapiens
MQLKPMEINPEMLNKVLSRLGVAGQWRFVDVLGLEEESLGSVPAPACALLLLFPLTAQHENFRKKQIEELKGQEVSPKVYFMKQTIGNSCGTIGLIHAPSVCLVSDI

SEQ ID NO: 834840 - protein, 400 aa, Homo sapiens
MSQVLGKPQPQDEDDAEEEEEEDELVGLADYGDGPDSSDADPDSGTEEGVLDFSDPFSTEVKPRILLMGLRRSGKSSIQKVVFHKMSPNETLFLESTNKICREDVSNSSFVNFQIWDFPGQIDFFDPTFDYEMIFRGTGALIFVIDSQDDYMEALARLHLTVTRAYKVNTDINFEVFIHKVDGLSDDHKIETQRDIHQRANDDLADAGLEKIHLSFYLTSIYDHSIFEAFSKVVQKLIPQLPTLENLLNIFISNSGIEKAFLFDVVSKIYIATDSTPVDMQTYELCCDMIDVVIDISCIYGLKEDGAGTPYDKESTAIIKLNNTTVLYLKEVTKFLALVCFVREESFERKGLIDYNFHCFRKAIHEVFEVRMKVVKSRKVQNRLQKKKRATPNGTPRVLL

SEQ ID NO: 834841 - protein, 400 aa, Homo sapiens; identical to SEQ ID NO: 834840

SEQ ID NO: 834842 - protein, 386 aa, Homo sapiens
MSWLKKGSRRRRDWQGRRQLRVSVSPRVAAGGAHPVLDFSDPFSTEVKPRILLMGLRRSGKSSIQKVVFHKMSPNETLFLESTNKICREDVSNSSFVNFQIWDFPGQIDFFDPTFDYEMIFRGTGALIFVIDSQDDYMEALARLHLTVTRAYKVNTDINFEVFIHKVDGLSDDHKIETQRDIHQRANDDLADAGLEKIHLSFYLTSIYDHSIFEAFSKVVQKLIPQLPTLENLLNIFISNSGIEKAFLFDVVSKIYIATDSTPVDMQTYELCCDMIDVVIDISCIYGLKEDGAGTPYDKESTAIIKLNNTTVLYLKEVTKFLALVCFVREESFERKGLIDYNFHCFRKAIHEVFEVRMKVVKSRKVQNRLQKKKRATPNGTPRVLL

SEQ ID NO: 834843 - protein, 268 aa, Homo sapiens [sequence omitted]

SEQ ID NO: 834844 - protein, 39 aa, Homo sapiens
MLAKLLWESPRGRRFPGIHANTVVRTPYLLSVSPPGHGS

SEQ ID NO: 834845 - protein, 249 aa, Homo sapiens
MEALARLHLTVTRAYKVNTDINFEVFIHKVDGLSDDHKIETQRDIHQRANDDLADAGLEKIHLSFYLTSIYDHSIFEAFSKVVQKLIPQLPTLENLLNIFISNSGIEKAFLFDVVSKIYIATDSTPVDMQTYELCCDMIDVVIDISCIYGLKEDGAGTPYDKESTAIIKLNNTTVLYLKEVTKFLALVCFVREESFERKGLIDYNFHCFRKAIHEVFEVRMKVVKSRKVQNRLQKKKRATPNGTPRVLL

SEQ ID NO: 834846 - protein, 400 aa, Homo sapiens; identical to SEQ ID NO: 834840

SEQ ID NO: 834847 - protein, 400 aa, Homo sapiens; identical to SEQ ID NO: 834840

SEQ ID NO: 834848 - protein, 149 aa, Homo sapiens
MSQVLGKPQPQDEDDAEEEEEEDELVGLADYGDGPDSSDADPDSGTEEGVLDFSDPFSTEVKPRILLMGLRRSGKSSIQKVVFHKMSPNETLFLESTNKICREDVSNSSFVNFQIWDFPGQIDFFDPTFDYEMIFRGTGALIFVIDSQG

SEQ ID NO: 834849 - protein, 96 aa, Homo sapiens
MADGKGDAAAVAGAGAEAPAVAGAGDGVETESMVRGHRPVSPAPGASGLRPCLWQLETELREQEVSEVSSLNYCRSFCQGADMDYDSYQHYFYDYD

SEQ ID NO: 834850 - protein, 1918 aa, Homo sapiens
RRGKMADGKGDAAAVAGAGAEAPAVAGAGDGVETESMVRGHRPVSPAPGASGLRPCLWQLETELREQEVSEVSSLNYCRSFCQTLLQYASNKNASEHIVYLLEVYRLAIQSFASARPYLTTECEDVLLVLGRLVLSCFELLLSVSESELPCEVWLPFLQSLQESHDALLEFGNNNLQILVHVTKEGVWKNPVLLKILSQQPVETEEVNKLIAQEGPSFLQMRIKHLLKSNCIPQATALSKLCAESKEISNVSSFQQAYITCLCSMLPNEDAIKEIAKVDCKEVLDIICNLESEGQDNTAFVLCTTYLTQQLQTASVYCSWELTLFWSKLQRRIDPSLDTFLERCRQFGVIAKTQQHLFCLIRVIQTEAQDAGLGVSILLCVRALQLRSSEDEEMKASVCKTIACLLPEDLEVRRACQLTEFLIEPSLDGFNMLEELYLQPDQKFDEENAPVPNSLRCELLLALKAHWPFDPEFWDWKTLKRHCHQLLGQEASDSDDDLSGYEMSINDTDVLESFLSDYDEGKEDKQYRRRDLTDQHKEKRDKKPIGSSERYQRWLQYKFFCLLCKRECIEARILHHSKMHMEDGIYTCPVCIKKFKRKEMFVPHVMEHVKMPPSRRDRSKKKLLLKGSQKGICPKSPSAIPEQNHSLNDQAKGESHEYVTFSKLEDCHLQDRDLYPCPGTDCSRVFKQFKYLSVHLKAEHQNNDENAKHYLDMKNRREKCTYCRRHFMSAFHLREHEQVHCGPQPYMCVSIDCYARFGSVNELLNHKQKHDDLRYKCELNGCNIVFSDLGQLYHHEAQHFRDASYTCNFLGCKKFYYSKIEYQNHLSMHNVENSNGDIKKSVKLEESATGEKQDCINQPHLLNQTDKSHLPEDLFCAESANSQIDTETAENLKENSDSNSSDQLSHSSSASMNEELIDTLDHSETMQDVLLSNEKVFGPSSLKEKCSSMAVCFDGTKFTCGFDGCGSTYKNARGMQKHLRKVHPYHFKPKKIKTKDLFPSLGNEHNQTTEKLDAEPKPCSDTNSDSPDEGLDHNIHIKCKREHQGYSSESSICASKRPCTEDTMLELLLRLKHLSLKNSITHGSFSGSLQGYPSSGAKSLQSVSSISDLNFQNQDENMPSQYLAQLAAKPFFCELQGCKYEFVTREALLMHYLKKHNYSKEKVLQLTMFQHRYSPFQCHICQRSFTRKTHLRIHYKNKHQIGSDRATHKLLDNEKCDHEGPCSVDRLKGDCSAELGGDPSSNSEKPHCHPKKDECSSETDLESSCEETESKTSDISSPIGSHREEQEGREGRGSRRTVAKGNLCYILNKYHKPFHCIHKTCNSSFTNLKGLIRHYRTVHQYNKEQLCLEKDKARTKRELVKCKKIFACKYKECNKRFLCSKALAKHCSDSHNLDHIEEPKVLSEAGSAARFSCNQPQCPAVFYTFNKLKHHLMEQHNIEGEIHSDYEIHCDLNGCGQIFTHRSNYSQHVYYRHKDYYDDLFRSQKVANERLLRSEKVCQTADTQGHEHQTTRRSFNAKSKKCGLIKEKKAPISFKTRAEALHMCVEHSEHTQYPCMVQGCLSVVKLESSIVRHYKRTHQMSSAYLEQQMENLVVCVKYGTKIKEEPPSEADPCIKKEENRSCESERTEHSHSPGDSSAPIQNTDCCHSSERDGGQKGCIESSSVFDADTLLYRGTLKCNHSSKTTSLEQCNIVQPPPPCKIENSIPNPNGTESGTYFTSFQLPLPRIKESETRQHSSGQENTVKNPTHVPKENFRKHSQPRSFDLKTYKPMGFESSFLKFIQESEEKEDDFDDWEPSEHLTLSNSSQSSNDLTGNVVANNMVNDSEPEVDIPHSSSDSTIHENLTAIPPLIVAETTTVPSLENLRVVLDKALTDCGELALKQLHYLRPVVVLERSKFSTPILDLFPTKKTDELCVGSS

SEQ ID NO: 834851 - protein, 1900 aa, Homo sapiens
RRGKMADGKGDAAAVAGAGAEAPAVAGAGDGVETESMVRGHRPVSPAPGASGLRPCLWQLETELREQEVSEVSSLNYCRSFCQTLLQYASNKNASEHIVYLLEVYRLAIQSFASARPYLTTECEDVLLVLGRLVLSCFELLLSVSESELPCEVWLPFLQSLQESHDALLEFGNNNLQILVHVTKEGVWKNPVLLKILSQQPVETEEVNKLIAQEGPSFLQMRIKHLLKSNCIPQATALSKLCAESKEISNVSSFQQAYITCLCSMLPNEDAIKEIAKVDCKEVLDIICNLESEGQDNTAFVLCTTYLTQQLQTASVYCSWELTLFWSKLQRRIDPSLDTFLERCRQFGVIAKTQQHLFCLIRVIQTEAQDAGLGVSILLCVRALQLRSSEDEEMKASVCKTIACLLPEDLEVRRACQLTEFLIEPSLDGFNMLEELYLQPDQKFDEENAPVPNSLRCELLLALKAHWPFDPEFWDWKTLKRHCHQLLGQEASDSDDDLSGYEMSINDTDVLESFLSDYDEGKEDKQYRRRDLTDQHKEKRDKKPIGSSERYQRWLQYKFFCLLCKRECIEARILHHSKMHMEDGIYTCPVCIKKFKRKEMFVPHVMEHVKMPPSRRDRSKKKLLLKGSQKGICPKSPSAIPEQNHSLNDQAKGESHEYVTFSKLEDCHLQDRDLYPCPGTDCSRVFKQFKYLSVHLKAEHQNNDENAKHYLDMKNRREKCTYCRRHFMSAFHLREHEQVHCGPQPYMCVSIDCYARFGSVNELLNHKQKHDDLRYKCELNGCNIVFSDLGQLYHHEAQHFRDASYTCNFLGCKKFYYSKIEYQNHLSMHNVENSNGDIKKSVKLEESATGEKQDCINQPHLLNQTDKSHLPEDLFCAESANSQIDTETAENLKENSDSNSSDQLSHSSSASMNEELIDTLDHSETMQDVLLSNEKVFGPSSLKEKCSSMAVCFDGTKFTCGFDGCGSTYKNARGMQKHLRKVHPYHFKPKKIKTKDLFPSLGNEHNQTTEKLDAEPKPCSDTNSDSPDEGLDHNIHIKCKREHQGYSSESSICASKRPCTEDTMLELLLRLKHLSLKNSITHGSFSGSLQGYPSSGAKSLQSVSSISDLNFQNQDENMPSQYLAQLAAKPFFCELQGCKYEFVTREALLMHYLKKHNYSKEKVLQLTMFQHRYSPFQCHICQRSFTRKTHLRIHYKNKHQIGSDRATHKLLDNEKCDHEGPCSVDRLKGDCSAELGGDPSSNSEKPHCHPKKDECSSETDLESSCEETESKTSDISSPIGSHREEQEGREGRGSRRTVAKGNLCYILNKYHKPFHCIHKTCNSSFTNLKGLIRHYRTVHQYNKEQLCLEKDKARTKRELVKCKKIFACKYKECNKRFLCSKALAKHCSDSHNLDHIEEPKVLSEAGSAARFSCNQPQCPAVFYTFNKLKHHLMEQHNIEGEIHSDYEIHCDLNGCGQIFTHRSNYSQHVYYRHKDYYDDLFRSQKVANERLLRSEKVCQTADTQGHEHQTTRRSFNAKSKKCGLIKEKKAPISFKTRAEALHMCVEHSEHTQYPCMVQGCLSVVKLESSIVRHYKRTHQMSSAYLEQQMENLVVCVKYGTKIKEEPPSEADPCIKKEENRSCESERTEHSHSPGDSSAPIQNTDCCHSSERDGGQKGCIESSSVFDADTLLYRGTLKCNHSSKTTSLEQCNIVQPPPPCKIENSIPNPNGTESGTYFTSFQLPLPRIKESETRQHSSGQENTVKNPTHVPKPMGFESSFLKFIQESEEKEDDFDDWEPSEHLTLSNSSQSSNDLTGNVVANNMVNDSEPEVDIPHSSSDSTIHENLTAIPPLIVAETTTVPSLENLRVVLDKALTDCGELALKQLHYLRPVVVLERSKFSTPILDLFPTKKTDELCVGSS

SEQ ID NO: 834852 - protein, 131 aa, Homo sapiens
MADGKGDAAAVAGAGAEAPAVAGAGDGVETESMVRGHRPVSPAPGASGLRPCLWQLETELREQEVSEVSSLNYCRSFCQTLLQYASNKNASEHIVYLLEVYRLAIQSFASARPYLTTECEDVLLVLGRLVL

SEQ ID NO: 834853 - protein, 1918 aa, Homo sapiens; identical to SEQ ID NO: 834850

SEQ ID NO: 834854 - protein, 1918 aa, Homo sapiens; identical to SEQ ID NO: 834850

SEQ ID NO: 834855 - protein, 827 aa, Homo sapiens
RRGKMADGKGDAAAVAGAGAEAPAVAGAGDGVETESMVRGHRPVSPAPGASGLRPCLWQLETELREQEVSEVSSLNYCRSFCQTLLQYASNKNASEHIVYLLEVYRLAIQSFASARPYLTTECEDVLLVLGRLVLSCFELLLSVSESELPCEVWLPFLQSLQESHDALLEFGNNNLQILVHVTKEGVWKNPVLLKILSQQPVETEEVNKLIAQEGPSFLQMRIKHLLKSNCIPQATALSKLCAESKEISNVSSFQQAYITCLCSMLPNEDAIKEIAKVDCKEVLDIICNLESEGQDNTAFVLCTTYLTQQLQTASVYCSWELTLFWSKLQRRIDPSLDTFLERCRQFGVIAKTQQHLFCLIRVIQTEAQDAGLGVSILLCVRALQLRSSEDEEMKASVCKTIACLLPEDLEVRRACQLTEFLIEPSLDGFNMLEELYLQPDQKFDEENAPVPNSLRCELLLALKAHWPFDPEFWDWKTLKRHCHQLLGQEASDSDDDLSGYEMSINDTDVLESFLSDYDEGKEDKQYRRRDLTDQHKEKRDKKPIGSSERYQRWLQYKFFCLLCKRECIEARILHHSKMHMEDGIYTCPVCIKKFKRKEMFVPHVMEHVKMPPSRRDRSKKKLLLKGSQKGICPKSPSAIPEQNHSLNDQAKGESHEYVTFSKLEDCHLQDRDLYPCPGTDCSRVFKQFKYLSVHLKAEHQNNDENAKHYLDMKNRREKCTYCRRHFMSAFHLREHEQVHCGPQPYMCVSIDCYARFGSVNELLNHKQKHDDLRYKCELNGCNIVFSDLGQLYHHGTWIHKGTWITMARGSQWHVDHNGTWITMARG

SEQ ID NO: 834856 - protein, 131 aa, Homo sapiens
MEEAGLCGLREKADMLCNSESHDILQHQDSNCSATSNKHLLEDEEGRDFITKNRSWVSPVHCTQESRRELPEQEVAPPSGQQALQCNRNKEKVLERQGLSLSPRLERGGTFMGHGSLKLPELVILSLQTLE

SEQ ID NO: 834857 - protein, 181 aa, Homo sapiens
MKQEEAQLKEQLFLYMDKFEEFQTTMAKTNELFTAFKQETEKLTKKIKKLEKEMVIWYTKWENNNTTLLQMAEEKTIRDKNYKVFQIKLERLEKLYKALQIERNELSEKLGILKGQVSVKVADVDLAVPVTHSCADLDSSNMLNTSSKRAPGVHLEADPKGMNEVKCYSKALSTGSPLGID

SEQ ID NO: 834858 - protein, 181 aa, Homo sapiens; identical to SEQ ID NO: 834857

SEQ ID NO: 834859 - protein, 131 aa, Homo sapiens
MEEAGLCGLREKADMLCNSESHDILQHQDSNCSATSNKHLLEDEEGRDFITKNRSWVSPVHCTQESRRELPEQEVAPPSGQQALQCNRNKEKVLGKEVLLLMQALNTLSTPEEKLAALCKKYADLGNSPLL

SEQ ID NO: 834860 - protein, 217 aa, Homo sapiens
AAAAVRPARAPAPAPPDPLAVAPSSVGRVVPRAPPPRAYENEVVTGPRMTPRHHCEAYSSAGEEEEEEEEEKFVNSTMEEAGLCGLREKADMLCNSESHDILQHQDSNCSATSNKHLLEDEEGRDFITKNRSWVSPVHCTQESRRELPEQEVAPPSGQQALQCNRNKEKVLGNNLCSVVGCCHILVFLFYIFCSMSDYELGLFGGKCCLVNLFLHLV

SEQ ID NO: 834861 - protein, 174 aa, Homo sapiens
FAAEVTSWRRGEVTPRRGSGGGAKTIGAKQGRTQLSSGFVNSTMEEAGLCGLREKADMLCNSESHDILQHQDSNCSATSNKHLLEDEEGRDFITKNRSWVSPVHCTQESRRELPEQEVAPPSGQQALQCNRNKEKVLGKEVLLLMQALNTLSTPEEKLAALCKKYADLGNSPLL

SEQ ID NO: 834862 - protein, 145 aa, Homo sapiens
MEEAGLCGLREKADMLCNSESHDILQHQDSNCSATSNKHLLEDEEGRDFITKNRSWVSPVHCTQESRRELPEQEVAPPSGQQALQCNRNKEKVLERQGLSLSPRLERGGKEVLLLMQALNTLSTPEEKLAALCKKYADLGNSPLL

SEQ ID NO: 834863 - protein, 174 aa, Homo sapiens
FAAEVTSWRRGEVTPRRGSGGGAKTIGAKQGRTQLSSGFVNSTMEEAGLCGLREKADMLCNSESHDILQHQDSNCSATSNKHLLEDEEGRDFITKNRSWVSPVHCTQESRRELPEQEVAPPSGQQALQCNRNKEKVLERQGLSLSPRLERGGTFMGHGSLKLPELVILSLQTLE

SEQ ID NO: 834864 - protein, 140 aa, Homo sapiens
MEEAGLCGLREKADMLCNSESHDILQHQDSNCSATSNKHLLEDEEGRDFITKNRSWVSPVHCTQESRRELPEQEVAPPSGQQALQCNRNKEKVLGNNLCSVVGCCHILVFLFYIFCSMSDYELGLFGGKCCLVNLFLHLV

SEQ ID NO: 834865 - protein, 131 aa, Homo sapiens; identical to SEQ ID NO: 834856

SEQ ID NO: 834866 - protein, 678 aa, Homo sapiens
MNASSEGESFAGSVQIPGGTTVLVELTPDIHICGICKQQFNNLDAFVAHKQSGCQLTGTSAAAPSTVQFVSEETVPATQTQTTTRTITSETQTITVSAPEFVFEHGYQTYLPTESNENQTATVISLPAKSRTKKPTTPPAQKRLNCCYPGCQFKTAYGMKDMERHLKIHTGDKPHKCEVCGKCFSRKDKLKTHMRCHTGVKPYKCKTCDYAAADSSSLNKHLRIHSDERPFKCQICPYASRNSSQLTVHLRSHTGDTPFQCWLCSAKFKISSDLKRHMLVHSGEKPFKCEFCDVRCTMKANLKSHIRIKHTFKCLHCAFQGRDRADLLEHSRLHQADHPEKCPECSYSCSSKAALRIHERIHCTDRPFKCNYCSFDTKQPSNLSKHMKKFHGDMVKTEALERKDTGRQSSRQVAKLDAKKSFHCDICDASFMREDSLRSHKRQHSEYSESKNSDVTVLQFQIDPSKQPATPLTVGHLQVPLQPSQVPQFSEGRVKIIVGHQVPQANTIVQAAAAAVNIVPPALVAQNPEELPGNSRLQILRQVSLIAPPQSSRCPSEAGAMTQPAVLLTTHEQTDGATLHQTLIPTASGGPQEGSGNQTFITSSGITCTDFEGLNALIQEGTAEVTVVSDGGQNIAVATTAPPVFSSSSQQELPKQTYSIIQGAAHPALLCPADSIPD

SEQ ID NO: 834867 - protein, 200 aa, Homo sapiens
MKDMERHLKIHTGDKPHKCEVCGKCFSRKDKLKTHMRCHTGVKPYKCKTCDYAAADSSSLNKHLRIHSDERPFKCQICPYASRNSSQLTVHLRSHTASELDDDVPKANCLSTESTDTPKAPVITLPSEAREQMATLGERTFNCCYPGCHFKTVHGMKDLDRHLRIHTAPFDQQPRGRCRAACCLEEVRGRGPPDHSPCGS

SEQ ID NO: 834868 - protein, 624 aa, Homo sapiens
MNASSEGESFAGSVQIPGGTTVLVELTPDIHICGICKQQFNNLDAFVAHKQSGCQLTGTSAAAPSTVQFVSEETVPATQTQTTTRTITSETQTITGCQFKTAYGMKDMERHLKIHTGDKPHKCEVCGKCFSRKDKLKTHMRCHTGVKPYKCKTCDYAAADSSSLNKHLRIHSDERPFKCQICPYASRNSSQLTVHLRSHTGDTPFQCWLCSAKFKISSDLKRHMLVHSGEKPFKCEFCDVRCTMKANLKSHIRIKHTFKCLHCAFQGRDRADLLEHSRLHQADHPEKCPECSYSCSSKAALRIHERIHCTDRPFKCNYCSFDTKQPSNLSKHMKKFHGDMVKTEALERKDTGRQSSRQVAKLDAKKSFHCDICDASFMREDSLRSHKRQHSEYSESKNSDVTVLQFQIDPSKQPATPLTVGHLQVPLQPSQVPQFSEGRVKIIVGHQVPQANTIVQAAAAAVNIVPPALVAQNPEELPGNSRLQILRQVSLIAPPQSSRCPSEAGAMTQPAVLLTTHEQTDGATLHQTLIPTASGGPQEGSGNQTFITSSGITCTDFEGLNALIQEGTAEVTVVSDGGQNIAVATTAPPVFSSSSQQELPKQTYSIIQGAAHPALLCPADSIPD

SEQ ID NO: 834869 - protein, 426 aa, Homo sapiens
MSRRKQAKPQHLNSEEPRPARRECAEVAPQVAGEPASELDDDVPKANCLSTESTDTPKAPVITLPSEAREQMATLGERTFNCCYPGCHFKTVHGMKDLDRHLRIHTGDKPHKCEFCDKCFSRKDNLTMHMRCHTSVKPHKCHLCDYAAVDSSSLKKHLRIHSDERPYKCQLCPYASRNSSQLTVHLRSHTGDTPFQCWLCSAKFKISSDLKRHMIVHSGEKPFKCEFCDVRCTMKANLKSHIRIKHTFKCLHCAFQGRDRADLLEHSRLHQADHPEKCPECSYSCSSAAALRVHSRVHCKDRPFKCDFCSFDTKRPSSLAKHVDKVHRDEAKTENRAPLGKEGLREGSSQHVAKIVTQRAFRCETCGASFVRDDSLRCHKKQHSDQSENKNSDLVTFPPESGASGQLSTLVSVGQLEAPLEPSQDL

SEQ ID NO: 834870 - protein, 734 aa, Homo sapiens
AHDRPTVQVGDLPVCLPGTRFTEGEKLSQGSGAIFPWCASETAAWMEDMSVPERVASIVRRSCEVSSLDEACDAFVASQGKSGVPADRHIAEQATQVRVQVCIGQETTCACADTEDVQTNTTNEPSQPSEKTLGRDHQVCEALREEVWFYFEASGYRESFELVAQRDKVTGKEPGQATVISLPAKSRTKKPTTPPAQKRLNCCYPGCQFKTAYGMKDMERHLKIHTGDKPHKCEVCGKCFSRKDKLKTHMRCHTGVKPYKCKTCDYAAADSSSLNKHLRIHSDERPFKCQICPYASRNSSQLTVHLRSHTGDTPFQCWLCSAKFKISSDLKRHMRVHSGEKPFKCEFCDVRCTMKANLKSHIRIKHTFKCLHCAFQGRDRADLLEHSRLHQADHPEKCPECSYSCSSKAALRIHERIHCTDRPFKCNYCSFDTKQPSNLSKHMKKFHGDMVKTEALERKDTGRQSSRQVAKLDAKKSFHCDICDASFMREDSLRSHKRQHSEYSESKNSDVTVLQFQIDPSKQPATPLTVGHLQVPLQPSQVPQFSEGRVKIIVGHQVPQANTIVQAAAAAVNIVPPALVAQNPEELPGNSRLQILRQVSLIAPPQSSRCPSEAGAMTQPAVLLTTHEQTDGATLHQTLIPTASGGPQEGSGNQTFITSSGITCTDFEGLNALIQEGTAEVTVVSDGGQNIAVATTAPPVFSSSSQQELPKQTYSIIQGAAHPALLCPADSIPD

SEQ ID NO: 834871 - protein, 515 aa, Homo sapiens
MNASSEGESFAGSVQIPGGTTVLVELTPDIHICGICKQQFNNLDAFVAHKQSGCQLTGTSAAAPSTVQFVSEETVPATQTQTTTRTITSETQTITVSAPEFVFEHGYQTYLPTESNENQTATVISLPAKSRTKKPTTPPAQKRLNCCYPGCQFKTAYGMKDMERHLKIHTGDKPHKCEVCGKCFSRKDKLKTHMRCHTGVKPYKCKTCDYAAADSSSLNKHLRIHSDERPFKCQICPYASRNSSQLTVHLRSHTGDTPFQCWLCSAKFKISSDLKRHMLVHSGEKPFKCEFCDVRCTMKANLKSHIRIKHTFKCLHCAFQGRDRADLLEHSRLHQADHPEKCPECSYSCSSKAALRIHERIHCTDRPFKCNYCSFDTKQPSNLSKHMKKFHGDMVKTEALERKDTGRQSSRQVAKLECSGAILAHCNVRLPGSSDSHASALRVAGTTGVRHHDWLIFVYLVETGFHHVELLTSSDLPTSASQSAGITGVSHHAWPWFALNVFKDGCESPWPHNKL

SEQ ID NO: 834872 - protein, 259 aa, Homo sapiens
MNASSEGESFAGSVQIPGGTTVLVELTPDIHICGICKQQFNNLDAFVAHKQSGCQLTGTSAAAPSTVQFVSEETVPATQTQTTTRTITSETQTITVSAPEFVFEHGYQTYLPTESNENQTATVISLPAKSRTKKPTTPPAQKRLNCCYPGCQFKTAYGMKDMERHLKIHTGDKPHKCEVCGKCFSRKDKLKTHMRCHTGVKPYKCKTCDYAAADSSSLNKHLRIHSDERPFKCQICPYASRNSSQLTVHLRSHTGPGPG

SEQ ID NO: 834873 - protein, 591 aa, Homo sapiens
MNASSEGESFAGSVQIPGGTTVLVELTPDIHICGICKQQFNNLDAFVAHKQSGCQLTGTSAAAPSTVQFVSEETVPATQTQTTTRTITSETQTITGCQFKTAYGMKDMERHLKIHTGDKPHKCEVCGKCFSRKDKLKTHMRCHTGVKPYKCKTCDYAAADSSSLNKHLRIHSDERPFKCQICPYASRNSSQLTVHLRSHTASELDDDVPKANCLSTESTDTPKAPVITLPSEAREQMATLGERTFNCCYPGCHFKTVHGMKDLDRHLRIHTGDKPHKCEFCDKCFSRKDNLTMHMRCHTSVKPHKCHLCDYAAVDSSSLKKHLRIHSDERPYKCQLCPYASRNSSQLTVHLRSHTGDTPFQCWLCSAKFKISSDLKRHMIVHSGEKPFKCEFCDVRCTMKANLKSHIRIKHTFKCLHCAFQGRDRADLLEHSRLHQADHPEKCPECSYSCSSAAALRVHSRVHCKDRPFKCDFCSFDTKRPSSLAKHVDKVHRDEAKTENRAPLGKEGLREGSSQHVAKIVTQRAFRCETCGASFVRDDSLRCHKKQHSDQSENKNSDLVTFPPESGASGQLSTLVSVGQLEAPLEPSQDL

SEQ ID NO: 834874 - protein, 244 aa, Homo sapiens [sequence omitted]

SEQ ID NO: 834875 - protein, 112 aa, Homo sapiens
FRKAVGNKPFPFLNLVSCCHLCVYVFEGDKPHKCEVCGKCFSRKDKLKTHMRCHTGVKPYKCKTCDYAAADSSSLNKHLRIHSDERPFKCQICPYASRNSSQLTVHLRSHTG

SEQ ID NO: 834876 - protein, 142 aa, Homo sapiens
MNASSEGESFAGSVQIPGGTTVLVELTPDIHICGICKQQFNNLDAFVAHKQSGCQLTGTSAAAPSTVQFVSEETVPATQTQTTTRTITSETQTITDGASLCCPGWSAMTRSWPTATSASRVQAILPQPPEWLGLQVPTTTPS

SEQ ID NO: 834877 - protein, 624 aa, Homo sapiens; identical to SEQ ID NO: 834868

SEQ ID NO: 834878 - protein, 678 aa, Homo sapiens
MTEGVRAFDGEPPTDVPGGTTVLVELTPDIHICGICKQQFNNLDAFVAHKQSGCQLTGTSAAAPSTVQFVSEETVPATQTQTTTRTITSETQTITVSAPEFVFEHGYQTYLPTESNENQTATVISLPAKSRTKKPTTPPAQKRLNCCYPGCQFKTAYGMKDMERHLKIHTGDKPHKCEVCGKCFSRKDKLKTHMRCHTGVKPYKCKTCDYAAADSSSLNKHLRIHSDERPFKCQICPYASRNSSQLTVHLRSHTGDTPFQCWLCSAKFKISSDLKRHMLVHSGEKPFKCEFCDVRCTMKANLKSHIRIKHTFKCLHCAFQGRDRADLLEHSRLHQADHPEKCPECSYSCSSKAALRIHERIHCTDRPFKCNYCSFDTKQPSNLSKHMKKFHGDMVKTEALERKDTGRQSSRQVAKLDAKKSFHCDICDASFMREDSLRSHKRQHSEYSESKNSDVTVLQFQIDPSKQPATPLTVGHLQVPLQPSQVPQFSEGRVKIIVGHQVPQANTIVQAAAAAVNIVPPALVAQNPEELPGNSRLQILRQVSLIAPPQSSRCPSEAGAMTQPAVLLTTHEQTDGATLHQTLIPTASGGPQEGSGNQTFITSSGITCTDFEGLNALIQEGTAEVTVVSDGGQNIAVATTAPPVFSSSSQQELPKQTYSIIQGAAHPALLCPADSIPD

SEQ ID NO: 834879 - protein, 645 aa, Homo sapiens
MNASSEGESFAGSVQIPGGTTVLVELTPDIHICGICKQQFNNLDAFVAHKQSGCQLTGTSAAAPSTVQFVSEETVPATQTQTTTRTITSETQTITVSAPEFVFEHGYQTYLPTESNENQTATVISLPAKSRTKKPTTPPAQKRLNCCYPGCQFKTAYGMKDMERHLKIHTGDKPHKCEVCGKCFSRKDKLKTHMRCHTGVKPYKCKTCDYAAADSSSLNKHLRIHSDERPFKCQICPYASRNSSQLTVHLRSHTASELDDDVPKANCLSTESTDTPKAPVITLPSEAREQMATLGERTFNCCYPGCHFKTVHGMKDLDRHLRIHTGDKPHKCEFCDKCFSRKDNLTMHMRCHTSVKPHKCHLCDYAAVDSSSLKKHLRIHSDERPYKCQLCPYASRNSSQLTVHLRSHTGDTPFQCWLCSAKFKISSDLKRHMIVHSGEKPFKCEFCDVRCTMKANLKSHIRIKHTFKCLHCAFQGRDRADLLEHSRLHQADHPEKCPECSYSCSSAAALRVHSRVHCKDRPFKCDFCSFDTKRPSSLAKHVDKVHRDEAKTENRAPLGKEGLREGSSQHVAKIVTQRAFRCETCGASFVRDDSLRCHKKQHSDQSENKNSDLVTFPPESGASGQLSTLVSVGQLEAPLEPSQDL

SEQ ID NO: 834880 - protein, 487 aa, Homo sapiens
MKDMERHLKIHTGDKPHKCEVCGKCFSRKDKLKTHMRCHTGVKPYKCKTCDYAAADSSSLNKHLRIHSDERPFKCQICPYASRNSSQLTVHLRSHTASELDDDVPKANCLSTESTDTPKAPVITLPSEAREQMATLGERTFNCCYPGCHFKTVHGMKDLDRHLRIHTGDKPHKCEFCDKCFSRKDNLTMHMRCHTSVKPHKCHLCDYAAVDSSSLKKHLRIHSDERPYKCQLCPYASRNSSQLTVHLRSHTGDTPFQCWLCSAKFKISSDLKRHMIVHSGEKPFKCEFCDVRCTMKANLKSHIRIKHTFKCLHCAFQGRDRADLLEHSRLHQADHPEKCPECSYSCSSAAALRVHSRVHCKDRPFKCDFCSFDTKRPSSLAKHVDKVHRDEAKTENRAPLGKEGLREGSSQHVAKIVTQRAFRCETCGASFVRDDSLRCHKKQHSDQSENKNSDLVTFPPESGASGQLSTLVSVGQLEAPLEPSQDL

SEQ ID NO: 834881 - protein, 426 aa, Homo sapiens
MNASSEGESFAGSVQIPGGTTVLVELTPDIHICGICKQQFNNLDAFVAHKQSGCQLTGTSAAAPSTVQFVSEETVPATQTQTTTRTITSETQTITVSAPEFVFEHGYQTYLPTESNENQTATVISLPAKSRTKKPTTPPAQKRLNCCYPGCQFKTAYGMKDMERHLKIHTGDKPHKCEVCGKCFSRKDKLKTHMRCHTGVKPYKCKTCDYAAADSSSLNKHLRIHSDERPFKCQICPYASRNSSQLTVHLRSHTASELDDDVPKANCLSTESTDTPKAPVITLPSEAREQMATLGERTFNCCYPGCHFKTVHGMKDLDRHLRIHTGDKPHKCEFCDKCFSRKDNLTMHMRCHTSVKPHKCHLCDYAAVDSSSLKKHLRIHSDERPYKCQLCPYASRNSSQLTVHLRSHTGESLTRKPQSLTFSLIS

SEQ ID NO: 834882 - protein, 226 aa, Homo sapiens
MSEYIRVTEDENDEPIEIPSEDDGTVLLSTVTAQFPGACGLRCRNPVSQCMRGVRLVEGILHAPDAGWRNPVYVVNYPKDNKRKMGETEASSAVKVKRPVRFNSVGSPMENNEQDLKEYCSTFGDVLMVRQSQDEPLRSRKVFVGRRTEDMTEDELWEFFSQYGDVMDVFVPKPFRAFAFVPFADDQIARSLCGEDSMKGISVHISNAEPKRNSNRQQEVEDLVVI

SEQ ID NO: 834883 - protein, 154 aa, Homo sapiens [sequence omitted]

SEQ ID NO: 834884 - protein, 135 aa, Homo sapiens
NSVCLLNDSYMIPLTQVITWIQHLIPKIEDGNDFGVAIQEKVLERVNAVKTKVEAFQTTISKYFSERGDAVAKASKETHVMDYRALVHERDEAAYGELRAMVLDLRAFYAELYHIISSNLEKIVNPKGEEKPSMY

SEQ ID NO: 834885 - protein, 282 aa, Homo sapiens
MAKPCGVRLSGEARKQVEVFRQNLFQEFRSSVSSFASLGPSDFQRPFQFHLSDISLSIFCDSPPLQCNPQAEEFLYRFLPQKIIYLNQLLQEDSLNVADLTSLRAPLDIPIPDPPPKDDEMETDKQEKKEVPKCGFLPGNEKVLSLLALVKPEVWTLKEKCILVITWIQHLIPKIEDGNDFGVAIQEKVLERVNAVKTKVEAFQTTISKYFSERGDAVAKASKETHVMDYRALVHERDEAAYGELRAMVLDLRAFYAELYHIISSNLEKIVNPKGEEKPSMY

SEQ ID NO: 834886 - protein, 162 aa, Homo sapiens
METDKQEKKEVPKCGFLPGNEKVLSLLALVKPEVWTLKEKCILVITWIQHLIPKIEDGNDFGVAIQEKVLERVNAVKTKVEAFQTTISKYFSERGDAVAKASKETHVMDYRALVHERDEAAYGELRAMVLDLRAFYAELYHIISSNLEKIVNPKGEEKPSMY

SEQ ID NO: 834887 - protein, 162 aa, Homo sapiens; identical to SEQ ID NO: 834886

SEQ ID NO: 834888 - protein, 162 aa, Homo sapiens; identical to SEQ ID NO: 834886

SEQ ID NO: 834889 - protein, 162 aa, Homo sapiens; identical to SEQ ID NO: 834886

SEQ ID NO: 834890 - protein, 162 aa, Homo sapiens; identical to SEQ ID NO: 834886

SEQ ID NO: 834891 - protein, 162 aa, Homo sapiens; identical to SEQ ID NO: 834886

SEQ ID NO: 834892 - protein, 162 aa, Homo sapiens; identical to SEQ ID NO: 834886

SEQ ID NO: 834893 - protein, 163 aa, Homo sapiens [sequence omitted]

SEQ ID NO: 834894 - protein, 163 aa, Homo sapiens [sequence omitted]

SEQ ID NO: 834895 - protein, 110 aa, Homo sapiens
METDKQEKKEVPKCGFLPGNEKVLSLLALVKPEVWTLKEKCILVITWIQHLIPKIEDGNDFGVAIQEKVLERVNAVKTKVEAFQTTISKYFSERGDAVAKASKETHVVSG

SEQ ID NO: 834896 - protein, 107 aa, Homo sapiens
MAKPCGVRLSGEARKQVEVFRQNLFQEFRSSVSSFASLGPSDFQRPFQFHLSDISLSIFCDSPPLQCNPQAEEFLYRFLPQKIIYLNQLLQLRAMVLDLRAFYVSVE

SEQ ID NO: 834897 - protein, 162 aa, Homo sapiens; identical to SEQ ID NO: 834886

SEQ ID NO: 834898 - protein, 162 aa, Homo sapiens; identical to SEQ ID NO: 834886

SEQ ID NO: 834899 - protein, 162 aa, Homo sapiens; identical to SEQ ID NO: 834886

SEQ ID NO: 834900 - protein, 162 aa, Homo sapiens; identical to SEQ ID NO: 834886

SEQ ID NO: 834901 - protein, 162 aa, Homo sapiens; identical to SEQ ID NO: 834886

SEQ ID NO: 834902 - protein, 162 aa, Homo sapiens; identical to SEQ ID NO: 834886

SEQ ID NO: 834903 - protein, 163 aa, Homo sapiens [sequence omitted]

SEQ ID NO: 834904 - protein, 140 aa, Homo sapiens
METDKQEKKEVPKCGFLPGNEKVLSLLALVKPEVWTLKEKCILVITWIQHLIPKIEDGNDFGVAIQEKVLERVNAVKTKVEAFQTTISKYFSERGDAVAKASKETHVMDYRALVHERDEAAYGELRAMVLDLRAFYVSVE

SEQ ID NO: 834905 - protein, 110 aa, Homo sapiens; identical to SEQ ID NO: 834895

SEQ ID NO: 834906 - protein, 346 aa, Homo sapiens
MEYQILKMSLCLFILLFLTPGILCICPLQCICTERHRHVDCSGRNLSTLPSGLQENIIHLNLSYNHFTDLHNQLTQYTNLRTLDISNNRLESLPAHLPRSLWNMSAANNNIKLLDKSDTAYQWNLKYLDVSKNMLEKVVLIKNTLRSLEVLNLSSNKLWTVPTNMPSKLHIVDLSNNSLTQILPGTLINLTNLTHLYLHNNKFTFIPDQSFDQLFQLQEITLYNNRWSCDHKQNITYLLKWMMETKAHVIGTPCSTQISSLKEHNMYPTPSGFTSSLFTVSGMQTVDTINSLSVVTQPKVTKIPKQYRTKETTFGATLSKDTTFTSTDKAFCALSRRYIHRDYQFT

SEQ ID NO: 834907 - protein, 321 aa, Homo sapiens
MSLCLFILLFLTPGILCICPLQCICTERHRHVDCSGRNLSTLPSGLQENIIHLNLSYNHFTDLHNQLTQYTNLRTLDISNNRLESLPAHLPRSLWNMSAANNNIKLLDKSDTAYQWNLKYLDVSKNMLEKVVLIKVPTNMPSKLHIVDLSNNSLTQILPGTLINLTNLTHLYLHNNKFTFIPDQSFDQLFQLQEITLYNNRWSCDHKQNITYLLKWMMETKAHVIGTPCSTQISSLKEHNMYPTPSGFTSSLFTVSGMQTVDTINSLSVVTQPKVTKIPKQYRTKETTFGATLSKDTTFTSTDKAFCALSRRYIHRDYQFT

SEQ ID NO: 834908 - protein, 346 aa, Homo sapiens; identical to SEQ ID NO: 834906

SEQ ID NO: 834909 - protein, 121 aa, Homo sapiens
VCSRGVPRGIRFVPYPEDTSTETINSHEAAAATLTIHLQDGMVTNTSLTSSTKSSPTPMTLSITSGMPNNFSEMPQQSTTLNLWREETTTNVKTPLPSVANAWKVNASFLLLLNVVVMLAV

SEQ ID NO: 834910 - protein, 439 aa, Homo sapiens
MEYQILKMSLCLFILLFLTPILCICPLQCICTERHRHVDCSGRNLSTLPSGLQENIIHLNLSYNHFTDLHNQLTQYTNLRTLDISNNRLESLPAHLPRSLWNMSAANNNIKLLDKSDTAYQWNLKYLDVSKNMLEKVVLIKNTLRSLEVLNLSSNKLWTVPTNMPSKLHIVDLSNNSLTQILPGTLINLTNLTHLYLHNNKFTFIPDQSFDQLFQLQEITLYNNRWSCDHKQNITYLLKWMMETKAHVIGTPCSTQISSLKEHNMYPTPSGFTSSLFTVSGMQTVDTINSLSVVTQPKVTKIPKQYRTKETTFGATLSKDTTFTSTDKAFVPYPEDTSTETINSHEAAAATLTIHLQDGMVTNTSLTSSTKSSPTPMTLSITSGMPNNFSEMPQQSTTLNLWREETTTNVKTPLPSVANAWKVNASFLLLLNVVVMLAV

SEQ ID NO: 834911 - protein, 443 aa, Homo sapiens
WPYMGSRVTDGTHSHKTLRGRRNPRLLGRRAAALAIERAGRERGVAPPLGRRAPSRPQPRGSPSRASPADTLAVDTLAVGTRGARGAGPLAGGGGGMKVTSLDGRQLRKMLRKEAAARCVVLDCRPYLAFAASNVRGSLNVNLNSVVLRRARGGAVSARYVLPDEAARARLLQEGGGGVAAVVVLDQGSRHWQKLREESAARVVLTSLLACLPAGPRVYFLKGGYETFYSEYPECCVDVKPISQEKIESERALISQCGKPVVNVSYRPAYDQGGPVEILPFLYLGSAYHASKCEFLANLHITALLNVSRRTSEACMTHLHYKWIPVEDSHTADISSHFQEAIDFIDCVREKGGKVLVHCEAGISRSPTICMAYLMKTKQFRLKEAFDYIKQRRSMVSPNFGFMGQLLQYESENPALHAQPPASLLPRGGSRLFTDRPFADTEP

SEQ ID NO: 834912 - protein, 416 aa, Homo sapiens
WPYMGSRVTDGTHSHKTLRGRRNPRLLGRRAAGWLSSERGGNAELRRRSGAGLRRGARGAGPLAGGGGGMKVTSLDGRQLRKMLRKEAAARCVVLDCRPYLAFAASNVRGSLNVNLNSVVLRRARGGAVSARYVLPDEAARARLLQEGGGGVAAVVVLDQGSRHWQKLREESAARVVLTSLLACLPAGPRVYFLKGGYETFYSEYPECCVDVKPISQEKIESERALISQCGKPVVNVSYRPAYDQGGPVEILPFLYLGSAYHASKCEFLANLHITALLNVSRRTSEACMTHLHYKWIPVEDSHTADISSHFQEAIDFIDCVREKGGKVLVHCEAGISRSPTICMAYLMKTKQFRLKEAFDYIKQRRSMVSPNFGFMGQLLQYESENPALHAQPPASLLPRGGSRLFTDRPFADTEP

SEQ ID NO: 834913 - protein, 499 aa, Homo sapiens
WPYMGSRVTDGTHSHKTLRGRRNPRLLGRRAAGLAIERAGRERGVAPPLGRRAPSRPQPRGSPSRASPADTLAVDTLAVGTRGARGAGPLAGGGGGMKVTSLDGRQLRKMLRKEAAARCVVLDCRPYLAFAASNVRGSLNVNLNSVVLRRARGGAVSARYVLPDEAARARLLQEGGGGVAAVVVLDQGSRHWQKLREESAARVVLTSLLACLPAGPRVYFLKGGYETFYSEYPECCVDVKPISQEKIESERALISQCGKPVVNVSYRPAYDQITETRGNQKILEGFMFLKLGGPVEILPFLYLGSAYHASKCEFLANLHITALLNVSRRTSEACMTHLHYKWIPVEDSHTADISSHFQEAIDFIDCVREKGGKVLVHCEAGISRSPTICMAYLMKTKQFRLKEAFDYIKQRRSMVSPNFGFMGQLLQYESEILPSTPNPQPPSCQGEAAGSSLIGHLQTLSPDMQGAYCTFPASVLAPVPTHSTVSELSRSPVATATSC

SEQ ID NO: 834914 - protein, 213 aa, Homo sapiens
WPYMGSRVTDGTHSHKTLRGRRNPRLLGRRAAALAIERAGRERGVAPPLGRRAPSRPQPRGSPSRASPADTLAVDTLAVGTRGARGAGPLAGGGGGMKVTSLDGRQLRKMLRKEAAARCVVLDCRPYLAFAASNVRGSLNVNLNSVVLRRARGGAVSARYVWTRAAATGRSCERRAPRVSSSPRYSLAYPPARGSTSSKVSARGPCHARPSGA

SEQ ID NO: 834915 - protein, 443 aa, Homo sapiens; identical to SEQ ID NO: 834911

SEQ ID NO: 834916 - protein, 443 aa, Homo sapiens; identical to SEQ ID NO: 834911

SEQ ID NO: 834917 - protein, 289 aa, Homo sapiens
WPYMGSRVTDGTHSHKTLRGRRNPRLLGRRAAALAIERAGRERGVAPPLGRRAPSRPQPRGSPSRASPADTLAVDTLAVGTRGARGAGPLAGGGGGMKVTSLDGRQLRKMLRKEAAARCVVLDCRPYLAFAASNVRGSLNVNLNSVVLRRARGGAVSARYVLPDEAARARLLQEGGGGVAAVVVLDQGSRHWQKLREESAARVVLTSLLACLPAGPRVYFLKGGYETFYSEYPECCVDVKPISQEKIESERALISQCGKPVVNVSYRPAYDQITETRGNQKILEGFMFL

SEQ ID NO: 834918 - protein, 74 aa, Homo sapiens
MPPARCAWRGLAGFLRAEELLNKTVKRKTHRLLRENSLYTCVRAPGLIAPCWMCQKEECKDSEARWAVPSPSPK

SEQ ID NO: 834919 - protein, 432 aa, Homo sapiens
SGTGACAAAGLPLVGPHVEPLLVLLTRAPRNLQLGPVWDWKPAMAASAAETRVFLEVRGQLQSALLILGEPKEGGMPMNISIMPSSLQMKTPEGCTEIQLPAEVRLVPSSCRGLQFVVGDGLHLRLQTQAKLGTKLISMFNQSSQTQECCTFYCQSCGEVIIKDRKLLRVLPLPSENWGALVGEWCCHPDPFANKSLHPQENDCFIGDSFFLVNLRTSLWQQRPELSPVEMCCVSSDNHCKLEPKANTKVICKRCKVMLGETVSSETTKFYMTEIIIQSSERSFPIIPRSWFVQSVIAQCLVQLSSARSTFRFTIQGQDDKVYILLWLLNSDSLVIESLRNSKYIKKFPLLENTFKADSSSAWSAVKVLYQPCIKSRNEKLVSLWESDISVHPLTLPSATCLELLLILSKSNANLPSSLRRVNSFQVAFLKM

SEQ ID NO: 834920 - protein, 357 aa, Homo sapiens
MPMNISIMPSSLQMKTPEGCTEIQLPAEVRLVPSSCRGLQFVVGDGLHLRLQTQAKLGTKLISMFNQSSQTQECCTFYCQSCGEVIIKDRKLLRVLPLPSENWGALVGEWCCHPDPFANKSLHPQENDCFIGDSFFLVNLRTSLWQQRPELSPVEMCCVSSDNHCKLEPKANTKVICKRCKVMLGETVSSETTKFYMTEIIIQSSERSFPIIPRSWFVQSVIAQCLVQLSSARSTFRFTIQGQDDKVYILLWLLNSDSLVIESLRNSKYIKKFPLLENTFKADSSSAWSAVKVLYQPCIKSRNEKLVSLWESDISVHPLTLPSATCLELLLILSKSNANLPSSLRRVNSFQVAFLKM

SEQ ID NO: 834921 - protein, 357 aa, Homo sapiens; identical to SEQ ID NO: 834920

SEQ ID NO: 834922 - protein, 357 aa, Homo sapiens; identical to SEQ ID NO: 834920

SEQ ID NO: 834923 - protein, 432 aa, Homo sapiens; identical to SEQ ID NO: 834919

SEQ ID NO: 834924 - protein, 208 aa, Homo sapiens
RWSHVLSPRLECSGTISAHCNICLLVSSNYPASPSRVAGTTETTKFYMTEIIIQSSERSFPIIPRSWFVQSVIAQCLVQLSSARSTFRFTIQGQDDKVYILLWLLNSDSLVIESLRNSKYIKKFPLLENTFKADSSSAWSAVKVLYQPCIKSRNEKLVSLWESDISVHPLTLPSATCLELLLILSKSNANLPSSLRRVNSFQVAFLKM

SEQ ID NO: 834925 - protein, 321 aa, Homo sapiens
MPSSLQMKTPEGCTEIQLPAEVRLVPSSCRGLQFVVGDGLHLRLQTQAKLGTKLISMFNQSSQTQECCTFYCQSCGEVIIKDRKLLRVLPLPSENWGALVGEWCCHPDPFANKSLHPQENDCFIGDSFFLVNLRTSLWQQRPELSPVEMCCVSSDNHCKLEPKANTKVICKRCKVMLGETVSSARSCCCKRWAPMALNSSVPVVLPETTKFYMTEIIIQSSERSFPIIPRSWFVQSVIAQCLVQLSSARSTFRFTIQGQDDKVYILLWLLNSDSLVIESLRNSKYIKKFPLLENTFKADSSSAWSAVKVLYQPCIKSRNEK

SEQ ID NO: 834926 - protein, 205 aa, Homo sapiens
MPMNISIMPSSLQMKTPEGCTEIQLPAEVRLVPSSCRGLQFVVGDGLHLRLQTQAKLGTKLISMFNQSSQTQECCTFYCQSCGEVIIKDRKLLRVLPLPSENWGALVGEWCCHPDPFANKSLHPQENDCFIGDSFFLVNLRTSLWQQRPELSPVEMCCVSSDNHCKLEPKANTKVICKRCKVMLGETVSSGKNFITRSQNDWLLA

SEQ ID NO: 834927 - protein, 106 aa, Homo sapiens
RLRLGSRDGIPRSRVLGRMRQPYLSSREVSSSRKRWRTFPVDCVAMCGDCVEKEYPNRGNTCLENGSFLLNFTGCAVCSKRDFMLITNKSLKEEDGEEIVTYDRFV

SEQ ID NO: 834928 - protein, 123 aa, Homo sapiens
RLRLGSRDGIPRSRVLGRMRQPYLSSREVSSSRKRWRTFPVDCVAMCGDCVEKEYPNRGNTCLENGSFLLNFTGCAVCSKRDFMLITNKSLKEEDGEEIVTYDRVYHAVSVMRQSRRYYQYSP

SEQ ID NO: 834929 - protein, 106 aa, Homo sapiens; identical to SEQ ID NO: 834927

SEQ ID NO: 834930 - protein, 123 aa, Homo sapiens; identical to SEQ ID NO: 834928

SEQ ID NO: 834931 - protein, 106 aa, Homo sapiens; identical to SEQ ID NO: 834927

SEQ ID NO: 834932 - protein, 106 aa, Homo sapiens; identical to SEQ ID NO: 834927

SEQ ID NO: 834933 - protein, 106 aa, Homo sapiens; identical to SEQ ID NO: 834927

SEQ ID NO: 834934 - protein, 123 aa, Homo sapiens; identical to SEQ ID NO: 834928

SEQ ID NO: 834935 - protein, 117 aa, Homo sapiens
MRLSRCWENGEEESQNRWINLVDELHLPSSQTEIWSPRLFRAGLCWSPSHRRKCVEEVEAAVVPDAGRSPLMLSTRGVQCIAGHLLRAISEAHPWKPQKPKRPKHPPTQQVTLLKMP

SEQ ID NO: 834936 - protein, 106 aa, Homo sapiens; identical to SEQ ID NO: 834927

SEQ ID NO: 834937 - protein, 106 aa, Homo sapiens; identical to SEQ ID NO: 834927

SEQ ID NO: 834938 - protein, 105 aa, Homo sapiens
RLRLGSRDGIPRSRVLGRMRQPYLSSREVSSSRKRWRTFPVDCVAMCGDCVEKEYPNRGNTCLENGSFLLNFTGCAVCSKRDFMLITNKSLKEEDGEEIVTYDRK

SEQ ID NO: 834939 - protein, 106 aa, Homo sapiens; identical to SEQ ID NO: 834927

SEQ ID NO: 834940 - protein, 106 aa, Homo sapiens; identical to SEQ ID NO: 834927

SEQ ID NO: 834941 - protein, 106 aa, Homo sapiens; identical to SEQ ID NO: 834927

SEQ ID NO: 834942 - protein, 218 aa, Homo sapiens
RASPHPARGGSICPAAFAHALHSGTVPARSGRTMARGAALALLLFGLLGVLVAAPDGGFDLSDALPDNENKKPTAIPKKPSAGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKENAEQGEVDMESHRNANAEPAVQRTLLEK

SEQ ID NO: 834943 - protein, 210 aa, Homo sapiens
RASPHPARGGSICPAAFAHALHSGTVPARSGRTMARGAALALLLFGLLGVLVAAPDGGFDLSDALPDNENKKPTAIPKKPSAGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKENGQLAGSLGPCIGIRREADG

SEQ ID NO: 834944 - protein, 218 aa, Homo sapiens; identical to SEQ ID NO: 834942

SEQ ID NO: 834945 - protein, 79 aa, Homo sapiens
LGTQLLAHRKEGEEADAPGVIPGIVGAVVVAVAGAISSFIAYQKKKLCFKENAEQGEVDMESHRNANAEPAVQRTLLEK

SEQ ID NO: 834946 - protein, 218 aa, Homo sapiens; identical to SEQ ID NO: 834942

SEQ ID NO: 834947 - protein, 218 aa, Homo sapiens; identical to SEQ ID NO: 834942

SEQ ID NO: 834948 - protein, 861 aa, Homo sapiens
NSHIPGIAAASGAGRPWGCALGREQPERRRHGREHIFAAELSWAEPEVVGLTALGTLGPQRCSGARCHRPLSRQLCASQRSMRTLEDSSGTVLHRLIQEQLRYGNLTETRTLLAIQQQALRGGAGTGGTGSPQASLEILAPEDSQVLQQATRQEPQGQEHQGGENHLAENTLYRLCPQPSKGEELPTYEEAKAHSQYYAAQQAGTRPHAGDRDPRGAPGGSRRQDEALRELRHGHVRSLSERLLQLSLERNGARAPSHMSSSHSFPQLARNQQGPPLRGPPAEGPESRGPPPQYPHVVLAHETTTAVTDPRYRARGSPHFQHAEVRILQAQVPPVFLQQQQQYQYLQQSQEHPPPPHPAALGHGPLSSLSPPAVEGPVSAQASSATSGSAHLAQMEAVLRENARLQRDNERLQRELESSAEKAGRIEKLESEIQRLSEAHESLTRASSKREALEKTMRNKMDSEMRRLQDFNRDLRERLESANRRLASKTQEAQAGSQDMVAKLLAQSYEQQQEQEKLEREMALLRGAIEDQRRRAELLEQALGNAQGRAARAEEELRKKQAYVEKVERLQQALGQLQAACEKREQLELRLRTRLEQELKALRAQQRQAGAPGGSSGSGGSPELSALRLSEQLREKEEQILALEADMTKWEQKYLEERAMRQFAMDAAATAAAQRDTTLIRHSPQPSPSSSFNEGLLTGGHRHQEMESRLKVLHAQILEKDAVIKVLQQRSRRDPGKAIQGSLRPAKSVPSVFAAAAAGTQGWQGLSSSERQTADAPARLTTADRAPTEEPVVTAPPAAHAKHGSRDGSTQTDGPPDSTSTCLPPEPDSLLGCSSSQRAASLDSVATSRVQDLSDMVEILI

SEQ ID NO: 834949 - protein, 861 aa, Homo sapiens; identical to SEQ ID NO: 834948

SEQ ID NO: 834950 - protein, 627 aa, Homo sapiens
NSHIPGIAAASGAGRPWGCALGREQPERRRHGREHIFAAELSWAEPEVVGLTALGTLGPQRCSGARCHRPLSRQLCASQRSMRTLEDSSGTVLHRLIQEQLRYGNLTETRTLLAIQQQALRGGAGTGGTGSPQASLEILAPEDSQVLQQATRQEPQGQEHQGGENHLAENTLYRLCPQPSKGEELPTYEEAKSPLESEIQRLSEAHESLTRASSKREALEKTMRNKMDSEMRRLQDFNRDLRERLESANRRLASKTQEAQAGSQDMVAKLLAQSYEQQQEQEKLEREMALLRGAIEDQRRRAELLEQALGNAQGRAARAEEELRKKQAYVEKVERLQQALGQLQAACEKREQLELRLRTRLEQELKALRAQQRQAGAPGGSSGSGGSPELSALRLSEQLREKEEQILALEADMTKWEQKYLEERAMRQFAMDAAATAAAQRDTTLIRHSPQPSPSSSFNEGLLTGGHRHQEMESRLKVLHAQILEKDAVIKVLQQRSRRDPGKAIQGSLRPAKSVPSVFAAAAAGTQGWQGLSSSERQTADAPARLTTADRAPTEEPVVTAPPAAHAKHGSRDGSTQTDGPPDSTSTCLPPEPDSLLGCSSSQRAASLDSVATSRVQDLSDMVEILI

SEQ ID NO: 834951 - protein, 861 aa, Homo sapiens; identical to SEQ ID NO: 834948

SEQ ID NO: 834952 - protein, 861 aa, Homo sapiens; identical to SEQ ID NO: 834948

SEQ ID NO: 834953 - protein, 846 aa, Homo sapiens
NSHIPGIAAASGAGRPWGCALGREQPERRRHGREHIFAAELSWAEPEVVGLTALGTLGPQRCSGARCHRPLSRQLCASQRSMRTLEDSSGTVLHRLIQEQLRYGNLTETRTLLAIQQQALRGGAGTGGTGSPQASLEILAPEDSQVLQQATRQEPQGQEHQGGENHLAENTLYRLCPQPSKGEELPTYEEAKAHSQYYAAQQAGTRPHAGDRDPRGAPGGSRRQDEALRELRHGHVRSLSERLLQLSLERNGARAPSHMSSSHSFPQLARNQQGPPLRGPPAEGPESRGPPPQYPHVVLAHETTTAVTDPRYRARGSPHFQHAEVRILQAQVPPVFLQQQQQYQYLQQSQEHPPPPHPAALGHGPLSSLSPPAVEGPVSAQASSATSGSAHLAQMEAVLRENARLQRDNERLQRELESSAEKAGRIEKLESEIQRLSEAHESLTRASSKREALEKTMRNKMDSEMRRLQDFNRDLRERLESANRRLASKTQEAQAGSQDMVAKLLAQSYEQQQEQEKLEREMALLRGAIEDQRRRAELLEQALGNAQGRAARAEEELRKKQAYVEKVERLQQALGQLQAACEKREQLELRLRTRLEQELKALRAQQRQAGAPGGSSGSGGSPELSALRLSEQLREKEEQILALEADMTKWEQKYLEERAMRQFAMDAAATAAAQRDTTLIRHSPQPSPSSSFNEGLLTGGHRHQEMESRLKVLHAQILEKDAVIKVLQQRSRRDPGKAIQGSLRPAKSVPSVFAAAAAGTQGWQGLSSSERQTADAPARLTTADRAPTEEPVVTAPPAAHAKHGSRDGSTQTDGPPDSTSTCLPPEPDSLLGCSSSQRAASLGKSS

SEQ ID NO: 834954 - protein, 234 aa, Homo sapiens [sequence omitted]

SEQ ID NO: 834955 - protein, 363 aa, Homo sapiens
GIICTVLCHLAAHQYQQLTQVSAGGSEAKPLIFTFVPTVRRLPTHTQLADTSKFLVKIPEESSDKSPETVNRSKSNDYLTLNAGSQQERDQAKLTCPSEVSGTILQEREFEANKLQGMQQSDLFKAEYVLIVDSEGEDEAASRKVEQGPPGGIGTAAIRPKSLAISSSLVSDVVRPKTQGTDLKTSSHPEMLHGMAPQQKHGQTPTTLPRAAGRETKYANLSSPTSTVSESQLTKPGVIRPVPVKSRILLKKEEEVYEPNPFSKYLEDNSDLFSEQDVTVPPKPVSLHPLYQTKLYPPAKSLLHPQTLSHADCLAPGPFSHLSFSLSDEQENSHTLLSHNACNKLSHPMVAIPEHEALDSKEQ

SEQ ID NO: 834956 - protein, 457 aa, Homo sapiens
GIICTVLCHLAAHQYQQLTQVSAGGSEAKPLIFTFVPTVRRLPTHTQLADTSKFLVKIPEESSDKSPETVNRSKSNDYLTLNAGSQQERDQAKLTCPSEVSGTILQEREFEANKLQGMQQSDLFKAEYVLIVDSEGEDEAASRKVEQGPPGGIGTAAIRPKSLAISSSLVSDVVRPKTQGTDLKTSSHPEMLHGMAPQQKHGQQYKTKSSYKAFAAIPTNTLLLEQKALDEPAKTESVSKDNTLEPPVELYFPAQLRQQTEELCATIDKVLQDSLSMHSSDSPSRSPKTLLGSDTVKTPTTLPRAAGRETKYANLSSPTSTVSESQLTKPGVIRPVPVKSRILLKKEEEVYEPNPFSKYLEDNSDLFSEQDVTVPPKPVSLHPLYQTKLYPPAKSLLHPQTLSHADCLAPGPFSHLSFSLSDEQENSHTLLSHNACNKLSHPMVAIPEHEALDSKEQ

SEQ ID NO: 834957 - protein, 287 aa, Homo sapiens
GIICTVLCHLAAHQYQQLTQVSAGGSEAKPLIFTFVPTVRRLPTHTQLADTSKFLVKIPEESSDKSPETVNRSKSNDYLTLNAGSQQERDQAKLTCPSEVSGTILQEREFEANKLQGMQQSDLFKAEYVLIVDSEGEDEAASRKVEQGPPGGIGTAAIRPKSLAISSSLVSDVVRPKTQGTDLKTSSHPEMLHGMAPQQKHGQQYKTKSSYKAFAAIPTNTLLLEQKALDEPAKTESVSKDNTLEPPVETPTTLPRAAGRETKYANLSSPTSTVSESQLTKPGVFPQ

SEQ ID NO: 834958 - protein, 144 aa, Homo sapiens
MQQSDLFKAEYVLIVDSEGEDEAASRKVEQGPPGGIGTAAIRPKSLAISSSLVSDVVRPKTQGTDLKTSSHPEMLHGMAPQQKHGQQYKTKSSYKAFAAIPTNTLLLEQKTPTTLPRAAGRETKYANLSSPTSTVSESQLVCIF

SEQ ID NO: 834959 - protein, 457 aa, Homo sapiens; identical to SEQ ID NO: 834956

SEQ ID NO: 834960 - protein, 457 aa, Homo sapiens; identical to SEQ ID NO: 834956

SEQ ID NO: 834961 - protein, 388 aa, Homo sapiens
GIICTVLCHLAAHQYQQLTQVSAGGSEAKPLIFTFVPTVRRLPTHTQLADTSKFLVKIPEESSDKSPETVNRSKSNDYLTLNAGSQQERDQAKLTCPSEVSGTILQEREFEANKLQGMQQSDLFKAEYVLIVDSEGEDEAASRKVEQGPPGGIGTAAIRPKSLAISSSLVSDVVRPKTQGTDLKTSSHPEMLHGMAPQQKHGQLTSSPTTSEQLACKPPAFSFVSPTNPNTPPDPVNLEGASVLEEFHTRRLDVGGAVVEESATYFQTTAHSTPFSASKGTSSTLLFPHSTQLSGSNLPSSTAADPKPGLTSEVLKKTTLTSHVLSHGESPRTSSSPPSSSASLKSNSASYIPVRIVTHSLSPSPKPFTSSFHGSSSTICSQMSSSGN

SEQ ID NO: 834962 - protein, 184 aa, Homo sapiens
MREYKLVVLGSGGVGKSALTVQFVQGIFVEKYDPTIEDSYRKQVEVDCQQCMLEILDTAGTEQFTAMRDLYMKNGQGFALVYSITAQSTFNDLQDLREQILRVKDTEDVPMILVGNKCDLEDERVVGKEQGQNLARQWCNCAFLESSAKSKINVNEIFYDLVRQINRKTPVEKKKPKKKSCLLL

SEQ ID NO: 834963 - protein, 184 aa, Homo sapiens; identical to SEQ ID NO: 834962

SEQ ID NO: 834964 - protein, 265 aa, Homo sapiens
MREYKLVVLGSGGVGKSALTVQFVQGIFVEKYDPTIEDSYRKQVEVDCQQCMLEILDTAGTEQFTAMRDLYMKNGQGFALVYSITAQSTFNDLQDLREQILRVKDTEDVPMILVGNKCDLEDERVVGKEQGQNLARQWCNCAFLESSAKSKINVNEIFYDLVRQINRKTPVEGSGGGTGGGGTPSKTSNTIRVFLPNKQRTVVNVRNGMSLHDCLMKALKVRGLQPESCAVFRLLHEHKGKKARLDWNTEAASLIGEELHVDFLG

SEQ ID NO: 834965 - protein, 99 aa, Homo sapiens
MREYKLVVLGSGGVGKSALTVQFVQGIFVEKYDPTIEDSYRKQVEVDCQQCMLEILDTAGTEQFTAAREAEAGEWVEPGRRTFQWAEIVPLHSRVRLCL

SEQ ID NO: 834966 - protein, 184 aa, Homo sapiens; identical to SEQ ID NO: 834962

SEQ ID NO: 834967 - protein, 184 aa, Homo sapiens; identical to SEQ ID NO: 834962

SEQ ID NO: 834968 - protein, 133 aa, Homo sapiens
MLEILDTAGTEQFTAMRDLYMKNGQGFALVYSITAQSTFNDLQDLREQILRVKDTEDVPMILVGNKCDLEDERVVGKEQGQNLARQWCNCAFLESSAKSKINVNEIFYDLVRQINRKTPVEKKKPKKKSCLLL

SEQ ID NO: 834969 - protein, 184 aa, Homo sapiens; identical to SEQ ID NO: 834962

SEQ ID NO: 834970 - protein, 310 aa, Homo sapiens
RTTQRAAAASPSSCGPRGAEYGALMAMEGYWRFLALLGSALLVGFLSVIFALVWVLHYREGLGWDGSALEFNWHPVLMVTGFVFIQGIAIIVYRLPWTWKCSKLLMKSIHAGLNAVAAILAIISVVAVFENHNVNNIANMYSLHSWVGLIAVICYLLQLLSGFSVFLLPWAPLSLRAFLMPIHVYSGIVIFGTVIATALMGLTEKLIFSLRDPAYSTFPPEGVFVNTLGLLILVFGALIFWIVTRPQWKRPKEPNSTILHPNGGTEQGARGSMPAYSGNNMDKSDSELNSEVAARKRNLALDEAGQRSTM

SEQ ID NO: 834971 - protein, 310 aa, Homo sapiens; identical to SEQ ID NO: 834970

SEQ ID NO: 834972 - protein, 310 aa, Homo sapiens; identical to SEQ ID NO: 834970

SEQ ID NO: 834973 - protein, 310 aa, Homo sapiens; identical to SEQ ID NO: 834970

SEQ ID NO: 834974 - protein, 181 aa, Homo sapiens
RTTQRAAAASPSSCGPRGAEYGALMAMEGYWRFLALLGSALLVGFLSVIFALVWVLHYREGLGWDGSALEFNWHPVLMVTGFVFIQGIASFRFFSLSASMGSAFSPSISHAHTCLFWNCHLWNSDCNSTYGIDRETDFFPERSCIQYIPARRCFRKYAWPSDPGVRGPHFLDSHQTAMETS

SEQ ID NO: 834975 - protein, 310 aa, Homo sapiens; identical to SEQ ID NO: 834970

SEQ ID NO: 834976 - protein, 103 aa, Homo sapiens
MKSLILLAILAALAVVTLCYESHESMESYELNPFINRRNANTFISPQQRWRAKVQERIRERSKPVHELNREACDDYRLCERYAMVYGYNAAYNRYFRKRRGTK

SEQ ID NO: 834977 - protein, 103 aa, Homo sapiens; identical to SEQ ID NO: 834976

SEQ ID NO: 834978 - protein, 128 aa, Homo sapiens
MKSLILLAILAALAVVTLCYGEWQKEENFGFDIVSVLSLNWHRAQESHESMESYELNPFINRRNANTFISPQQRWRAKVQERIRERSKPVHELNREACDDYRLCERYAMVYGYNAAYNRYFRKRRGTK

SEQ ID NO: 834979 - protein, 66 aa, Homo sapiens
SEDPQSCSHQQRWRAKVQERIRERSKPVHELNREACDDYRLCERYAMVYGYNAAYNRYFRKRRGTK

SEQ ID NO: 834980 - protein, 133 aa, Homo sapiens
PLWTLTLWIPISCCPTAATQDPETDLQDETMKSLILLAILAALAVVTLCYESHESMESYELNPFINRRNANTFISPQQRWRAKVQERIRERSKPVHELNREACDDYRLCERYAMVYGYNAAYNRYFRKRRGTK

SEQ ID NO: 834981 - protein, 103 aa, Homo sapiens; identical to SEQ ID NO: 834976

SEQ ID NO: 834982 - protein, 103 aa, Homo sapiens; identical to SEQ ID NO: 834976

SEQ ID NO: 834983 - protein, 66 aa, Homo sapiens; identical to SEQ ID NO: 834979

SEQ ID NO: 834984 - protein, 103 aa, Homo sapiens; identical to SEQ ID NO: 834976

SEQ ID NO: 834985 - protein, 133 aa, Homo sapiens; identical to SEQ ID NO: 834980

SEQ ID NO: 834986 - protein, 76 aa, Homo sapiens
MKSLILLAILAALAVVTLCYESHESMESYELNPFINRRNANTFISPQQRWRAKVQERIRDALACPRAGILYITCGN

SEQ ID NO: 834987 - protein, 135 aa, Homo sapiens
LYTRKLPDRNSKHIAVTYRHLNLQTPGRRIHYVSHHRHCFSAVVKTAAVSVMNSPESMESYELNPFINRRNANTFISPQQRWRAKVQERIRERSKPVHELNREACDDYRLCERYAMVYGYNAAYNRYFRKRRGTK

SEQ ID NO: 834988 - protein, 103 aa, Homo sapiens; identical to SEQ ID NO: 834976

SEQ ID NO: 834989 - protein, 635 aa, Homo sapiens
KKGWQRALAIVCDFKLFLYDIAEGKASQPSVVISQVIDMRDEEFSVSSVLASDVIHASRKDIPCIFRVTASQLSASNNKCSILMLADTENEKNKWVGVLSELHKILKKNKFRDRSVYVPKEAYDSTLPLIKTTQAAAIIDHERIALGNEEGLFVVHVTKDEIIRVGDNKKIHQIELIPNDQLVAVISGRNRHVRLFPMSALDGRETDFYKLSETKGCQTVTSGKVRHGALTCLCVAMKRQVLCYELFQSKTRHRKFKEIQVPYNVQWMAIFSEQLCVGFQSGFLRYPLNGEGNPYSMLHSNDHTLSFIAHQPMDAICAVEISSKEYLLCFNSIGIYTDCQGRRSRQQELMWPANPSSCCYNAPYLSVYSENAVDIFDVNSMEWIQTLPLKKVRPLNNEGSLNLLGLETIRLIYFKNKMAEGDELVVPETSDNSRKQMVRNINNKRRYSFRVPEEERMQQRREMLRDPEMRNKLISNPTNFNHIAHMGPGDGIQILKDLPMNPRPQESRTVFSGSVSIPSITKSRPEPGRSMSASSGLSARSSAQNGSALKREFSGGSYSAKRQPMPSPSEGSLSSGGMDQGSDAPARDFDGEDSDSPRHSTASNSSNLSSPPSPVSPRKTKSLSLESTDRGSWDP

SEQ ID NO: 834990 - protein, 697 aa, Homo sapiens
KKGWQRALAIVCDFKLFLYDIAEGKASQPSVVISQVIDMRDEEFSVSSVLASDVIHASRKDIPCIFRVTASQLSASNNKCSILMLADTENEKNKWVGVLSELHKILKKNKFRDRSVYVPKEAYDSTLPLIKTTQAAAIIDHERIALGNEEGLFVVHVTKDEIIRVGDNKKIHQIELIPNDQLVAVISGRNRHVRLFPMSALDGRETDFYKLSETKGCQTVTSGKVRHGALTCLCVAMKRQVLCYELFQSKTRHRKFKEIQVPYNVQWMAIFSEQLCVGFQSGFLRYPLNGEGNPYSMLHSNDHTLSFIAHQPMDAICAVEISSKEYLLCFNSIGIYTDCQGRRSRQQELMWPANPSSCCYNAPYLSVYSENAVDIFDVNSMEWIQTLPLKKVRPLNNEGSLNLLGLETIRLIYFKNKMAEGDELVVPETSDNSRKQMVRNINNKRRYSFRVPEEERMQQRREMLRDPEMRNKLISNPTNFNHIAHMGPGDGIQILKDLPMPGFPYPSPHHHSGLISSPINFEHIYHMTVNSAEKFLSPDSINPEYSPSLRSVPGTPSFMTLRNPRPQESRTVFSGSVSIPSITKSRPEPGRSMSASSGLSARSSAQNGSALKREFSGGSYSAKRQPMPSPSEGSLSSGGMDQGSDAPARDFDGEDSDSPRHSTASNSSNLSSPPSPVSPRKTKSLSLESTDRGSWDP

SEQ ID NO: 834991 - protein, 578 aa, Homo sapiens
KKGWQRALAIVCDFKLFLYDIAEGKASQPSVVISQVIDMRDEEFSVSSVLASDVIHASRKDIPCIFRVTASQLSASNNKCSILMLADTENEKNKWVGVLSELHKILKKNKFRDRSVYVPKEAYDSTLPLIKTTQAAAIIDHERIALGNEEGLFVVHVTKDEIIRVGDNKKIHQIELIPNDQLVAVISGRNRHVRLFPMSALDGRETDFYKLSETKGCQTVTSGKVRHGALTCLCVAMKRQVLCYELFQSKTRHRKFKEIQVPYNVQWMAIFSEQLCVGFQSGFLRYPLNGEGNPYSMLHSNDHTLSFIAHQPMDAICAVEISSKEYLLCFNSIGIYTDCQGRRSRQQELMWPANPSSCCYNAPYLSVYSENAVDIFDVNSMEWIQTLPLKKVRPLNNEGSLNLLGLETIRLIYFKNKMAEGDELVVPETSDNSRKQMVRNINNKRRYSFRVPEEERMQQRREMLRDPEMRNKLISNPTNFNHIAHMGPGDGIQILKDLPMPGFPYPSPHHHSGLISSPINFEHIYHMTVNSAEKFLSPDSINPEYSPSLRSVPEPSASGKSDSIQWLSQYSIYHQIPP

SEQ ID NO: 834992 - protein, 564 aa, Homo sapiens
KKGWQRALAIVCDFKLFLYDIAEGKASQPSVVISQVIDMRDEEFSVSSVLASDVIHASRKDIPCIFRVTASQLSASNNKCSILMLADTENEKNKWVGVLSELHKILKKNKFRDRSVYVPKEAYDSTLPLIKTTQAAAIIDHERIALGNEEGLFVVHVTKDEIIRVGDNKKIHQIELIPNDQLVAVISGRNRHVRLFPMSALDGRETDFYKLSETKGCQTVTSGKVRHGALTCLCVAMKRQVLCYELFQSKTRHRKFKEIQVPYNVQWMAIFSEQLCVGFQSGFLRYPLNGEGNPYSMLHSNDHTLSFIAHQPMDAICAVEISSKEYLLCFNSIGIYTDCQGRRSRQQELMWPANPSSCCYNAPYLSVYSENAVDIFDVNSMEWIQTLPLKKVRPLNNEGSLNLLGLETIRLIYFKNKMAEGDELVVPETSDNSRKQMVRNINNKRRYSFRVPEEERMQQRREMLRDPEMRNKLISNPTNFNHIAHMGPGDGIQILKDLPMNPRPQESRTVFSGSVSIPSITKSRPEPGRSMSASSGLSASKCRGYRKVPLRQGDPQLPPLLSRG

SEQ ID NO: 834993 - protein, 635 aa, Homo sapiens; identical to SEQ ID NO: 834989

SEQ ID NO: 834994 - protein, 635 aa, Homo sapiens; identical to SEQ ID NO: 834989

SEQ ID NO: 834995 - protein, 245 aa, Homo sapiens
MFVLSWRLIDKKHFNSLKNIIIVCIFILTEGDELVVPETSDNSRKQMVRNINNKRRYSFRVPEEERMQQRREMLRDPEMRNKLISNPTNFNHIAHMGPGDGIQILKDLPMNPRPQESRTVFSGSVSIPSITKSRPEPGRSMSASSGLSARSSAQNGSALKREFSGGSYSAKRQPMPSPSEGSLSSGGMDQGSDAPARDFDGEDSDSPRHSTASNSSNLSSPPSPVSPRKTKSLSLESTDRGSWDP

SEQ ID NO: 834996 - protein, 145 aa, Homo sapiens
MTSQTLDNQEWTQLTSWIKGNLTCDSRTREWLCCCWRIISGKRCSSSGPKSWERRIRSTPRLNRCLETKAGTEPLRSMHPWGAQGGRGLGKLIPQTLWGLPRHRPKGLFFSSIFAKCLSLNEEHIWTTVQCCVLPGSVTLPLFLK

SEQ ID NO: 834997 - protein, 557 aa, Homo sapiens
MQSPWSPANDDQSRPSLSNGHTCVGCVLVVSVIEQLAQVHNSTVQASMERLCSYLPEKLFLKTTCYLVIDKFGSDIIKLLSADMNADVVCHTLEFCKQNTGQPLCHLYPLPKETWKFTLQKARQIVKKSPILKYSRSGSDICSLPVLAKICQKIKLAMEQSVPFKDVDSDKYSVFPTLRGYHWRGRDCNDSDESVYPGRRPNNWDVHQDSNCNGIWGVDPKDGVPYEKKFCEGSQPRGIILLGDSAGAHFHISPEWITASQMSLNSFINLPTALTNELDWPQLSGATGFLDSTVGIKEKSIYLRLWKRNHCNHRDYQNISRNGASSRNLKKFIESLSRNKVLDYPAIVIYAMIGNDVCSGKSDPVPAMTTPEKLYSNVMQTLKHLNSHLPNGSHVILYGLPDGTFLWDNLHNRYHPLGQLNKDMTYAQLYSFLNCLQVSPCHGWMSSNKTLRTLTSERAEQLSNTLKKIAASEKFTNFNLFYMDFAFHEIIQEWQKRGGQPWQLIEPVDGFHPNEVALLLLADHFWKKVQLQWPQILGKENPFNPQIKQVFGDQGGH

SEQ ID NO: 834998 - protein, 237 aa, Homo sapiens
MQSPWKILTVAPLFLLLSLQSSASPANDDQSRPSLSNGHTCVGCVLVVSVIEQLAQVHNSTVQASMERLCSYLPEKLFLKTTCYLVIDKFGSDIIKLLSADMNADVVCHTLEFCKQNTGQPLCHLYPLPKETWKFTLQKARQIVKKSPILKYSRSGSDICSLPVLAKICQKIKLAMEQSVPFKDVDSDKYSVFPTLRGYHWRGRDCNDSDESVYPGRRPNNWDVHQDSNCNGIWVSN

SEQ ID NO: 834999 - protein, 103 aa, Homo sapiens
SGKPRGSRGLCTLTSLSQGARKLCHCATWVFFILQSLPQQNRTPQTPSSSLCVALSGSNKSKLWVCECLCVLLFTSHLLKSVYVRGWGVCVKESEEEKEREIN

SEQ ID NO: 835000 - protein, 143 aa, Homo sapiens
MKSYRSGRREADSPGSSSSPWMDSTPTRWLCCCWRIISGKRCSSSGPKSWERRIRSTPRLNRCLETKAGTEPLRSMHPWGAQGGRGLGKLIPQTLWGLPRHRPKGLFFSSIFAKCLSLNEEHIWTTVQCCVLPGSVTLPLFLK

SEQ ID NO: 835001 - protein, 575 aa, Homo sapiens
MQSPWKILTVAPLFLLLSLQSSASPANDDQSRPSLSNGHTCVGCVLVVSVIEQLAQVHNSTVQASMERLCSYLPEKLFLKTTCYLVIDKFGSDIIKLLSADMNADVVCHTLEFCKQNTGQPLCHLYPLPKETWKFTLQKARQIVKKSPILKYSRSGSDICSLPVLAKICQKIKLAMEQSVPFKDVDSDKYSVFPTLRGYHWRGRDCNDSDESVYPGRRPNNWDVHQDSNCNGIWGVDPKDGVPYEKKFCEGSQPRGIILLGDSAGAHFHISPEWITASQMSLNSFINLPTALTNELDWPQLSGATGFLDSTVGIKEKSIYLRLWKRNHCNHRDYQNISRNGASSRNLKKFIESLSRNKVLDYPAIVIYAMIGNDVCSGKSDPVPAMTTPEKLYSNVMQTLKHLNSHLPNGSHVILYGLPDGTFLWDNLHNRYHPLGQLNKDMTYAQLYSFLNCLQVSPCHGWMSSNKTLRTLTSERAEQLSNTLKKIAASEKFTNFNLFYMDFAFHEIIQEWQKRGGQPWQLIEPVDGFHPNEVALLLLADHFWKKVQLQWPQILGKENPFNPQIKQVFGDQGGH

SEQ ID NO: 835002 - protein, 575 aa, Homo sapiens; identical to SEQ ID NO: 835001

SEQ ID NO: 835003 - protein, 545 aa, Homo sapiens [sequence omitted]

SEQ ID NO: 835004 - protein, 437 aa, Homo sapiens
MQSPWKILTVAPLFLLLSLQSSASPANDDQSRPSLSNGHTCVGCVLVVSVIEQLAQVHNSTVQASMERLCSYLPEKLFLKTTCYLVIDKFGSDIIKLLSADMNADVVCHTLEFCKQNTGQPLCHLYPLPKETWKFTLQKARQIVKKSPILKYSRSGSDICSLPVLAKICQKIKLAMEQSVPFKDVDSDKYSVFPTLRGYHWRGRDCNDSDESVYPGRRPNNWDVHQDSNCNGIWGVDPKDGVPYEKKFCEGSQPRGIILLGDSAGAHFHISPEWITASQMSLNSFINLPTALTNELDWPQLSGATGFLDSTVGIKEKSIYLRLWKRNHCNHRDYQNISRNGASSRNLKKFIERKSDPVPAMTTPEKLYSNVMQTLKHLNSHLPNGSHVILYGLPDGTFLWDNLHNRYHPLGQLNKDMTYAQLYSFLNCLQVSTHWLA

SEQ ID NO: 835005 - protein, 482 aa, Homo sapiens
SPGGGLGRSQGFWADPAPAPPLPARGPPSRPGLAPGSQMTTEGGPPPAPLRRACSPVPGALQAALMSPPPAAAAAAAAAPETTSSSSSSSSASCASSSSSSNSASAPSAACKSAGGGGAGAGSGGAKKASSGLRRPEKPPYSYIALIVMAIQSSPSKRLTLSEIYQFLQARFPFFRGAYQGWKNSVRHNLSLNECFIKLPKGLGRPGKGHYWTIDPASEFMFEEGSFRRRPRGFRRKCQALKPMYHRVVSGLGFGASLLPQGFDFQAPPSAPLGCHSQGGYGGLDMMPAGYDAGAGAPSHAHPHHHHHHHVPHMSPNPGSTYMASCPVPAGPGGVGAAGGGGGGDYGPDSSSSPVPSSPAMASAIECHSPYTSPAAHWSSPGASPYLKQPPALTPSSNPAASAGLHSSMSSYSLEQSYLHQNAREDLSVGLPRYQHHSTPVCDRKDFVLNFNGISSFHPSASGSYYHHHHQSVCQDIKPCVM

SEQ ID NO: 835006 - protein, 697 aa, Homo sapiens
MAETSPEPSGQLVVHSDAHSDTVLASFEDQRKKGFLCDITLIVENVHFRAHKALLAASSEYFSMMFAEEGEIGQSIYMLEGMVADTFGILLEFIYTGYLHASEKSTEQILATAQFLKVYDLVKAYTDFQNNHSSPKPTTLNTAGAPVVVISNKKNDPPKRKRGRPKKVNTLQEEKSELAAEEEIQLRVNNSVQNRQNFVVKGDSGVLNEQIAAKEKEESEPTCEPSREEEMPVEKDENYDPKTEDGQASQSRYSKRRIWRSVKLKDYKLVGDQEDHGSAKRICGRRKRPGGPEARCKDCGKVFKYNHFLAIHQRSHTGERPFKCNECGKGFAQKHSLQVHTRMHTGERPYTCTVCSKALTTKHSLLEHMSLHSGQKSFTCDQCGKYFSQNRQLKSHYRVHTGHSLPECKDCHRKFMDVSQLKKHLRTHTGEKPFTCEICGKSFTAKSSLQTHIRIHRGEKPYSCGICGKSFSDSSAKRRHCILHTGKKPFSCPECNLQFARLDNLKAHLKIHSKEKHASDASSISGSSNTEEVRNILQLQPYQLSTSGEQEIQLLVTDSVHNINFMPGPSQGISIVTAESSQNMTADQAANLTLLTQQPEQLQNLILSAQQEQTEHIQSLNMIESQMGPSQTEPVHVITLSKETLEHLHAHQEQTEELHLATSTSDPAQHLQLTQEPGPPPPTHHVPQPTPLGQEQS

SEQ ID NO: 835007 - protein, 333 aa, Homo sapiens
MAETSPEPSGQLVVHSDAHSDTVLASFEDQRKKGFLCDITLIVENVHFRAHKALLAASSEYFSMMFAEEGEIGQSIYMLEGMVADTFGILLEFIYTGYLHASEKSTEQILATAQFLKVYDLVKAYTDFQNNHSSPKPTTLNTAGAPVVVISNKKNDPPKRKRGRPKKVNTLQEEKSELAAEEEIQLRVNNSVQNRQNFVVKGDSGVLNEQIAAKEKEESEPTCEPSREEEMPVEKDENYDPKTEDGQASQSRYSKRRIWRSVKLKDYKLVGDQEDHGSAKRICGRRKRPGGPEARCKDCGKVFKYNHFLAIHQRSHTGNDVFKADCSVLQNWE

SEQ ID NO: 835008 - protein, 697 aa, Homo sapiens; identical to SEQ ID NO: 835006

SEQ ID NO: 835009 - protein, 446 aa, Homo sapiens
MLVLLTAGFRFICSASKILLLMSLVFIVGLLDVCLLRKILYCFFNLGETEKCVDSYLYHASGALLPGERPFKCNECGKGFAQKHSLQVHTRMHTGERPYTCTVCSKALTTKHSLLEHMSLHSGQKSFTCDQCGKYFSQNRQLKSHYRVHTGHSLPECKDCHRKFMDVSQLKKHLRTHTGEKPFTCEICGKSFTAKSSLQTHIRIHRGEKPYSCGICGKSFSDSSAKRRHCILHTGKKPFSCPECNLQFARLDNLKAHLKIHSKEKHASDASSISGSSNTEEVRNILQLQPYQLSTSGEQEIQLLVTDSVHNINFMPGPSQGISIVTAESSQNMTADQAANLTLLTQQPEQLQNLILSAQQEQTEHIQSLNMIESQMGPSQTEPVHVITLSKETLEHLHAHQEQTEELHLATSTSDPAQHLQLTQEPGPPPPTHHVPQPTPLGQEQS

SEQ ID NO: 835010 - protein, 157 aa, Homo sapiens
HFGLSGPSGDAGSGRAREEWLWPLHTGGSEVRRRRWSRPGTGQRQEHRRARVPPPPRVMAAAAALRAPAQSSVTFEDVAVNFSLEEWSLLNEAQGCLYHDVMLETLTLISSLKGCTRQQFCNRSTLNKEDRVIYNLRRSPSCRFPLPGTGPHILYVS

SEQ ID NO: 835011 - protein, 358 aa, Homo sapiens
MYLTSISLLLGCWHGGEDEAAPSKQSTCIHIYKDQGGHSGERPYECGEYRKLFKNKSCLTEPRRDHKHRNVRTGERPYECSKYGKLFHQKPTLHIHERFHTGQKTYECSECGKSFHQSSSLLQRQTLHTRERPYECIECGKAFAEKSSLINHRKVHSGAKRYECNECGKSFAYTSSLIKHRRIHTGERPYECSECGRSFAENSSLIKHLRVHTGERPYECVECGKSFRRSSSLLQHQRVHTRERPYECSECGKSFSLRSNLIHHQRVHTGERHECGQCGKSFSRKSSLIIHLRVHTGERPYECSDCGKSFAENSSLIKHLRVHTGERPYECIDCGKSFRHSSSFRRHQRVHTGMRPYK

SEQ ID NO: 835012 - protein, 117 aa, Homo sapiens
HFGLSGPSGDAGSGRAREEWLWPLHTGGSEVRRRRWSRPGTGQRQEHRRARVPPPPRVMAAAAALRAPAQSSVTFEDVAVNFSLEEWSLLNEAQRCLYRDVMLETLTLISSLEQCDL

SEQ ID NO: 835013 - protein, 123 aa, Homo sapiens
HFGLSGPSGDAGSGRAREEWLWPLHTGGSEVRRRRWSRPGTGQRQEHRRARVPPPPRVMAAAAALRAPAQSSVTFEDVAVNFSLEEWSLLNEAQRCLYRDVMLETLTLISSLGKVLIFTCDLS

SEQ ID NO: 835014 - protein, 460 aa, Homo sapiens
HFGLSGPSGDAGSGRAREEWLWPLHTGGSEVRRRRWSRPGTGQRQEHRRARVPPPPRVMAAAAALRAPAQSSVTFEDVAVNFSLEEWSLLNEAQRCLYRDVMLETLTLISSLGCWHGGEDEAAPSKQSTCIHIYKDQGGHSGERPYECGEYRKLFKNKSCLTEPRRDHKHRNVRTGERPYECSKYGKLFHQKPTLHIHERFHTGQKTYECSECGKSFHQSSSLLQRQTLHTRERPYECIECGKAFAEKSSLINHRKVHSGAKRYECNECGKSFAYTSSLIKHRRIHTGERPYECSECGRSFAENSSLIKHLRVHTGERPYECVECGKSFRRSSSLLQHQRVHTRERPYECSECGKSFSLRSNLIHHQRVHTGERHECGQCGKSFSRKSSLIIHLRVHTGERPYECSDCGKSFAENSSLIKHLRVHTGERPYECIDCGKSFRHSSSFRRHQRVHTGMRPYK

SEQ ID NO: 835015 - protein, 460 aa, Homo sapiens; identical to SEQ ID NO: 835014

SEQ ID NO: 835016 - protein, 112 aa, Homo sapiens
HFGLSGPSGDAGSGRAREEWLWPLHTGGSEVRRRRWSRPGTGQRQEHRRARVPPPPRVMAAAAALRAPAQSSVTFEDVAVNFSLEEWSLLNEAQGCLYHDVMLETLTLISSL

SEQ ID NO: 835017 - protein, 579 aa, Homo sapiens
GEKNLLELVELADQALRSFSYHQHFPLIKEIISICSKIWKSAQASPLLQGESQKVLLHMLSHPLPRVKAETYHCCLEITKECLGVHNVTKPVSSLCNGIHFLLHPKVLYEISVFGIQEPESEVNTAAKAILLYLLQGRLMMTALTWNKFIESLCPVIPILQGYADTEDPLGNCILLLSKASSDTEEMLPCTTRLKSMLRLLLVKKPSVRSLALKLLAFHLTSEEGADTKRPLIDARVLSRVTDLFIGKKPIELRLDDRRELVIKLETVEKVYEIFTSDDVDLVLRKSAAEQLAVIMQDIKMHAVVKKLCLIDKIIEYLNECVSQDGKVVECLVQPCLTLLRKVLCGDPVMRVSLSQQSSLLTVLFRVSLIFHEDCSVVTEVGALFCLLLFDEVSRMDMWSVNPSNKPSLPSVFSLPVSVFRRYHLPVHVIGHHAVSPYSIVLPLSADCLALKPVSDMLRIAWNLSWYHGSDNLLKQMNSETKTQEILDALKLSTEDILTLKITHMASGLQDCLHSIVQAATHREVRAAVTRMSFYLLNDRLSLKGCPGPCGVTLKSLAWHTALNSFYRCFLLALKMRNC

SEQ ID NO: 835018 - protein, 498 aa, Homo sapiens
GEKNLLELVELADQALRSFSYHQHFPLIKEIISICSKIWKSAQASPLLQGESQKVLLHMLSHPLPRVKAETYHCCLEITKECLGVHNVTKPVSSLCNGIHFLLHPKVLYEISVFGIQEPESEVNTAAKAILLYLLQGRLMMTALTWNKFIESLCPVIPILQGYADTEDPLGNCILLLSKASSDTEEMLPCTTRLKSMLRLLLVKKPSVRSLALKLLAFHLTSEEGADTKRPLIDARVLSRVTDLFIGKKPIELRLDDRRELVIKLETVEKVYEIFTSDDVDLVLRKSAAEQLAVIMQDIKMHAVVKKLCLIDKIIEYLNECVSQDGKVVECLVQPCLTLLRKVLCGDPVMRVSLSQQSSLLTVLFRVSLIFHEDCSVVTEVGALFCLLLFDEVSRMDMWSVNPSNKPSLPSVFSLPVSVFRRFLQVLPACTEDEKLLIDIIHFLNKLIKEQRKNSSLELLNWILELLLRHSANPLLDLLVLTESQAREETDDIRTAVR

SEQ ID NO: 835019 - protein, 640 aa, Homo sapiens
GEKNLLELVELADQALRSFSYHQHFPLIKEIISICSKIWKSAQASPLLQGESQKVLLHMLSHPLPRVKAETYHCCLEITKECLGVHNVTKPVSSLCNGIHFLLHPKVLYEISVFGIQEPESEVNTAAKAILLYLLQGRLMMTALTWNKFIESLCPVIPILQGYADTEDPLGNCILLLSKASSDTEEMLPCTTRLKSMLRLLLVKKPSVRSLALKLLAFHLTSEEGADTKRPLIDARVLSRVTDLFIGKKPIELRLDDRRELVIKLETVEKVYEIFTSDDVDLVLRKSAAEQLAVIMQDIKMHAVVKKLCLIDKIIEYLNECVSQDGKVVECLVQPCLTLLRKVLCGDPVMRVSLSQQSSLLTVLFRVSLIFHEDCSVVTEVGALFCLLLFDEVSRMDMWSVNPSNKPSLPSVFSLPVSVFRRYHLPVHVIGHHAVSPYSIVLPLSADCLALKPVSDMLRIAWNLSWYHGSDNLLKQMNSETKTQEILDALKLSTEDILTLKITHMASGLQDCLHSIVQAATHREVRAAVTRMSFYLLNDRLSLKGCPGPCGVTLKSLAWHTALQFLQVLPACTEDEKLLIDIIHFLNKLIKEQRKNSSLELLNWILELLLRHSANPLLDLLVLTESQAREETDDIRTAVR

SEQ ID NO: 835020 - protein, 411 aa, Homo sapiens
GEKNLLELVELADQALRSFSYHQHFPLIKEIISICSKIWKSAQASPLLQGESQKVLLHMLSHPLPRVKAETYHCCLEITKECLGVHNVTKPVSSLCNGIHFLLHPKVLYEISVFGIQEPESEVNTAAKAILLYLLQGRLMMTALTWNKFIESLCPVIPILQGYADTEDPLGNCILLLSKASSDTEEMLPCTTRLKSMLRLLLVKKPSVRSLALKLLAFHLTSEEGADTKRPLIDARVLSRVTDLFIGKKPIELRLDDRRELVIKLETVEKVYEIFTSDDVDLVLRKSAAEQLAVIMQDIKMHAVVKKLCLIDKIIEYLNECVSQDGKVVECLVQPCLTLLRKVLCGDPVMRVSLSQQSSLLTVLFRVSLIFHEDCSVVTEVGALFCLLLFDALIDLCIVEGDSPYRPSFLL

SEQ ID NO: 835021 - protein, 601 aa, Homo sapiens
GEKNLLELVELADQALRSFSYHQHFPLIKEIISICSKIWKSAQASPLLQGESQKVLLHMLSHPLPRVKAETYHCCLEITKECLGVHNVTKPVSSLCNGIHFLLHPKVLYEISVFGIQEPESEVNTAAKAILLYLLQGRLMMTALTWNKFIESLCPVIPILQGYADTEDPLGNCILLLSKASSDTEEMLPCTTRLKSMLRLLLVKKPSVRSLALKLLAFHLTSEEGADTKRPLIDARVLSRVTDLFIGKKPIELRLDDRRELVIKLETVEKVYEIFTSDDVDLVLRKSAAEQLAVIMQDIKMHAVVKKLCLIDKIIEYLNECVSQDGKVVECLVQPCLTLLRKVLCGDPVMRVSLSQQSSLLTVLFRVSLIFHEDCSVVTEVGALFCLLLFDEVSRMDMWSVNPSNKPSLPSVFSLPVSVFRRYHLPVHVIGHHAVSPYSIVLPLSADCLALKPVSDMLRIAWNLSWYHGSDNLLKQMNSETKTQEILDALKLSTEDILTLKITHMASGLQDCLHSIVQAATHREVRAAVTRMSFYLLNDRLSLKGCPGPCGVTLKSLAWHTALNSKHGKEQAVPATAKTCQLVKTIDARKKLYQLTSKITS

SEQ ID NO: 835022 - protein, 407 aa, Homo sapiens
GGGGGDGDGDGSGDGSSSGSSSVDAAGAGAMNPLEGAGCAARGAGEEEEDAAVKFSAMNLRGLFQDFNPSKFLIYACLLLFSVLLALRLDGIIQWSYWAVFAPIWLWKLMVIVGASVGTGVWARNPQYRAEGETCVEFKAMLIAVGIHLLLLMFEVLVCDRIERGSHFWLLVFMPLFFVSPVSVAACVWGFRHDRSLELEILCSVNILQFIFIALRLDKIIHWPWLVVCVPLWILMSFLCLVVLYYIVWSVLFLRSMDVIAEQRRTHITMALSWMTIVVPLLTFEILLVHKLDGHNAFSCIPIFVPLWLSLITLMATTFGQKGGNHWWFGIRKDFCQFLLEIFPFLREYGNISYDLHHEDNEETEETPVPEPPKIAPMFRKKARVVITQSPGKYVLPPPKLNIEMPD

SEQ ID NO: 835023 - protein, 172 aa, Homo sapiens
MSFLCLVVLYYIVWSVLFLRSMDVIAEQRRTHITMALSWMTIVVPLLTFEILLVHKLDGHNAFSCIPIFVPLWLSLITLMATTFGQKGGNHWWFGIRKDFCQFLLEIFPFLREYGNISYDLHHEDNEETEETPVPEPPKIAPMFRKKARVVITQSPGKYVLPPPKLNIEMPD

SEQ ID NO: 835024 - protein, 230 aa, Homo sapiens
GGGGGDGDGDGSGDGSSSGSSSVDAAGAGAMNPLEGAGCAARGAGEEEEDAAVKFSAMNLRGLFQDFNPSKFLIYACLLLFSVLLALRLDGIIQWSYWAVFAPIWLWKLMVIVGASVGTGVWARNPQYRAEGETCVEFKAMLIAVGIHLLLLMFEVLVCDRIERGSHFWLLVFMPLFFVSPVSVAACVWGFRHDRSLELEILCSVNILQFIFIALRLDKIIHWPWLVCNF

SEQ ID NO: 835025 - protein, 407 aa, Homo sapiens; identical to SEQ ID NO: 835022

SEQ ID NO: 835026 - protein, 727 aa, Homo sapiens
MGNGESQLSSVPAQKLGWFIQEYLKPYEECQTLIDEMVNTICDVLQEPEQFPLVQGVAIGGSYGRKTVLRGNSDGTLVLFFSDLKQFQDQKRSQRDILDKTGDKLKFCLFTKWLKNNFEIQKSLDGFTIQVFTKNQRISFEVLAAFNALSLNDNPSPWIYRELKRSLDKTNASPGEFAVCFTELQQKFFDNRPGKLKDLILLIKHWHQQCQKKIKDLPSLSPYALELLTVYAWEQGCRKDNFDIAEGVRTVLELIKCQEKLCIYWMVNYNFEDETIRNILLHQLQSARPVILDPVDPTNNVSGDKICWQWLKKEAQTWLTSPNLDNELPAPSWNVLPAPLFTTPGHLLDKFIKEFLQPNKCFLEQIDSAVNIIRTFLKENCFRQSTAKIQIVRGGSTAKGTALKTGSDADLVVFHNSLKSYTSQKNERHKIVKEIHEQLKAFWREKEEELEVSFEPPKWKAPRVLSFSLKSKVLNESVSFDVLPAFNALGQLSSGSTPSPEVYAGLIDLYKSSDLPGGEFSTCFTVLQRNFIRSRPTKLKDLIRLVKHWYKECERKLKPKGSLPPKYALELLTIYAWEQGSGVPDFDTAEGFRTVLELVTQYQQLCIFWKVNYNFEDETVRKFLLSQLQKTRPVILDPAEPTGDVGGGDRWCWHLLAKEAKEWLSSPCFKDGTGNPIPPWKVPTMQTPGSCGARIHPIVNEMFSSRSHRILNNNSKRNFWRSSGNRF

SEQ ID NO: 835027 - protein, 687 aa, Homo sapiens
MGNGESQLSSVPAQKLGWFIQEYLKPYEECQTLIDEMVNTICDVLQEPEQFPLVQGVAIGGSYGRKTVLRGNSDGTLVLFFSDLKQFQDQKRSQRDILDKTGDKLKFCLFTKWLKNNFEIQKSLDGFTIQVFTKNQRISFEVLAAFNALSLNDNPSPWIYRELKRSLDKTNASPGEFAVCFTELQQKFFDNRPGKLKDLILLIKHWHQQCQKKIKDLPSLSPYALELLTVYAWEQGCRKDNFDIAEGVRTVLELIKCQEKLCIYWMVNYNFEDETIRNILLHQLQSARPVILDPVDPTNNVSGDKICWQWLKKEAQTWLTSPNLDNELPAPSWNVLPAPLFTTPGHLLDKFIKEFLQPNKCFLEQIDSAVNIIRTFLKENCFRQSTAKIQIVRGGSTAKGTALKTGSDADLVVFHNSLKSYTSQKNERHKIVKEIHEQLKAFWREKEEELEVSFEPPKWKAPRVLSFSLKSKVLNESVSFDVLPAFNALGQLSSGSTPSPEVYAGLIDLYKSSDLPGGEFSTCFTVLQRNFIRSRPTKLKDLIRLVKHWYKECERKLKPKGSLPPKYALELLTIYAWEQGSGVPDFDTAEGFRTVLELVTQYQQLCIFWKVNYNFEDETVRKFLLSQLQKTRPVILDPAEPTGDVGGGDRWCWHLLAKEAKEWLSSPCFKDGTGNPIPPWKVPVKVI

SEQ ID NO: 835028 - protein, 687 aa, Homo sapiens; identical to SEQ ID NO: 835027

SEQ ID NO: 835029 - protein, 172 aa, Homo sapiens [sequence omitted]

SEQ ID NO: 835030 - protein, 172 aa, Homo sapiens [sequence omitted]

SEQ ID NO: 835031 - protein, 687 aa, Homo sapiens; identical to SEQ ID NO: 835027

SEQ ID NO: 835032 - protein, 560 aa, Homo sapiens
MGNGESQLSSVPAQKLGWFIQEYLKPYEECQTLIDEMVNTICDVLQEPEQFPLVQGVAIGGSYGRKTVLRGNSDGTLVLFFSDLKQFQDQKRSQRDILDKTGDKLKFCLFTKWLKNNFEIQKSLDGFTIQVFTKNQRISFEVLAAFNALSLNDNPSPWIYRELKRSLDKTNASPGEFAVCFTELQQKFFDNRPGKLKDLILLIKHWHQQCQKKIKDLPSLSPYALELLTVYAWEQGCRKDNFDIAEGVRTVLELIKCQEKLCIYWMVNYNFEDETIRNILLHQLQSARPVILDPVDPTNNVSGDKICWQWLKKEAQTWLTSPNLDNELPAPSWNVLPAPLFTTPGHLLDKFIKEFLQPNKCFLEQIDSAVNIIRTFLKENCFRQSTAKIQIVRGGSTAKGTALKTGSDADLVVFHNSLKSYTSQKNERHKIVKEIHEQLKAFWREKEEELEVSFEPPKWKAPRVLSFSLKSKVLNESVSFDVLPAFNALGQLSSGSTPSPEVYAGLIDLYKSSDLPGGEFSTCFTVLQRNFIRSRPTKLKHWNFQPHPTPNLQGGDGAGN

SEQ ID NO: 835033 - protein, 105 aa, Homo sapiens
MCQIPCWVLELPKGEKYSHRTKNFRKVHIKVLCKLKHDTNVNGLHIYEMNEWMNEILSASYIPAILGTVNTRLILLCNKRKVYPLYYSDVRNDILLNFKQSRLYW

SEQ ID NO: 835034 - protein, 685 aa, Homo sapiens
ASSLRGLTATERLKMIPFLPMFSLLLLLIVNPINANNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERIMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMDQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYSN

SEQ ID NO: 835035 - protein, 731 aa, Homo sapiens
ASSLRGLTATERLKMIPFLPMFSLLLLLIVNPINANNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERIMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMDQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYRPTLTKVKIEGEPEFRLIKEGETITEVIHGEPIIKKYTKIIDGVPVGN

SEQ ID NO: 835036 - protein, 687 aa, Homo sapiens
ASSLRGLTATERLKMIPFLPMFSLLLLLIVNPINANNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERIMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMDQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYRANY

SEQ ID NO: 835037 - protein, 174 aa, Homo sapiens
MTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYRPTLTKVKIEGEPEFRLIKEGETITEVIHGEPIIKKYTKIIDGVPVGN

SEQ ID NO: 835038 - protein, 174 aa, Homo sapiens; identical to SEQ ID NO: 835037

SEQ ID NO: 835039 - protein, 106 aa, Homo sapiens
GYPSFIYSKTFIESGSGGSCLQSQHLGITATERLKMIPFLPMFSLLLLLIVNPINANNHYDKILAHSRIRGRDQGPNVCALQQILGTKKKYFSTLVMHVTSWHPGI

SEQ ID NO: 835040 - protein, 700 aa, Homo sapiens
ASSLRGLTATERLKMIPFLPMFSLLLLLIVNPINANNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERIMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMDQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYSQLLKNTPKSLMECLWK

SEQ ID NO: 835041 - protein, 763 aa, Homo sapiens
ASSLRGLTATERLKMIPFLPMFSLLLLLIVNPINANNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERIMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMDQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYSPEIKYTRISTGGGETEETLKKLLQEEVTKVTKFIEGGDGHLFEDEEIKRLLQGDTPVRKLQANKKVQGSRRRLREGRSQ

SEQ ID NO: 835042 - protein, 238 aa, Homo sapiens
CSDDPMRERFHSRQQTNTPSMKVENNDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYRPTLTKVKIEGEPEFRLIKEGETITEVIHGEPIIKKYTKIIDGVPVGN

SEQ ID NO: 835043 - protein, 55 aa, Homo sapiens
MLARSFLTVLTEGFFAVAQQLFEPVCTLRVLPMSHGIEMLRSSFLQPLRQSKAPC

SEQ ID NO: 835044 - protein, 163 aa, Homo sapiens
MDNFCLFPCKQDCHFLNPVWSPGWSKESHGSQICWALRRKNFPSGSHIGDRRVHADLLPSKKDRRSWVEQDHWSFEDEKVAGVHWGYEETRTLLAILSQTEFYEALRNCHRNSQVYGAVAERLREYGFSGPWNSVGPSSKVSRRAIGKSRAATHLRPAPSLKR

SEQ ID NO: 835045 - protein, 319 aa, Homo sapiens
MKIELSMQPWNPGYSSEGATAQETYTCPKMIEMEQAEAQLAELDLLASMFPGENELIVNDQLAVAELKDCIEKKTMEGRSSKVYFTINMNLDVSDEKMAMFSLACILPFKYPAVLPEITVRSVLLSRSQQTQLNTDLTAFLQKHCHGDVCILNATEWVREHASGYVSRDTSSSPTTGSTVQSVDLIFTRLWIYSHHIYNKCKRKNILEWAKELSLSGFSMPGKPGVVCVEGPQSACEEFWSRLRKLNWKRILIRHREDIPFDGTNDETERQRKFSIFEEKVFSVNGARGNHMDFGQLYQFLNTKGCGDVFQMFFGVEGQ

SEQ ID NO: 835046 - protein, 301 aa, Homo sapiens
MKIELSMQPWNPGYSSEGATAQETYTCPKMIEMEQAEAQLAELDLLASMFPGENELIVNDQLAVAELKDCIEKKTMEGRSSKVYFTINMNLDVSDEKMAMFSLACILPFKYPAVLPEITVRSVLLSRSQQTQLNTDLTAFLQKHCHGDVCILNATEWVREHASGYVSRDTSSSPTTGSTVQSVDLIFTRLWIYSHHIYNKCKRKNILEWAKELSLSGFSMPGKPGVVCVEGPQSACEEFWSRLRKLNWKRILIRHREDIPFDGTNDETERQRKFSIFEDYQFLNTKGCGDVFQMFFGVEGQ

SEQ ID NO: 835047 - protein, 104 aa, Homo sapiens [sequence omitted]

SEQ ID NO: 835048 - protein, 103 aa, Homo sapiens
MKIELSMQPWNPGYSSEGATAQETYTCPKMIEMEQAEAQLAELDLLASMFPGENELIVNDQLAVAELKDCIEKKTMEGRSSKVYFTINMNLDVSDEKMISIIE

SEQ ID NO: 835049 - protein, 35 aa, Homo sapiens
MRPSVGSVLGVASRLLQPCSSRGPRPGGNQGARAA

SEQ ID NO: 835050 - protein, 319 aa, Homo sapiens; identical to SEQ ID NO: 835045

SEQ ID NO: 835051 - protein, 290 aa, Homo sapiens
MIEMEQAEAQLAELDLLASMFPGENELIVNDQLAVAELKDCIEKKTMEGRSSKVYFTINMNLDVSDEKMAMFSLACILPFKYPAVLPEITVRSVLLSRSQQTQLNTDLTAFLQKHCHGDVCILNATEWVREHASGYVSRDTSSSPTTGSTVQSVDLIFTRLWIYSHHIYNKCKRKNILEWAKELSLSGFSMPGKPGVVCVEGPQSACEEFWSRLRKLNWKRILIRHREDIPFDGTNDETERQRKFSIFEEKVFSVNGARGNHMDFGQLYQFLNTKGCGDVFQMFFGVEGQ

SEQ ID NO: 835052 - protein, 227 aa, Homo sapiens
MKIELSMQPWNPGYSSEGATAQETYTCPKMIEMEQAEAQLAELDLLASMFPGENELIVNDQLAVAELKDCIEKKTMEGRSSKVYFTINMNLDVSDEKMAMFSLACILPFKYPAVLPEITVRSVLLSRSQQTQLNTDLTAFLQKHCHGDVCILNATEWVREHASGYVSRDTSSSPTTGSTVQSVDLIFTRLWIYSHHIYNKCCLENLVLFVWKAHKVPVKNSGQDSEN

SEQ ID NO: 835053 - protein, 117 aa, Homo sapiens
MKIELSMQPWNPGYSSEGATAQETYTCPKMIEMEQAEAQLAELDLLASMFPGENELIVNDQLAVAELKDCIEKKTMEGRSSKVYFTINMNLDVSDEKMTQKIKLEENFNSPSRRHSF

SEQ ID NO: 835054 - protein, 72 aa, Homo sapiens
MMEEISIMVAYDAHVFSQLHDEDFLTSLVAISKPRSMVPTKKLKKYEKEYQTMRESQLQQEDPMDRYKFVYL

SEQ ID NO: 835055 - protein, 256 aa, Homo sapiens
MRESQLQQEDPMDRYKRENRRLQEASMRLEQENDDLAHELVTSKIALRNDLDQAEDKADVLNKELLLTKQRLVETEEEKRKQEEETAQLKEVFRKQLEKAEYEIKKTTAIIAEYKQICSQLSTRLEKQQAASKEELEVVKGKMMACKHCSDIFSKEGALKLAATGREDQGIETDDEKDSLKKQLREMELELAQTKLQLVEAKCKIQELEHQRGALMNEIQAAKNSWFSKTLNSIKTATGTQPLQPAPVTQPPKEST

SEQ ID NO: 835056 - protein, 256 aa, Homo sapiens; identical to SEQ ID NO: 835055

SEQ ID NO: 835057 - protein, 256 aa, Homo sapiens; identical to SEQ ID NO: 835055

SEQ ID NO: 835058 - protein, 256 aa, Homo sapiens; identical to SEQ ID NO: 835055

SEQ ID NO: 835059 - protein, 1158 aa, Homo sapiens
EGPGRARFRPAATASSPPSRPAPSLASSCQAALLPSPLSSLRPPRAPAVAERTGPARLQSARWRVERGRLKELLSRQRPRRREEVVVGREVCRTEMEVRASLQKVSGSSDSVATMNSEEFVLVPQYADDNSTKHEEKPQLKIVSNGDEQLEKAMEEILRDSEKRPSSLLVDCQSSSEISDHSFGDIPASQTNKPSLQLILDPSNTEISTPRPSSPGGLPEEDSVLFNKLTYLGCMKVSSPRNEVEALRAMATMKSSSQYPFPVTLYVPNVPEGSVRIIDQSSNVEIASFPIYKVLFCARGHDGTTESNCFAFTESSHGSEEFQIHVFSCEIKEAVSRILYSFCTAFKRSSRQVSDVKDSVIPTPDSDVFTFSVSLEVKEDDGKGNFRLLVIPIPFEYFSPVPKDRDKFYFKLKQGIEKKVVITVQQLSNKELAIERCFGMLLSPGRNVKNSDMHLLDMESMGKSYDGRAYVITGMWNPNAPVFLALNEETPKDKQVYMTVAVDMVVTEVVEPVRFLLETVVRVYPANERFWYFSRKTFTETFFMRLKQSEGKGHTNAGDAIYEVVSLQRESDKEEPVTPTSGGGPMSPQDDEAEEESDNELSSGTGDVSKDCPEKILYSWGELLGKWHSNLGARPKGLSTLVKSGVPEALRAEVWQLLAGCHDNQAMLDRYRILITKDSAQESVITRDIHRTFPAHDYFKDTGGDGQESLYKICKAYSVYDEDIGYCQGQSFLAAVLLLHMPEEQAFCVLVKIMYDYGLRDLYRNNFEDLHCKFYQLERLMQEQLPDLHSHFSDLNLEAHMYASQWFLTLFTAKFPLCMVFHIIDLLLCEGLNIIFHVALALLKTSKEDLLQADFEGALKFFRVQLPKRYRAEENARRLMEQACNIKVPTKKLKKYEKEYQTMRESQLQQEDPMDRYKRENRRLQEASMRLEQENDDLAHELVTSKIALRNDLDQAEDKADVLNKELLLTKQRLVETEEEKRKQEEETAQLKEVFRKQLEKAEYEIKKTTAIIAEYKQICSQLSTRLEKQQAASKEELEVVKGKMMACKHCSDIFSKEGALKLAATGREDQGIETDDEKDSLKKQLREMELELAQTKLQLVEAKCKIQELEHQRGALMNEIQAAKNSWFSKTLNSIKTATGTQPLQPAPVTQPPKEST

SEQ ID NO: 835060 - protein, 922 aa, Homo sapiens
EGPGRARFRPAATASSPPSRPAPSLASSCQAALLPSPLSSLRPPRAPAVAERTGPARLQSARWRVERGRLKELLSRQRPRRREEVVVGREVCRTEMEVRASLQKVSGSSDSVATMNSEEFVLVPQYADDNSTKHEEKPQLKIVSNGDEQLEKAMEEILRDSEKRPSSLLVDCQSSSEISDHSFGDIPASQTNKPSLQLILDPSNTEISTPRPSSPGGLPEEDSVLFNKLTYLGCMKVSSPRNEVEALRAMATMKSSSQYPFPVTLYVPNVPEGSVRIIDQSSNVEIASFPIYKVLFCARGHDGTTESNCFAFTESSHGSEEFQIHVFSCEIKEAVSRILYSFCTAFKRSSRQVSDVKDSVIPTPDSDVFTFSVSLEVKEDDGKGNFRLLVIPIPFEYFSPVPKDRDKFYFKLKQGIEKKVVITVQQLSNKELAIERCFGMLLSPGRNVKNSDMHLLDMESMGKSYDGRAYVITGMWNPNAPVFLALNEETPKDKQVYMTVAVDMVVTEVVEPVRFLLETVVRVYPANERFWYFSRKTFTETFFMRLKQSEGKGHTNAGDAIYEVVSLQRESDKEEPVTPTSGGGPMSPQDDEAEEESDNELSSGTGDVSKDCPEKILYSWGELLGKWHSNLGARPKGLSTLVKSGVPEALRAEVWQLLAGCHDNQAMLDRYRILITKDSAQESVITRDIHRTFPAHDYFKDTGGDGQESLYKICKAYSVYDEDIGYCQGQSFLAAVLLLHMPEEQAFCVLVKIMYDYGLRDLYRNNFEDLHCKFYQLERLMQEQLPDLHSHFSDLNLEAHMYASQWFLTLFTAKFPLCMVFHIIDLLLCEGLNIIFHVALALLKTSKEDLLQADFEGALKFFRVQLPKRYRAEENARRLMEQACNIKVPTKKLKKYEKEYQTMRESQLQQEDPMDRYKFVYL

SEQ ID NO: 835061 - protein, 922 aa, Homo sapiens; identical to SEQ ID NO: 835060

SEQ ID NO: 835062 - protein, 885 aa, Homo sapiens
EGPGRARFRPAATASSPPSRPAPSLASSCQAALLPSPLSSLRPPRAPAVAERTGPARLQSARWRVERGRLKELLSRQRPRRREEVVVGREVCRTEMEVRASLQKVSGSSDSVATMNSEEFVLVPQYADDNSTKHEEKPQLKIVSNGDEQLEKAMEEILRDSEKRPSSLLVDCQSSSEISDHSFGDIPASQTNKPSLQLILDPSNTEISTPRPSSPGGLPEEDSVLFNKLTYLGCMKVSSPRNEVEALRAMATMKSSSQYPFPVTLYVPNVPEGSVRIIDQSSNVEIASFPIYKVLFCARGHDGTTESNCFAFTESSHGSEEFQIHVFSCEIKEAVSRILYSFCTAFKRSSRQVSDVKDSVIPTPDSDVFTFSVSLEVKEDDGKGNFRLLVIPIPFEYFSPVPKDRDKFYFKLKQGIEKKVVITVQQLSNKELAIERCFGMLLSPGRNVKNSDMHLLDMESMGKSYDGRAYVITGMWNPNAPVFLALNEETPKDKQVYMTVAVDMVVTEVVEPVRFLLETVVRVYPANERFWYFSRKTFTETFFMRLKQSEGKGHTNAGDAIYEVVSLQRESDKEEPVTPTSGGGPMSPQDDEAEEESDNELSSGTGDVSKDCPEKILYSWGELLGKWHSNLGARPKGLSTLVKSGVPEALRAEVWQLLAGCHDNQAMLDRYRILITKDSAQESVITRDIHRTFPAHDYFKDTGGDGQESLYKICKAYSVYDEDIGYCQGQSFLAAVLLLHMPEEQAFCVLVKIMYDYGLRDLYRNNFEDLHCKFYQLERLMQEQLPDLHSHFSDLNLEAHMYASQWFLTLFTAKFPLCMVFHIIDLLLCEGLNIIFHVALALLKTSKEDLLQADFEGALKFFRVQLPKRYRAEVDAAANLVVVVD

SEQ ID NO: 835063 - protein, 711 aa, Homo sapiens
EGPGRARFRPAATASSPPSRPAPSLASSCQAALLPSPLSSLRPPRAPAVAERTGPARLQSARWRVERGRLKELLSRQRPRRREEVVVGREVCRTEMEVRASLQKVSGSSDSVATMNSEEFVLVPQYADDNSTKHEEKPQLKIVSNGDEQLEKAMEEILRDSEKRPSSLLVDCQSSSEISDHSFGDIPASQTNKPSLQLILDPSNTEISTPRPSSPGGLPEEDSVLFNKLTYLGCMKVSSPRNEVEALRAMATMKSSSQYPFPVTLYVPNVPEGSVRIIDQSSNVEIASFPIYKVLFCARGHDGTTESNCFAFTESSHGSEEFQIHVFSCEIKEAVSRILYSFCTAFKRSSRQVSDVKDSVIPTPDSDVFTFSVSLEVKEDDGKGNFRLLVIPIPFEYFSPVPKDRDKFYFKLKQGIEKKVVITVQQLSNKELAIERCFGMLLSPGRNVKNSDMHLLDMESMGKSYDGRAYVITGMWNPNAPVFLALNEETPKDKQVYMTVAVDMVVTEVVEPVRFLLETVVRVYPANERFWYFSRKTFTETFFMRLKQSEGKGHTNAGDAIYEVVSLQRESDKEEPVTPTSGGGPMSPQDDEAEEESDNELSSGTGDVSKDCPEKILYSWGELLGKWHSNLGARPKGLSTLVKSGVPEALRAEVWQLLAGCHDNQAMLDRYRILITKDSAQESVITRDIHRTFPAHDYFKDTGGAATVSLE

SEQ ID NO: 835064 - protein, 1158 aa, Homo sapiens; identical to SEQ ID NO: 835059

SEQ ID NO: 835065 - protein, 922 aa, Homo sapiens; identical to SEQ ID NO: 835060

SEQ ID NO: 835066 - protein, 844 aa, Homo sapiens
EGPGRARFRPAATASSPPSRPAPSLASSCQAALLPSPLSSLRPPRAPAVAERTGPARLQSARWRVERGRLKELLSRQRPRRREEVVVGREVCRTEMEVRASLQKVSGSSDSVATMNSEEFVLVPQYADDNSTKHEEKPQLKIVSNGDEQLEKAMEEILRDSEKRPSSLLVDCQSSSEISDHSFGDIPASQTNKPSLQLILDPSNTEISTPRPSSPGGLPEEDSVLFNKLTYLGCMKVSSPRNEVEALRAMATMKSSSQYPFPVTLYVPNVPEGSVRIIDQSSNVEIASFPIYKVLFCARGHDGTTESNCFAFTESSHGSEEFQIHVFSCEIKEAVSRILYSFCTAFKRSSRQVSDVKDSVIPTPDSDVFTFSVSLEVKEDDGKGNFRLLVIPIPFEYFSPVPKDRDKFYFKLKQGIEKKVVITVQQLSNKELAIERCFGMLLSPGRNVKNSDMHLLDMESMGKSYDGRAYVITGMWNPNAPVFLALNEETPKDKQVYMTVAVDMVVTEVVEPVRFLLETVVRVYPANERFWYFSRKTFTETFFMRLKQSEGKGHTNAGDAIYEVVSLQRESDKEEPVTPTSGGGPMSPQDDEAEEESDNELSSGTGDVSKDCPEKILYSWGELLGKWHSNLGARPKGLSTLVKSGVPEALRAEVWQLLAGCHDNQAMLDRYRILITKDSAQESVITRDIHRTFPAHDYFKDTGGDGQESLYKICKAYSVYDEDIGYCQGQSFLAAVLLLHMPEEQAFCVLVKIMYDYGLRDLYRNNFEDLHCKFYQLERLMQEQLPDLHSHFSDLNLEAHMYASQWFLTLFTAKFPLCMVFHIIDLLLCESGISALQFTGMVTF

SEQ ID NO: 835067 - protein, 700 aa, Homo sapiens
EGPGRARFRPAATASSPPSRPAPSLASSCQAALLPSPLSSLRPPRAPAVAERTGPARLQSARWRVERGRLKELLSRQRPRRREEVVVGREVCRTEMEVRASLQKVSGSSDSVATMNSEEFVLVPQYADDNSTKHEEKPQLKIVSNGDEQLEKAMEEILRDSEKRPSSLLVDCQSSSEISDHSFGDIPASQTNKPSLQLILDPSNTEISTPRPSSPGGLPEEDSVLFNKLTYLGCMKVSSPRNEVEALRAMATMKSSSQYPFPVTLYVPNVPEGSVRIIDQSSNVEIASFPIYKVLFCARGHDGTTESNCFAFTESSHGSEEFQIHVFSCEIKEAVSRILYSFCTAFKRSSRQVSDVKDSVIPTPDSDVFTFSVSLEVKEDDGKGNFSPVPKDRDKFYFKLKQGIEKKVVITVQQLSNKELAIERCFGMLLSPGRNVKNSDMHLLDMESMGKSYDGRAYVITGMWNPNAPVFLALNEETPKDKQVYMTVAVDMVVTEVVEPVRFLLETVVRVYPANERFWYFSRKTFTETFFMRLKQSEGKGHTNAGDAIYEVVSLQRESDKEEPVTPTSGGGPMSPQDDEAEEESDNELSSGTGDVSKDCPEKILYSWGELLGKWHSNLGARPKGLSTLVKSGVPEALRAEVWQLLAGCHDNQAMLDRYRILITKVCWSLLEVHSRPCLPGYHQWKLQNSKYCRMANVAA

SEQ ID NO: 835068 - protein, 71 aa, Homo sapiens
MACKHCSDIFSKEGALKLAATGREDQGIETDDEKDSLKKQLREMELELAQTKLQLVEAKCKIQVGDLIKEQ

SEQ ID NO: 835069 - protein, 256 aa, Homo sapiens; identical to SEQ ID NO: 835055

SEQ ID NO: 835070 - protein, 256 aa, Homo sapiens; identical to SEQ ID NO: 835055

SEQ ID NO: 835071 - protein, 256 aa, Homo sapiens; identical to SEQ ID NO: 835055

SEQ ID NO: 835072 - protein, 256 aa, Homo sapiens; identical to SEQ ID NO: 835055

SEQ ID NO: 835073 - protein, 370 aa, Homo sapiens
MEEGVPCPAPAAKLTPPVKKSQDMHDERSKLVNEYACRVLELLGMGHRLFVPRLLATSKEDLLQADFEGALKFFRVQLPKRYRAEENARRLMEQACNIKVPTKKLKKYEKEYQTMRESQLQQEDPMDRYKRENRRLQEASMRLEQENDDLAHELVTSKIALRNDLDQAEDKADVLNKELLLTKQRLVETEEEKRKQEEETAQLKEVFRKQLEKAEYEIKKTTAIIAEYKQICSQLSTRLEKQQAASKEELEVVKGKMMACKHCSDIFSKEGALKLAATGREDQGIETDDEKDSLKKQLREMELELAQTKLQLVEAKCKIQELEHQRGALMNEIQAAKNSWFSKTLNSIKTATGTQPLQPAPVTQPPKEST

SEQ ID NO: 835074 - protein, 281 aa, Homo sapiens
PNNQSINSKVSGGSTHGTWGSLQETCESEVSGTQKVSFSGQPQNITTEMTGPNNTTNFMTSSLPNSGSVQNNELPSSNTGAWRVSTMNHPQMQAPSGMNGTSLSHLSNGESKSGGSYGTTWGAYGSNYSGDKCSGPNGQANGDTVNATLMQPGVNGPMGTNFQVNTNKGGGVWESGAANSQSTSWGSGNGANSGGSRRGWGTPAQNTGTNLPSVEWNKLPSNQHSNDSANGNGKTFTNGWKSTEEEDQGSATSQTNEQSSVWAKTGGTVESDGSLGLVLAA

SEQ ID NO: 835075 - protein, 360 aa, Homo sapiens
TNFKFPFPEFRPGEPWKGYPNIDPETDPYVTPGSVINNLSINTVREVDHLRDRNSGSSSSLNTTLPSTSAWSSIRASNYNVPLSSTAQSTSARNSDSKLTWSPGSVTNTSLAHELWKVPLPPKNITAPSRPPPGLTGQKPPLSTWDNSPLRIGGGWGNSDARYTPGSSWGESSSGRITNWLVLKNLTPQIDGSTLRTLCMQHGPLITFHLNLPHGNALVRYSSKEEVVKAQKSLHMCVLGNTTILAEFASEEEISRFFAQSQSLTPSPGWQSLGSSQSRLGSLDCSHSFSSRTDLNHWNGAGLSGTNCGDLHGTSLWGTPHYSTSLWGPPSSSDPRGISSPSPINAFLSVDHLGGGGESM

SEQ ID NO: 835076 - protein, 1016 aa, Homo sapiens
VLEDTSYRGRWSVSASDNWGETSRNNHWGEANKKSSSGGSDSDRSVSGWNELGKTSSFTWGNNINPNNSSGWDESSKPTPSQGWGDPPKSNQSLGWGDSSKPVSSPDWNKQQDIVGSWGIPPATGKPPGTGWLGGPIPAPAKEEEPTGWEEPSPESIRRKMEIDDGTSAWGDPSKYNYKNVNMWNKNVPNGNSRSDQQAQVHQLLTPASAISNKEASSGSGPKSMQDGWCGDDMPLPGNRPTGWEEEEDVEIGMWNSNSSQELNSSLNWPPYTKKMSSKGLSGKKRRRERGMMKGGNKQEEAWINPFVKQFSNISFSRDSPEENVQSNKMDLSGGMLQDKRMEIDKHSLNIGDYNRTVGKGPGSRPQISKESSMERNPYFDKNGNPSMFGVGNTAAQPRGMQQPPAQPLSSSQPNLRAQVPPPLLSPQVPVSLLKYAPNNGGLNPLFGPQQVAMLNQLSQLNQLSQISQLQRLLAQQQRAQSQRSVPSGNRPQQDQQGRPLSVQQQMMQQSRQLDPNLLVKQQTPPSQQQPLHQPAMKSFLDNVMPHTTPELQKGPSPINAFSNFPIGLNSNLNVNMDMNSIKEPQSRLRKWTTVDSISVNTSLDQNSSKHGAISSGFRLEESPFVPYDFMNSSTSPASPPGSIGDGWPRAKSPNGSSSVNWPPEFRPGEPWKGYPNIDPETDPYVTPGSVINNLSINTVREVDHLRDRNSGSSSSLNTTLPSTSAWSSIRASNYNVPLSSTAQSTSARNSDSKLTWSPGSVTNTSLAHELWKVPLPPKNITAPSRPPPGLTGQKPPLSTWDNSPLRIGGGWGNSDARYTPGSSWGESSSGRITNWLVLKNLTPQIDGSTLRTLCMQHGPLITFHLNLPHGNALVRYSSKEEVVKAQKSLHMCVLGNTTILAEFASEEEISRFFAQSQSLTPSPGWQSLGSSQSRLGSLDCSHSFSSRTDLNHWNGAGLSGTNCGDLHGTSLWGTPHYSTSLWGPPSSSDPRGISSPSPINAFLSVDHLGGGGESM

SEQ ID NO: 835077 - protein, 442 aa, Homo sapiens
QTKGAKRNVNQENIARATDQLDSISVNTSLDQNSSKHGAISSGFRLEESPFVPYDFMNSSTSPASPPGSIGDGWPRAKSPNGSSSVNWPPEFRPGEPWKGYPNIDPETDPYVTPGSVINNLSINTVREVDHLRDRNSGSSSSLNTTLPSTSAWSSIRASNYNVPLSSTAQSTSARNSDSKLTWSPGSVTNTSLAHELWKVPLPPKNITAPSRPPPGLTGQKPPLSTWDNSPLRIGGGWGNSDARYTPGSSWGESSSGRITNWLVLKNLTPQIDGSTLRTLCMQHGPLITFHLNLPHGNALVRYSSKEEVVKAQKSLHMCVLGNTTILAEFASEEEISRFFAQSQSLTPSPGWQSLGSSQSRLGSLDCSHSFSSRTDLNHWNGAGLSGTNCGDLHGTSLWGTPHYSTSLWGPPSSSDPRGISSPSPINAFLSVDHLGGGGESM

SEQ ID NO: 835078 - protein, 109 aa, Homo sapiens
ILSRSLTYHCDPKVPVSLLKYAPNNGGLNPLFGPQQVAMLNQLSQLNQLSQISQLQVSRVIVFLSTHLWSIYCMPNTRLCAGHSALNKTGVVIVLMELTVYRGRQIVNI

SEQ ID NO: 835079 - protein, 791 aa, Homo sapiens
MWNMLIVAMCLALLGCLQAQELQGHVSIILLGATGDLAKKYLWQGLFQLYLDEAGRGHSFSFHGAALTAPKQGQELMAKALESLSCPKDMAPSHCAEHKDQFLQLSQYRQLKTAEDYQALNKDIEAQLQHAGLREAGRIFYFSVPPFAYEDIARNINSSCRPGPGAWLRVVLEKPFGHDHFSAQQLATELGTFFQEEEMYRVDHYLGKQAVAQILPFRDQNRKALDGLWNRHHVERVEIIMKETVDAEGRTSFYEEYGVIRDVLQNHLTEVLTLVAMELPHNVSSAEAVLRHKLQVFQALRGLQRGSAVVGQYQSYSEQVRRELQKPDSFHSLTPTFAAVLVHIDNLRWEGVPFILMSGKALDERVGYARILFKNQACCVQSEKHWAAAQSQCLPRQLVFHIGHGDLGSPAVLVSRNLFRPSLPSSWKEMEGPPGLRLFGSPLSDYYAYSPVRERDAHSVLLSHIFHGRKNFFITTENLLASWNFWTPLLESLAHKAPRLYPGGAENGRLLDFEFSSGRLFFSQQQPEQLVPGPGPAPMPSDFQVLRAKYRESPLVSAWSEELISKLANDIEATAVRAVRRFGQFHLALSGGSSPVALFQQLATAHYGFPWAHTHLWLVDERCVPLSDPESNFQGLQAHLLQHVRIPYYNIHPMPVHLQQRLCAEEDQGAQIYAREISALVANSSFDLVLLGMGADGHTASLFPQSPTGLDGEQLVVLTTSPSQPHRRMSLSLPLINRAKKVAVLVMGRMKREITTLVSRVGHEPKKWPISGVLPHSGQLVWYMDYDAFLG

SEQ ID NO: 835080 - protein, 791 aa, Homo sapiens
MWNMLIVAMCLALLGCLQAQELQGHVSIILLGATGDLAKKYLWQGLFQLYLDEAGRGHSFSFHGAALTAPKQGQELMAKALESLSCPKDMAPSHCAEHKDQFLQLSQYRQLKTAEDYQALNKDIEAQLQHAGLREAGRIFYFSVPPFAYEDIARNINSSCRPGPGAWLRVVLEKPFGHDHFSAQQLATELGTFFQEEEMYRVDHYLGKQAVAQILPFRDQNRKALDGLWNRHHVERVEIIMKETVDAEGRTSFYEEYGVIRDVLQNHLTEVLTLVAMELPHNVSSAEAVLRHKLQVFQALRGLQRGSAVVGQYQSYSEQVRRELQKPDSFHSLTPTFAGVLVHIDNLRWEGVPFILMSGKALDERVGYARILFKNQACCVQSEKHWAAAQSQCLPRQLVFHIGHGDLGSPAVLVSRNLFRPSLPSSWKEMEGPPGLRLFGSPLSDYYAYSPVRERDAHSVLLSHIFHGRKNFFITTENLLASWNFWTPLLESLAHKAPRLYPGGAENGRLLDFEFSSGRLFFSQQQPEQLVPGPGPAPMPSDFQVLRAKYRESPLVSAWSEELISKLANDIEATAVRAVRRFGQFHLALSGGSSPVALFQQLATAHYGFPWAHTHLWLVDERCVPLSDPESNFQGLQAHLLQHVRIPYYNIHPMPVHLQQRLCAEEDQGAQIYAREISALVANSSFDLVLLGMGADGHTASLFPQSPTGLDGEQLVVLTTSPSQPHRRMSLSLPLINRAKKVAVLVMGRMKREITTLVSRVGHEPKKWPISGVLPHSGQLVWYMDYDAFLG

SEQ ID NO: 835081 - protein, 791 aa, Homo sapiens; identical to SEQ ID NO: 835079

SEQ ID NO: 835082 - protein, 131 aa, Homo sapiens
MQGSGSQFRACLLCLCFSCPCSPGGPRWNSRQGGRRFPKTCRAISQNLVFKYKTFCPVRYMQPHRSSLCLHFTSYVFILSTWGSLRTYSTDLKKKNCLAASQCQSEHGTGKARGDEGEVATVTGRQMRLCK

SEQ ID NO: 835083 - protein, 791 aa, Homo sapiens; identical to SEQ ID NO: 835079

SEQ ID NO: 835084 - protein, 791 aa, Homo sapiens; identical to SEQ ID NO: 835079

SEQ ID NO: 835085 - protein, 791 aa, Homo sapiens; identical to SEQ ID NO: 835079

SEQ ID NO: 835086 - protein, 791 aa, Homo sapiens; identical to SEQ ID NO: 835079

SEQ ID NO: 835087 - protein, 791 aa, Homo sapiens; identical to SEQ ID NO: 835079

SEQ ID NO: 835088 - protein, 791 aa, Homo sapiens; identical to SEQ ID NO: 835079

SEQ ID NO: 835089 - protein, 131 aa, Homo sapiens; identical to SEQ ID NO: 835082

SEQ ID NO: 835090 - protein, 791 aa, Homo sapiens; identical to SEQ ID NO: 835080

SEQ ID NO: 835091 - protein, 123 aa, Homo sapiens
RDRSGNSRVRLLLLNSRPRRQDVEIVPVLGNYFPLPGYGKEDVIVNNIHHPVFNVLQQCSNLFFSFVPTAFVYIENLKISPSLLEVKMFPNLLNMPLFTICFFRLFLMHYRIKYDFVYFYYSM

SEQ ID NO: 835092 - protein, 273 aa, Homo sapiens
MGRSRSRSSSRSKHTKSSKHNKKRSRSRSRSRDKERVRKRSKSRESKRNRRRESRSRSRSTNTAVSRRERDRERASSPPDRIDIFGRTVSKRSSLDEKQKREEEEKKAEFERQRKIRQQEIEEKLIEEETARRVEELVAKRVEEELEKRKDEIEREVLRRVEEAKRIMEKQLLEELERQRQAELAAQKAREVTLGRLESRDSPWQNFQCWVLPPAQFRKRWNTDYLIPFSSKLNIAAKVNFLAYSEVLTDNLKVGSFYKTYSRILFDLMELAI

SEQ ID NO: 835093 - protein, 273 aa, Homo sapiens; identical to SEQ ID NO: 835092

SEQ ID NO: 835094 - protein, 273 aa, Homo sapiens; identical to SEQ ID NO: 835092

SEQ ID NO: 835095 - protein, 106 aa, Homo sapiens [sequence omitted]

SEQ ID NO: 835096 - protein, 273 aa, Homo sapiens; identical to SEQ ID NO: 835092

SEQ ID NO: 835097 - protein, 273 aa, Homo sapiens; identical to SEQ ID NO: 835092

SEQ ID NO: 835098 - protein, 142 aa, Homo sapiens
MKLNEKFSEGWRKPNASWKSSCSKNSSDRDKLSLPHKKLERGSWRVWQPRSTLCRTLDKTEEERAKREELERILEENNRKIAEAQAKLAEEQLRIVEEQRKIHEERMKLEQERQRQQKEEQKIILGKGKSRPKLSFSLKTQD

SEQ ID NO: 835099 - protein, 255 aa, Homo sapiens
MGRSRSRSSSRSKHTKSSKHNKKRSRSRSRSRDKERVRKRSKSRESKRNRRRESRSRSRSTNTAVSRRERDRERASSPPDRIDIFGRTVSKRSSLDEKQKREEEEKKAEFERQRKIRQQEIEEKLIEEETARRVEELVAKRVEEELEKRKDEIEREVLRRVEEAKRIMEKQLLEELERQRQAELAAQKARERKLARMAAEEHTLQDTGQDKEERAKREEVKDKEWVMSQANVSRAKAVRALKNNSNDMVNAIRVR

SEQ ID NO: 835100 - protein, 273 aa, Homo sapiens
MGRSRSRSSSRSKHTKSSKHNKKRSRSRSRSRDKERVRKRSKSRESKRNRRRESRSRSRSTNTAVSRRERDRERASSPPDRIDIFGRTVSKRSSLDEKQKREEEEKKAEFERQRKIRQQEIEEKLIEEETARRVEELVAKRVEEELEKRKDEIEREVLRRVEEAKRIMEKQLLEELERQRQAELAAQKAREEEERAKREELERILEENNRKIAEAQAKLAEEQLRIVEEQRKIHEERMKLEQERQRQQKEEQKIILGKGKSRPKLSFSLKTQD

SEQ ID NO: 835101 - protein, 273 aa, Homo sapiens; identical to SEQ ID NO: 835092

SEQ ID NO: 835102 - protein, 338 aa, Homo sapiens
GHCGKGGRCSRSCHLRGAWRYGFLVGGGLRGSCRRRDASPRPKAEARGTGRVRGLRRAVRASPGRMGRSRSRSSSRSKHTKSSKHNKKRSRSRSRSRDKERVRKRSKSRESKRNRRRESRSRSRSTNTAVSRRERDRERASSPPDRIDIFGRTVSKRSSLDEKQKREEEEKKAEFERQRKIRQQEIEEKLIEEETARRVEELVAKRVEEELEKRKDEIEREVLRRVEEAKRIMEKQLLEELERQRQAELAAQKAREVTLGRLESRDSPWQNFQCWVLPPAQFRKRWNTDYLIPFSSKLNIAAKVNFLAYSEVLTDNLKVGSFYKTYSRILFDLMELAI

SEQ ID NO: 835103 - protein, 273 aa, Homo sapiens; identical to SEQ ID NO: 835092

SEQ ID NO: 835104 - protein, 273 aa, Homo sapiens; identical to SEQ ID NO: 835092

SEQ ID NO: 835105 - protein, 273 aa, Homo sapiens; identical to SEQ ID NO: 835092

SEQ ID NO: 835106 - protein, 555 aa, Homo sapiens
MPTTVDDVLEHGGEFHFFQKQMFFLLALLSATFAPIYVGIVFLGFTPDHRCRSPGVAELSLRCGWSPAEELNYTVPGPGPAGEASPRQCRRYEVDWNQSTFDCVDPLASLDTNRSRLPLGPCRDGWVYETPGSSIVTEFNLVCANSWMLDLFQSSVNVGFFIGSMSIGYIADRFGRKLCLLTTVLINAAAGVLMAISPTYTWMLIFRLIQGLVSKAGWLIGYILITEFVGRRYRRTVGIFYQVAYTVGLLVLAGVAYALPHWRWLQFTVALPNFFFLLYYWCIPESPRWLISQNKNAEAMRIIKHIAKKNGKSLPASLQRLRLEEETGKKLNPSFLDLVRTPQIRKHTMILMYNWFTSSVLYQGLIMHMGLAGDNIYLDFFYSALVEFPAAFMIILTIDRIGRRYPWAASNMVAGAACLASVFIPGDLQWLKIIISCLGRMGITMAYEIVCLVNAELYPTFIRNLGVHICSSMCDIGGIITPFLVYRLTNIWLELPLMVFGVLGLVAGGLVLLLPETKGKALPETIEEAENMQRPRKNKEKMIYLQVQKLDIPLN

SEQ ID NO: 835107 - protein, 574 aa, Homo sapiens
MPTTVDDVLEHGGEFHFFQKQMFLSIFVTLASSCYAFAASIFTGGRSVLSLEHSIPETQPACTGITRGDVQILRSATVCESHVDVTGTYRELGPSTRVDRCTHSLIQCRRYEVDWNQSTFDCVDPLASLDTNRSRLPLGPCRDGWVYETPGSSIVTEFNLVCANSWMLDLFQSSVNVGFFIGSMSIGYIADRFGRKLCLLTTVLINAAAGVLMAISPTYTWMLIFRLIQGLVSKAGWLIGYILITEFVGRRYRRTVGIFYQVAYTVGLLVLAGVAYALPHWRWLQFTVALPNFFFLLYYWCIPESPRWLISQNKNAEAMRIIKHIAKKNGKSLPASLQRLRLEEETGKKLNPSFLDLVRTPQIRKHTMILMYNWFTSSVLYQGLIMHMGLAGDNIYLDFFYSALVEFPAAFMIILTIDRIGRRYPWAASNMVAGAACLASVFIPGDLQWLKIIISCLGRMGITMAYEIVCLVNAELYPTFIRNLGVHICSSMCDIGGIITPFLVYRLTNIWLELPLMVFGVLGLVAGGLVLLLPETKGKALPETIEEAENMQRPRKNKEKMIYLQVQKLDIPLN

SEQ ID NO: 835108 - protein, 555 aa, Homo sapiens
MPTTVDDVLEHGGEFHFFQKQMFFLLALLSATFAPIYVGIVFLGFTPDHRCRSPGVAELSLRCGWSPAEELNYTVPGPGPAGEASPRQCRRYEVDWNQSTFDCVDPLASLDTNRSRLPLGPCRDGWVYETPGSSIVTEFNLVCANSWMLDLFQSSVNVGFFIGSMSIGYIADRFGRKLCLLTTVLINAAAGVLMAISPTYTWMLIFRLIQGLVSKAGWLIGYILITEFVGRRYRRTVGIFYQVAYTVGLLVLAGVAYALPHWRWLQFTVALPNFFFLLYYWCIPESPRWLISQNKNAEAMRIIKHIAKKNGKSLPASLQRLRLEEETGKKLNPSFLDLVRTPQIRKHTMILMYNWFTSSVLYQGLIMHMGLAGDNIYLDFFYSALVEFPAAFMIILTIDRIGRRYPWAASNMVAGAACLASVFIPGDLQWLKIIISCLGRMGITMAYEIVCLVNAELYPTFIRNLGVHICSSMCDIGGIITPFLVYRLTNIWLELPLMVFGVLGLVAGGLVLLLPETKGKALPETIEEAENMQRLLIHSPVFSIHQMLMFLPLQT

SEQ ID NO: 835109 - protein, 143 aa, Homo sapiens
MPTTVDDVLEHGGEFHFFQKQMFFLLALLSATFAPIYVGIVFLGFTPDHRCRSPGVAELSLRCGWSPAEELNYTVPGPGPAGEASPRQCRRYEVDWNQSTFDCVDPLASLDTNRSRLPLGPCRDGWVYETPGSSIVTEMPTHT

SEQ ID NO: 835110 - protein, 555 aa, Homo sapiens; identical to SEQ ID NO: 835106

SEQ ID NO: 835111 - protein, 555 aa, Homo sapiens; identical to SEQ ID NO: 835106

SEQ ID NO: 835112 - protein, 206 aa, Homo sapiens
MRRTGAPAQADSRGRGRARGGCPGGEATLSQPPPRGGTRGQEPQMKETIMNQEKLAKLQAQVRIGGKGTARRKKKVVHRTATADDKKLQFSLKKLGVNNISGIEEVNMFTNQGTVIHFNNPKVQASLAANTFTITGHAETKQLTEMLPSILNQLGADSLTSLRRLAEALPKQSVDGKAPLATGEDDDDEVPDLVENFDEASKNEAN

SEQ ID NO: 835113 - protein, 206 aa, Homo sapiens; identical to SEQ ID NO: 835112

SEQ ID NO: 835114 - protein, 121 aa, Homo sapiens
ISPVVRPAQALNVKSIMPRSGSPMQILERMEIDDQGMHHTDKTSARGKPNVSRWMVPEVAVLDGSVTGMRIKQEQATSETAAVSTFTRPLQGSYGVNTDLCVLEEVNMFTNQGTVIHFKQP

SEQ ID NO: 835115 - protein, 47 aa, Homo sapiens
MLPSILNQLGADSLTLLLCGECGLVSALEQAFSMDLNRPLSKCFIGI

SEQ ID NO: 835116 - protein, 461 aa, Homo sapiens
EAAYKRAPRARLAAKDIWAVCATRVGGAVGGTAKKPRSPEPRVTLLSQSKSGFWFGAERPGGLAFPRKAPPCPWPREQTKSTAGPITLGALRPAMVMEVGTLDAGGLRALLGERAAQCLLLDCRSFFAFNAGHIAGSVNVRFSTIVRRRAKGAMGLEHIVPNAELRGRLLAGAYHAVVLLDERSAALDGAKRDGTLALAAGALCREARAAQVFFLKGGYEAFSASCPELCSKQSTPMGLSLPLSTSVPDSAESGCSSCSTPLYDQGGPVEILPFLYLGSAYHASRKDMLDALGITALINVSANCPNHFEGHYQYKSIPVEDNHKADISSWFNEAIDFIDSIKNAGGRVFVHCQAGISRSATICLAYLMRTNRVKLDEAFEFVKQRRSIISPNFSFMGQLLQFESQVLAPHCSAEAGSPAMAVLDRGTSTTTVFNFPVSIPVHSTNSALSYLQSPITTSPSC

SEQ ID NO: 835117 - protein, 284 aa, Homo sapiens
EAAYKRAPRARLAAKDIWAVCATRVGGAVGGTAKKPRSPEPRVTLLSQSKSGFWFGAERPGGLAFPRKAPPCPWPREQTKSTAGPITLGALRPAMVMEVGTLDAGGLRALLGERAAQCLLLDCRSFFAFNAGHIAGSVNVRFSTIVRRRAKGAMGLEHIVPNAELRGRLLAGAYHAVVLLDERSAALDGAKRDGTLALAAGALCREARAAQVFFLKGGYEAFSASCPELCSKQSTPMGLSLPLSTSVPDSAESGCSSCSTPLYDQVSRCPCHREEVRTGKGMEE

SEQ ID NO: 835118 - protein, 461 aa, Homo sapiens; identical to SEQ ID NO: 835116

SEQ ID NO: 835119 - protein, 284 aa, Homo sapiens; identical to SEQ ID NO: 835117

SEQ ID NO: 835120 - protein, 433 aa, Homo sapiens
EAAYKRAPRARLAAKDIWAVCATRVGGAVGGTAKKPRSPEPRVTLLSQSKSGFWFGAERPGGLAFPRKAPPCPWPREQTKSTAGPITLGALRPAMVMEVGTLDAGGLRALLGERAAQCLLLDCRSFFAFNAGHIAGSVNVRFSTIVRRRAKGAMGLEHIVPNAELRGRLLAGAYHAVVLLDERSAALDGAKRDGTLALAAGALCREARAAQVFFLKGGYEAFSASCPELCSKQSTPMGLSLPLSTSVPDSAESGCSSCSTPLYDQGGPVEILPFLYLGSAYHASRKDMLDALGITALINVSANCPNHFEGHYQYKSIPVEDNHKADISSWFNEAIDFIDSIKNAGGRVFVHCQAGISRSATICLAYLMRTNRVKLDEAFDPHCSAEAGSPAMAVLDRGTSTTTVFNFPVSIPVHSTNSALSYLQSPITTSPSC

SEQ ID NO: 835121 - protein, 487 aa, Homo sapiens
EAAYKRAPRARLAAKDIWAVCATRVGGAVGGTAKKPRSPEPRVTLLSQSKSGFWFGAERPGGLAFPRKAPPCPWPREQTKSTAGPITLGALRPAMVMEVGTLDAGGLRALLGERAAQCLLLDCRSFFAFNAGHIAGSVNVRFSTIVRRRAKGAMGLEHIVPNAELRGRLLAGAYHAVVLLDERSAALDGAKRDGTLALAAGALCREARAAQVFFLKGGYEAFSASCPELCSKQSTPMGLSLPLSTSVPDSAESGCSSCSTPLYDQGGPVEILPFLYLGSAYHASRKDMLDALGITALINVSANCPNHFEGHYQYKSIPVEDNHKADISSWFNEAIDFIDSIKNAGGRVFVHCQAGISRSATICLAYLMRTNRVKLDEAFEFVKQRRSIISPNFSFMGQLLQFESQVLAPHCSAEAGSPAMAVLDRGLRALLGERAAQCLLLDCRSFFAFNAGHIAGSVNVRFSTIVRRRAKGAMGLEHIVPNAELRG

SEQ ID NO: 835122 - protein, 108 aa, Homo sapiens
NQEVETGALLKTKVWKMDRVKLDEAFEFVKQRRSIISPNFSFMGQLLQFESQVLAPHCSAEAGSPAMAVLDRGTSTTTVFNFPVSIPVHSTNSALSYLQSPITTSPSC

SEQ ID NO: 835123 - protein, 461 aa, Homo sapiens; identical to SEQ ID NO: 835116

SEQ ID NO: 835124 - protein, 461 aa, Homo sapiens; identical to SEQ ID NO: 835116

SEQ ID NO: 835125 - protein, 461 aa, Homo sapiens; identical to SEQ ID NO: 835116

SEQ ID NO: 835126 - protein, 554 aa, Homo sapiens
EAAYKRAPRARLAAKDIWAVCATRVGGAVGGTAKKPRSPEPRVTLLSQSKSGFWFGAERPGGLAFPRKAPPCPWPREQTKSTAGPITLGALRPAMVMEVGTLDAGGLRALLGERAAQCLLLDCRSFFAFNAGHIAGSVNVRFSTIVRRRAKGAMGLEHIVPNAELRGRLLAGAYHAVVLLDERSAALDGAKRDGTLALAAGALCREARAAQVFFLKGTPSGKLGAGRTPLRFCPVPLALGSRGIAPPAARGRWSTFISGTCHWLCLALETKTCLGLSDVNFQPLVGGGVVRRCRVPVSLMGKKNVFVFPGGYEAFSASCPELCSKQSTPMGLSLPLSTSVPDSAESGCSSCSTPLYDQGGPVEILPFLYLGSAYHASRKDMLDALGITALINVSANCPNHFEGHYQYKSIPVEDNHKADISSWFNEAIDFIDSIKNAGGRVFVHCQAGISRSATICLAYLMRTNRVKLDEAFEFVKQRRSIISPNFSFMGQLLQFESQVLAPHCSAEAGSPAMAVLDRGTSTTTVFNFPVSIPVHSTNSALSYLQSPITTSPSC

SEQ ID NO: 835127 - protein, 388 aa, Homo sapiens
EAAYKRAPRARLAAKDIWAVCATRVGGAVGGTAKKPRSPEPRVTLLSQSKSGFWFGAERPGGLAFPRKAPPCPWPREQTKSTAGPITLGALRPAMVMEVGTLDAGGLRALLGERAAQCLLLDCRSFFAFNAGHIAGSVNVRFSTIVRRRAKGAMGLEHIVPNAELRGRLLAGAYHAVVLLDERSAALDGAKRDGTLALAAGALCREARAAQVFFLKGGYEAFSASCPELCSKQSTPMGLSLPLSTSVPDSAESGCSSCSTPLYDQGGPVEILPFLYLGSAYHASRKDMLDALGITALINVSANCPNHFEGHYQYKSIPVEDNHKADISSWFNEAIDFIGKWNGCLGLFCLSLLILATKPNLCGKSLKFSEPSSTHSVSVWCGQHSCKI

SEQ ID NO: 835128 - protein, 397 aa, Homo sapiens
EAAYKRAPRARLAAKDIWAVCATRVGGAVGGTAKKPRSPEPRVTLLSQSKSGFWFGAERPGGLAFPRKAPPCPWPREQTKSTAGPITLGALRPAMVMEVGTLDAGGLRALLGERAAQCLLLDCRSFFAFNAGHIAGSVNVRFSTIVRRRAKGAMGLEHIVPNAELRGRLLAGAYHAVVLLDERSAALDGAKRDGTLALAAGALCREARAAQVFFLKGGYEAFSASCPELCSKQINVSANCPNHFEGHYQYKSIPVEDNHKADISSWFNEAIDFIDSIKNAGGRVFVHCQAGISRSATICLAYLMRTNRVKLDEAFEFVKQRRSIISPNFSFMGQLLQFESQVLAPHCSAEAGSPAMAVLDRGTSTTTVFNFPVSIPVHSTNSALSYLQSPITTSPSC

SEQ ID NO: 835129 - protein, 443 aa, Homo sapiens
EAAYKRAPRARLAAKDIWAVCATRVGGAVGGTAKKPRSPEPRVTLLSQSKSGFWFGAERPGGLAFPRITLGALRPAMVMEVGTLDAGGLRALLGERAAQCLLLDCRSFFAFNAGHIAGSVNVRFSTIVRRRAKGAMGLEHIVPNAELRGRLLAGAYHAVVLLDERSAALDGAKRDGTLALAAGALCREARAAQVFFLKGGYEAFSASCPELCSKQSTPMGLSLPLSTSVPDSAESGCSSCSTPLYDQGGPVEILPFLYLGSAYHASRKDMLDALGITALINVSANCPNHFEGHYQYKSIPVEDNHKADISSWFNEAIDFIDSIKNAGGRVFVHCQAGISRSATICLAYLMRTNRVKLDEAFEFVKQRRSIISPNFSFMGQLLQFESQVLAPHCSAEAGSPAMAVLDRGTSTTTVFNFPVSIPVHSTNSALSYLQSPITTSPSC

SEQ ID NO: 835130 - protein, 204 aa, Homo sapiens
MLDISGFQGGPVEILPFLYLGSAYHASRKDMLDALGITALINVSANCPNHFEGHYQYKSIPVEDNHKADISSWFNEAIDFIDSIKNAGGRVFVHCQAGISRSATICLAYLMRTNRVKLDEAFEFVKQRRSIISPNFSFMGQLLQFESQVLAPHCSAEAGSPAMAVLDRGTSTTTVFNFPVSIPVHSTNSALSYLQSPITTSPSC

SEQ ID NO: 835131 - protein, 295 aa, Homo sapiens
METPAWPRVPRPETAVARTLLLGWVFAQVAGASGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFREIFYIIGAVVFVVIILVIILAISLHKCRKAGVGQSWKENSPLNVS

SEQ ID NO: 835132 - protein, 295 aa, Homo sapiens
MALGSSRSSYNKALPMNNFKENVKILAGVLGLQGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFREIFYIIGAVVFVVIILVIILAISLHKCRKAGVGQSWKENSPLNVS

SEQ ID NO: 835133 - protein, 201 aa, Homo sapiens
METPAWPRVPRPETAVARTLLLGWVFAQVAGASGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKVSIF

SEQ ID NO: 835134 - protein, 108 aa, Homo sapiens
METPAWPRVPRPETAVARTLLLGWVFAQVAGASGLGRGNPKGLDCCLDWSRYNVVHAPYFYEVFVDGVETGTCCVLAKQTFIRNNPDANTADGVTGHTSPWVSVEVSV

SEQ ID NO: 835135 - protein, 127 aa, Homo sapiens
PKTASSPHPLALPLAGPGRLQPNLPSPTGATEPARSRRQLVDMETPAWPRVPRPETAVARTLLLGWVFAQVAGASGEWHQPLEARGAPHAGGRRQSWLAAGSPWFPGAPMLSPAPTGLGCAHPARLE

SEQ ID NO: 835136 - protein, 295 aa, Homo sapiens; identical to SEQ ID NO: 835131

SEQ ID NO: 835137 - protein, 238 aa, Homo sapiens
METPAWPRVPRPETAVARTLLLGWVFAQVAGASGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKYSTSLELWYLWSSSLSSSWLYLYTSVERQEWGRAGRRTPH

SEQ ID NO: 835138 - protein, 295 aa, Homo sapiens; identical to SEQ ID NO: 835131

SEQ ID NO: 835139 - protein, 143 aa, Homo sapiens
METPAWPRVPRPETAVARTLLLGWVFAQVAGASGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLESKWLGL

SEQ ID NO: 835140 - protein, 1426 aa, Homo sapiens
MHSSNPKVRSSPSGNTQSSPKSKQEVMVRPPTVMSPSGNPQLDSKFSNQGKQGGSASQSQPSPCDSKSGGHTPKALPGPGGSMGLKNGAGNGAKGKGKRERSISADSFDQRDPGTPNDDSDIKECNSADHIKSQDSQHTPHSMTPSNATAPRSSTPSHGQTTATEPTPAQKTPAKVVYVFSTEMANKAAEAVLKGQVETIVSFHIQNISNNKTERSTAPLNTQISALRNDPKPLPQQPPAPANQDQNSSQNTRLQPTPPIPAPAPKPAAPPRPLDRESPGVENKLIPSVGSPASSTPLPPDGTGPNSTPNNRAVTPVSQGSNSSSADPKAPPPPPVSSGEPPTLGENPDGLSQEQLEHRERSLQTLRDIQRMLFPDEKEFTGAQSGGPQQNPGVLDGPQKKPEGPIQAMMAQSQSLGKGPGPRTDVGAPFGPQGHRDVPFSPDEMVPPSMNSQSGTIGPDHLDHMTPEQIAWLKLQQEFYEEKRRKQEQVVVQQCSLQDMMVHQHGPRGVVRGPPPPYQMTPSEGWAPGGTEPFSDGINMPHSLPPRGMAPHPNMPGSQMRLPGFAGMINSEMEGPNVPNPASRPGLSGVSWPDDVPKIPDGRNFPPGQGIFSGPGRGERFPNPQGLSEEMFQQQLAEKQLGLPPGMAMEGIRPSMEMNRMIPGSQRHMEPGNNPIFPRIPVEGPLSPSRGDFPKGIPPQMGPGRELEFGMVPSGMKGDVNLNVNMGSNSQMIPQKMREAGAGPEEMLKLRPGGSDMLPAQQKMVPLPFGEHPQQEYGMGPRPFLPMSQGPGSNSGLRNLREPIGPDQRTNSRLSHMPPLPLNPSSNPTSLNTAPPVQRGLGRKPLDISVAGSQVHSPGINPLKSPTMHQVQSPMLGSPSGNLKSPQTPSQLAGMLAGPAAAASIKSPPVLGSAAASPVHLKSPSLPAPSPGWTSSPKPPLQSPGIPPNHKAPLTMASPAMLGNVESGGPPPPTASQPASVNIPGSLPSSTPYTMPPEPTLSQNPLSIMMSRMSKFAMPSSTPLYHDAIKTVASSDDDSPPARSPNLPSMNNMPGMGINTQNPRISGPNPVVPMPTLSPMGMTQPLSHSNQMPSPNAVGPNIPPHGVPMGPGLMSHNPIMGHGSQEPPMVPQGRMGFPQGFPPVQSPPQQVPFPHNGPSGGQGSFPGGMGFPGEGPLGRPSNLPQSSADAALCKPGGPGGPDSFTVLGNSMPSVFTDPDLQEVIRPGATGIPEFDLSRIIPSEKPSQTLQYFPRGEVPGRKQPQGPGPGFSHMQGMMGEQAPRMGLALPGMGGPGPVGTPDIPLGTAPSMPGHNPMRPPAFLQQGMMGPHHRMMSPAQSTMPGQPTLMSNPAAAVGMIPGKDRGPAGLYTHPGPVGSPGMMMSMQGMMGPQQNIMIPPQMRPRGMAADVGMGGFSQGPGNPGNMMF

SEQ ID NO: 835141 - protein, 1426 aa, Homo sapiens; identical to SEQ ID NO: 835140

SEQ ID NO: 835142 - protein, 1352 aa, Homo sapiens
MHSSNPKVRSSPSGNTQSSPKSKQEVMVRPPTVMSPSGNPQLDSKFSNQECNSADHIKSQDSQHTPHSMTPSNATAPRSSTPSHGQTTATEPTPAQKTPAKVVYVFSTEMANKAAEAVLKGQVETIVSFHIQNISNNKTERSTAPLNTQISALRNDPKPLPQQPPAPANQDQNSSQNTRLQPTPPIPAPAPKPAAPPRPLDRESPGVENKLIPSVGSPASSTPLPPDGTGPNSTPNNRAVTPVSQGSNSSSADPKAPPPPPVSSGEPPTLGENPDGLSQEQLEHRERSLQTLRDIQRMLFPDEKEFTGAQSGGPQQNPGVLDGPQKKPEGPIQAMMAQSQSLGKGPGPRTDVGAPFGPQGHRDVPFSPDEMVPPSMNSQSGTIGPDHLDHMTPEQIAWLKLQQEFYEEKRRKQEQVVVQQCSLQDMMVHQHGPRGVVRGPPPPYQMTPSEGWAPGGTEPFSDGINMPHSLPPRGMAPHPNMPGSQMRLPGFAGMINSEMEGPNVPNPASRPGLSGVSWPDDVPKIPDGRNFPPGQGIFSGPGRGERFPNPQGLSEEMFQQQLAEKQLGLPPGMAMEGIRPSMEMNRMIPGSQRHMEPGNNPIFPRIPVEGPLSPSRGDFPKGIPPQMGPGRELEFGMVPSGMKGDVNLNVNMGSNSQMIPQKMREAGAGPEEMLKLRPGGSDMLPAQQKMVPLPFGEHPQQEYGMGPRPFLPMSQGPGSNSGLRNLREPIGPDQRTNSRLSHMPPLPLNPSSNPTSLNTAPPVQRGLGRKPLDISVAGSQVHSPGINPLKSPTMHQVQSPMLGSPSGNLKSPQTPSQLAGMLAGPAAAASIKSPPVLGSAAASPVHLKSPSLPAPSPGWTSSPKPPLQSPGIPPNHKAPLTMASPAMLGNVESGGPPPPTASQPASVNIPGSLPSSTPYTMPPEPTLSQNPLSIMMSRMSKFAMPSSTPLYHDAIKTVASSDDDSPPARSPNLPSMNNMPGMGINTQNPRISGPNPVVPMPTLSPMGMTQPLSHSNQMPSPNAVGPNIPPHGVPMGPGLMSHNPIMGHGSQEPPMVPQGRMGFPQGFPPVQSPPQQVPFPHNGPSGGQGSFPGGMGFPGEGPLGRPSNLPQSSADAALCKPGGPGGPDSFTVLGNSMPSVFTDPDLQEVIRPGATGIPEFDLSRIIPSEKPSQTLQYFPRGEVPGRKQPQGPGPGFSHMQGMMGEQAPRMGLALPGMGGPGPVGTPDIPLGTAPSMPGHNPMRPPAFLQQGMMGPHHRMMSPAQSTMPGQPTLMSNPAAAVGMIPGKDRGPAGLYTHPGPVGSPGMMMSMQGMMGPQQNIMIPPQMRPRGMAADVGMGGFSQGPGNPGNMMF

SEQ ID NO: 835143 - protein, 1426 aa, Homo sapiens; identical to SEQ ID NO: 835140

SEQ ID NO: 835144 - protein, 1064 aa, Homo sapiens
MHSSNPKVRSSPSGNTQSSPKSKQEVMVRPPTVMSPSGNPQLDSKFSNQGKQGGSASQSQPSPCDSKSGGHTPKALPGPGGSMGLKNGAGNGAKGKGKRERSISADSFDQRDPGTPNDDSDIKECNSADHIKSQDSQHTPHSMTPSNATAPRSSTPSHGQTTATEPTPAQKTPAKVVYVFSTEMANKAAEAVLKGQVETIVSFHIQNISNNKTERSTAPLNTQISALRNDPKPLPQQPPAPANQDQNSSQNTRLQPTPPIPAPAPKPAAPPRPLDRESPGVENKLIPSVGSPASSTPLPPDGTGPNSTPNNRAVTPVSQGSNSSSADPKAPPPPPVSSGEPPTLGENPDGLSQEQLEHRERSLQTLRDIQRMLFPDEKEFTGAQSGGPQQNPGVLDGPQKKPEGPIQAMMAQSQSLGKGPGPRTDVGAPFGPQGHRDVPFSPDEMVPPSMNSQSGTIGPDHLDHMTPEQIAWLKLQQEFYEEKRRKQEQVVVQQCSLQDMMVHQHGPRGVVRGPPPPYQMTPSEGWAPGGTEPFSDGINMPHSLPPRGMAPHPNMPGSQMRLPGFAGMINSEMEGPNVPNPASRPGLSGVSWPDDVPKIPDGRNFPPGQGIFSGPGRGERFPNPQGLSEEMFQQQLAEKQLGLPPGMAMEGIRPSMEMNRMIPGSQRHMEPGNNPIFPRIPVEGPLSPSRGDFPKGIPPQMGPGRELEFGMVPSGMKGDVNLNVNMGSNSQMIPQKMREAGAGPEEMLKLRPGGSDMLPAQQKMVPLPFGEHPQQEYGMGPRPFLPMSQGPGSNSGLRNLREPIGPDQRTNSRLSHMPPLPLNPSSNPTSLNTAPPVQRGLGRKPLDISVAGSQVHSPGINPLKSPTMHQVQSPMLGSPSGNLKSPQTPSQLAGMLAGPAAAASIKSPPVLGSAAASPVHLKSPSLPAPSPGWTSSPKPPLQSPGIPPNHKAPLTMASPAMLGNVESGGPPPPTASQPASVNIPGSLPSSTPYTMPPEPTLSQNPLSIMMSRMSKFAMPSSTPLYHDAIKTVASSDDDSPPARSPNLPSMNNMPGKKSERQVVE

SEQ ID NO: 835145 - protein, 1453 aa, Homo sapiens
AEVNHGVVILVLRVSLTPNRNCLSLICADQLYLVSDLPLLFVSFSSPKSKQEVMVRPPTVMSPSGNPQLDSKFSNQGKQGGSASQSQPSPCDSKSGGHTPKALPGPGGSMGLKNGAGNGAKGKGKRERSISADSFDQRDPGTPNDDSDIKECNSADHIKSQDSQHTPHSMTPSNATAPRSSTPSHGQTTATEPTPAQKTPAKVVYVFSTEMANKAAEAVLKGQVETIVSFHIQNISNNKTERSTAPLNTQISALRNDPKPLPQQPPAPANQDQNSSQNTRLQPTPPIPAPAPKPAAPPRPLDRESPGVENKLIPSVGSPASSTPLPPDGTGPNSTPNNRAVTPVSQGSNSSSADPKAPPPPPVSSGEPPTLGENPDGLSQEQLEHRERSLQTLRDIQRMLFPDEKEFTGAQSGGPQQNPGVLDGPQKKPEGPIQAMMAQSQSLGKGPGPRTDVGAPFGPQGHRDVPFSPDEMVPPSMNSQSGTIGPDHLDHMTPEQIAWLKLQQEFYEEKRRKQEQVVVQQCSLQDMMVHQHGPRGVVRGPPPPYQMTPSEGWAPGGTEPFSDGINMPHSLPPRGMAPHPNMPGSQMRLPGFAGMINSEMEGPNVPNPASRPGLSGVSWPDDVPKIPDGRNFPPGQGIFSGPGRGERFPNPQGLSEEMFQQQLAEKQLGLPPGMAMEGIRPSMEMNRMIPGSQRHMEPGNNPIFPRIPVEGPLSPSRGDFPKGIPPQMGPGRELEFGMVPSGMKGDVNLNVNMGSNSQMIPQKMREAGAGPEEMLKLRPGGSDMLPAQQKMVPLPFGEHPQQEYGMGPRPFLPMSQGPGSNSGLRNLREPIGPDQRTNSRLSHMPPLPLNPSSNPTSLNTAPPVQRGLGRKPLDISVAGSQVHSPGINPLKSPTMHQVQSPMLGSPSGNLKSPQTPSQLAGMLAGPAAAASIKSPPVLGSAAASPVHLKSPSLPAPSPGWTSSPKPPLQSPGIPPNHKAPLTMASPAMLGNVESGGPPPPTASQPASVNIPGSLPSSTPYTMPPEPTLSQNPLSIMMSRMSKFAMPSSTPLYHDAIKTVASSDDDSPPARSPNLPSMNNMPGMGINTQNPRISGPNPVVPMPTLSPMGMTQPLSHSNQMPSPNAVGPNIPPHGVPMGPGLMSHNPIMGHGSQEPPMVPQGRMGFPQGFPPVQSPPQQVPFPHNGPSGGQGSFPGGMGFPGEGPLGRPSNLPQSSADAALCKPGGPGGPDSFTVLGNSMPSVFTDPDLQEVIRPGATGIPEFDLSRIIPSEKPSQTLQYFPRGEVPGRKQPQGPGPGFSHMQGMMGEQAPRMGLALPGMGGPGPVGTPDIPLGTAPSMPGHNPMRPPAFLQQGMMGPHHRMMSPAQSTMPGQPTLMSNPAAAVGMIPGKDRGPAGLYTHPGPVGSPGMMMSMQGMMGPQQNIMIPPQMRPRGMAADVGMGGFSQGPGNPGNMMF

SEQ ID NO: 835146 - protein, 1426 aa, Homo sapiens; identical to SEQ ID NO: 835140

SEQ ID NO: 835147 - protein, 70 aa, Homo sapiens
SNPRSIMRSAGPPQGTLRSTPKFPELKFKYVEEEQPEEFFIPYVWSLVYNSAVGLYWNPQDIQLFTMDSD

SEQ ID NO: 835148 - protein, 669 aa, Homo sapiens
MGSNSSRIGDLPKNEYLKKLSGTESISENDPFWNQLLSFSFPAPTSSSELKLLEEATISVCRSLVENNPRTGNLGALIKVFLSRTKELKLSAECQNHIFIWQTHNALFIICCLLKVFICQMSEEELQLHFTYEEKSPGNYSSDSEDLLEELLCCLMQLITDIPLLDITYEISVEAISTMVVFLSCQLFHKEVLRQSISHKYLMRGPCLPYTSKLVKTLLYNFIRQEKPPPPGAHVFPQQSDGGGLLYGLASGVATGLWTVFTLGGVGSKAAASPELSSPLANQSLLLLLVLANLTDASDAPNPYRQAIMSFKNTQDSSPFPSSIPHAFQINFNSLYTALCEQQTSDQATLLLYTLLHQNSNIRTYMLARTDMENLVLPILEILYHVEERNSHHVYMALIILLILTEDDGFNRSIHEVILKNITWYSERVLTEISLGSLLILVVIRTIQYNMTRTRDKYLHTNCLAALANMSAQFRSLHQYAAQRIISLFSLLSKKHNKVLEQATQSLRGSLSSNDVPLPDYAQDLNVIEEVIRMMLEIINSCLTNSLHHNPNLVYALLYKRDLFEQFRTHPSFQDIMQNIDLVISFFSSRLLQAGAELSVERVLEIIKQGVVALPKDRLKKFPELKFKYVEEEQPEEFFIPYVWSLVYNSAVGLYWNPQDIQLFTMDSD

SEQ ID NO: 835149 - protein, 669 aa, Homo sapiens; identical to SEQ ID NO: 835148

SEQ ID NO: 835150 - protein, 656 aa, Homo sapiens
MGSNSSRIGDLPKNEYLKKLSGTESISENDPFWNQLLSFSFPAPTSSSELKLLEEATISVCRSLVENNPRTGNLGALIKVFLSRTKELKLSAECQNHIFIWQTHNALFIICCLLKVFICQMSEEELQLHFTYEEKSPGNYSSDSEDLLEELLCCLMQLITDIPLLDITYEISVEAISTMVVFLSCQLFHKEVLRQSISHKYLMRGPCLPYTSKLVKTLLYNFIRQEKPPPPGAHVFPQQSDGGGLLYGLASGVATGLWTVFTLGGVGSKAAASPELSSPLANQSLLLLLVLANLTDASDAPNPYRQAIMSFKNTQDSSPFPSSIPHAFQINFNSLYTALCEQQTSDQATLLLYTLLHQNSNIRTYMLARTDMENLVLPILEILYHVEERNSHHVYMALIILLILTEDDGFNRSIHEVILKNITWYSERVLTEISLGSLLILVVIRTIQYNMTRTRDKYLHTNCLAALANMSAQFRSLHQYAAQRIISLFSLLSKKHNKVLEQATQSLRGSLSSNDVPLPDYAQDLNVIEEVIRMMLEIINSCLTNSLHHNPNLVYALLYKRDLFEQFRTHPSFQDIMQNIDLVISFFSSRLLQAGAELSVERVLEIIKQGVVALPKDRLKPLADRQVDRVLACQAFVYAASGFSQFHGLSVRNFQN

SEQ ID NO: 835151 - protein, 549 aa, Homo sapiens
MSEEELQLHFTYEEKSPGNYSSDSEDLLEELLCCLMQLITDIPLLDITYEISVEAISTMVVFLSCQLFHKEVLRQSISHKYLMRGPCLPYTSKLVKTLLYNFIRQEKPPPPGAHVFPQQSDGGGLLYGLASGVATGLWTVFTLGGVGSKAAASPELSSPLANQSLLLLLVLANLTDASDAPNPYRQAIMSFKNTQDSSPFPSSIPHAFQINFNSLYTALCEQQTSDQATLLLYTLLHQNSNIRTYMLARTDMENLVLPILEILYHVEERNSHHVYMALIILLILTEDDGFNRSIHEVILKNITWYSERVLTEISLGSLLILVVIRTIQYNMTRTRDKYLHTNCLAALANMSAQFRSLHQYAAQRIISLFSLLSKKHNKVLEQATQSLRGSLSSNDVPLPDYAQDLNVIEEVIRMMLEIINSCLTNSLHHNPNLVYALLYKRDLFEQFRTHPSFQDIMQNIDLVISFFSSRLLQAGAELSVERVLEIIKQGVVALPKDRLKKFPELKFKYVEEEQPEEFFIPYVWSLVYNSAVGLYWNPQDIQLFTMDSD

SEQ ID NO: 835152 - protein, 669 aa, Homo sapiens; identical to SEQ ID NO: 835148

SEQ ID NO: 835153 - protein, 608 aa, Homo sapiens
MGSNSSRIGDLPKNEYLKKLSGTESISENDPFWNQLLSFSFPAPTSSSELKLLEEATISVCRSLVENNPRTGNLGALIKVFLSRTKELKLSAECQNHIFIWQTHNALFIICCLLKVFICQMSEEELQLHFTYEEKSPGNYSSDSEDLLEELLCCLMQLITDIPLLDITYEISVEAISTMVVFLSCQLFHKEVLRQSISHKYLMRGPCLPYTSKLVKTLLYNFIRQEKPPPPGAHVFPQQSDGGGLLYGLASGVATGLWTVFTLGGVGSKAAASPELSSPLANQSLLLLLVLANLTDASDAPNPYRQAIMSFKNTQDSSPFPSSIPHAFQINFNSLYTALCEQQTSDQATLLLYTLLHQNSNIRTYMLARTDMENLVLPILEILYHVEERNSHHVYMALIILLILTEDDGFNRSIHEVILKNITWYSERVLTEISLGSLLILVVIRTIQYNMTRTRDKYLHTNCLAALANMSAQFRSLHQYAAQRIISLFSLLSKKHNKVLEQATQSLRGSLSSNDVPLPDYVISFFSSRLLQAGAELSVERVLEIIKQGVVALPKDRLKKFPELKFKYVEEEQPEEFFIPYVWSLVYNSAVGLYWNPQDIQLFTMDSD

SEQ ID NO: 835154 - protein, 67 aa, Homo sapiens
NDYYTRLQRNFDRHGNIDKFPELKFKYVEEEQPEEFFIPYVWSLVYNSAVGLYWNPQDIQLFTMDSD

SEQ ID NO: 835155 - protein, 66 aa, Homo sapiens
RVSVLVLFLFSDGTLEPKFPELKFKYVEEEQPEEFFIPYVWSLVYNSAVGLYWNPQDIQLFTMDSD

SEQ ID NO: 835156 - protein, 669 aa, Homo sapiens; identical to SEQ ID NO: 835148

SEQ ID NO: 835157 - protein, 602 aa, Homo sapiens
MGSNSSRIGDLPKNEYLKKLSGTESISENDPFWNQLLSFSFPAPTSSSELKLLEEATISVCRSLVENNPRTGNLGALIKVFLSRTKELKLSAECQNHIFIWQTHNALFIICCLLKVFICQMSEEELQLHFTYEEKSPGNYSSDSEDLLEELLCCLMQLITDIPLLDITYEISVEAISTMVVFLSCQLFHKEVLRQSISHKYLMRGPCLPYTSKLVKTLLYNFIRQEKPPPPGAHVFPQQSDGGGLLYGLASGVATGLWTVFTLGGVGSKAAASPELSSPLANQSLLLLLVLANLTDASDAPNPYRQAIMSFKNTQDSSPFPSSIPHAFQINFNSLYTALCEQQTSDQATLLLYTLLHQNSNIRTYMLARTDMENLVLPILEILYHVEERNSHHVYMALIILLILTEDDGFNRSIHEVILKNITWYSERVLTEISLGSLLILVVIRTIQYNMTRTRDKYLHTNCLAALANMSAQFRSLHQYAAQRIISLFSLLSKKHNKVLEQATQSLRGSLSSNDVPLPDYAQDLNVIEEVIRMMLEIINSCLTNSLHHNPNLVYALLYKRDLFEQFRTHPSFQDIMQNIDLVSVNEDIYYDSFLSIKAENV

SEQ ID NO: 835158 - protein, 669 aa, Homo sapiens; identical to SEQ ID NO: 835148

SEQ ID NO: 835159 - protein, 669 aa, Homo sapiens; identical to SEQ ID NO: 835148

SEQ ID NO: 835160 - protein, 73 aa, Homo sapiens
FLLYFYIITGPTENVAVHVQEYSSKFPELKFKYVEEEQPEEFFIPYVWSLVYNSAVGLYWNPQDIQLFTMDSD

SEQ ID NO: 835161 - protein, 1005 aa, Homo sapiens
GSSALSPPRVRGESWNLCTGLGKRLSSSAKMSGIGNKRAAGEPGTSMPPEKKAAVEDSGTTVETIKLGGVSSTEELDIRTLQTKNRKLAEMLDQRQAIEDELREHIEKLERRQATDDASLLIVNRYWSQFDENIRIILKRYDLEQGLGDLLTERKALVVPEPEPDSDSNQERKDDRERGEGQEPAFSFLATLASSSSEEMESQLQERVESSRRAVSQIVTVYDKLQEKVELLSRKLNSGDNLIVEEAVQELNSFLAQENMRLQELTDLLQEKHRTMSQEFSKLQSKVETAESRVSVLESMIDDLQWDIDKIRKREQRLNRHLAEVLERVNSKGYKVYGAGSSLYGGTITINARKFEEMNAELEENKELAQNRLCELEKLRQDFEEVTTQNEKLKVELRSAVEQVVKETPEYRCMQSQFSVLYNESLQLKAHLDEARTLLHGTRGTHQHQVELIERDEVSLHKKLRTEVIQLEDTLAQVRKEYEMLRIEFEQTLAANEQAGPINREMRHLISSLQNHNHQLKGEVLRYKRKLREAQSDLNKTRLRSGSALLQSQSSTEDPKDEPAELKPDSEDLSSQSSASKASQEDANEIKSKRDEEERERERREKEREREREREKEKEREREKQKLKESEKERDSAKDKEKGKHDDGRKKEAEIIKQLKIELKKAQESQKEMKLLLDMYRSAPKEQRDKVQLMAAEKKSKAELEDLRQRLKDLEDKEKKENKKMADEDALRKIRAVEEQIEYLQKKLAMAKQEEEALLSEMDVTGQAFEDMQEQNIRLMQQLREKDDANFKLMSERIKSNQIHKLLKEEKEELADQVLTLKTQVDAQLQVVRKLEEKEHLLQSNIGTGEKELGLRTQALEMNKRKAMEAAQLADDLKAQLELAQKKLHDFQDEIVENSVTKEKDMFNFKRAQEDISRLRRKLETTKKPDNVPKCDEILMEEIKDYKARLTCPCCNMRKKDAVLTKCFHVFCFECVKTRYDTRQRKCPKCNAAFGANDFHRIYIG

SEQ ID NO: 835162 - protein, 447 aa, Homo sapiens
SISESQQNTSAITISTSGHPTNSSNNTFANEIKSKRDEEERERERREKEREREREREKEKEREREKQKLKESEKERDSAKDKEKGKHDDGRKKEAEIIKQLKIELKKAQESQKEMKLLLDMYRSAPKEQRDKVQLMAAEKKSKAELEDLRQRLKDLEDKEKKENKKMADEDALRKIRAVEEQIEYLQKKLAMAKQEEEALLSEMDVTGQAFEDMQEQNIRLMQQLREKDDANFKLMSERIKSNQIHKLLKEEKEELADQVLTLKTQVDAQLQVVRKLEEKEHLLQSNIGTGEKELGLRTQALEMNKRKAMEAAQLADDLKAQLELAQKKLHDFQDEIVENSVTKEKDMFNFKRAQEDISRLRRKLETTKKPDNVPKCDEILMEEIKDYKARLTCPCCNMRKKDAVLTKCFHVFCFECVKTRYDTRQRKCPKCNAAFGANDFHRIYIG

SEQ ID NO: 835163 - protein, 868 aa, Homo sapiens
GSSALSPPRVRGESWNLCTGLGKRLSSSAKMSGIGNKRAAGEPGTSMPPEKKAAVEDSGTTVETIKLGGVSSTEELDIRTLQTKNRKLAEMLDQRQAIEDELREHIEKLERRQATDDASLLIVNRYWSQFDENIRIILKRYDLEQGLGDLLTERKALVVPEPEPDSDSNQERKDDRERGEGQEPAFSFLATLASSSSEEMESQLQERVESSRRAVSQIVTVYDKLQEKVELLSRKLNSGDNLIVEEAVQELNSFLAQENMRLQELTDLLQEKHRTMSQEFSKLQSKVETAESRVSVLESMIDDLQWDIDKIRKREQRLNRHLAEVLERVNSKGYKVYGAGSSLYGGTITINARKFEEMNAELEENKELAQNRLCELEKLRQDFEEVTTQNEKLKVELRSAVEQVVKETPEYRCMQSQFSVLYNESLQLKAHLDEARTLLHGTRGTHQHQVELIERDEVSLHKKLRTEVIQLEDTLAQVRKEYEMLRIEFEQTLAANEQAGPINREMRHLISSLQNHNHQLKGEVLRYKRKLREAQSDLNKTRLRSGSALLQSQSSTEDPKDEPAELKPDSEDLSSQSSASKASQEDANEIKSKRDEEERERERREKEREREREREKEKEREREKQKLKESEKERDSAKDKEKGKHDDGRKKEAEIIKQLKIELKKAQESQKEMKLLLDMYRSAPKEQRDKVQLMAAEKKSKAELEDLRQRLKDLEDKEKKENKKMADEDALRKIRAVEEQIEYLQKKLAMAKQEEEALLSEMDVTGQAFEDMQEQNIRLMQQLREKDDANFKLMSERIKSNQIHKLLKEEKEELAALGSGVIGARCISNGGVNRGSTWNQIFKVLPAGHAFDGGSDGLVAFVHVIRRH

SEQ ID NO: 835164 - protein, 915 aa, Homo sapiens [sequence omitted]

SEQ ID NO: 835165 - protein, 430 aa, Homo sapiens [sequence omitted]

SEQ ID NO: 835166 - protein, 289 aa, Homo sapiens
MSYITNHGSEEQIKHFIPQMTAGKCIGAIAMTEPGAGSDLQGIKTNAKKDGSDWILNGSKVFISNGSLSDVVIVVAVTNHEAPSPAHGISLFLVENGMKGFIKGRKLHKMGLKAQDTAELFFEDIRLPASALLGEENKGFYYIMKELPQERLLIADVAISASEFMFEETRNYVKQRKAFGKTVAHLQTVQHKLAELKTHICVTRAFVDNCLQLHEAKRLDSATACMAKYWASELQNSVAYDCVQLHGGWGYMWEYPIAKAYVDARVQPIYGGTNEIMKELIAREIVFDK

SEQ ID NO: 835167 - protein, 430 aa, Homo sapiens [sequence omitted]

SEQ ID NO: 835168 - protein, 124 aa, Homo sapiens
MAARLLRGSLRVLGGHRAPRQLPAARCSHSGGEERLETPSAKKLTDIGIRRIFSPEHDIFRKSVRKFFQEEVIPHHSEWEKAGEVSREVWEKAGKQGLLGVNIAEHLGGIGGDLYSAAIVWEEQ

SEQ ID NO: 835169 - protein, 408 aa, Homo sapiens
MAARLLRGSLRVLGGHRAPRQLPAARCSHSGGEERLETPSAKKLTDIGIRRIFSPEHDIFRKSVRKFFQEEVIPHHSEWEKAGEVSREVWEKAGKQGLLGVNIAEHLGGIGGDLYSAAIVWEEQAYSNCSGPGFSIHSGIVMSYITNHGSEEQIKHFIPQMTAGKCIGAIAMTEPGAGSDLQGIKTNAKKDGSDWILNGSKVFISNGSLSDVVIVVAVTNHEAPSPAHGISLFLVENGMKGFIKGRKLHKMGLKAQDTAELFFEDIRLPASALLGEENKGFYYIMKELPQERLLIADVAISASEFMFEETRNYVKQRKAFGKTVAHLQTVQHKLAELKTHICVTRAFVDNCLQLHEAKRLDSATACMAKYWASELQNSVAYDCVQLHGGWGYMWEYPIAKNPDEYGEE

SEQ ID NO: 835170 - protein, 96 aa, Homo sapiens
RFGRRWSPPGPGCRSAGCDLCPSSSCEPGVPHGLDSPRGSELGTRTQCPGCGADQNCPGQTGLEMTWRGFHQTRKLALDISTNLTKYRGLMKTESK

SEQ ID NO: 835171 - protein, 306 aa, Homo sapiens [sequence omitted]

SEQ ID NO: 835172 - protein, 190 aa, Homo sapiens
MLPFSCYSVKIAPGAVVCVESEIRGDVTIGPRTVIHPKARIIAEAGPIVIGEGNLIEEQALIINAYPDNITPDTEDPEPKPMIIGTNNVFEVGCYSQAMKMGDNNVIESKAYVGRNVILTSGCIIGACCNLNTFEVIPENTVIYGADCLRRVQTERPQPQTLQLDFLMKILPNYHHLKKTMKGSSTPVKN

SEQ ID NO: 835173 - protein, 306 aa, Homo sapiens [sequence omitted]

SEQ ID NO: 835174 - protein, 162 aa, Homo sapiens
MLPRLVSQSGTPGLKRSSCLGLSASQSAGLCPVNGCSKLGSTHLYAGLKSAGGPAPLPKVQSCAPRRDAHKSRKLPGPRPTPAPPLPQPCQALQSHVELSLYPGGGVDLRSNWGRTMAEKTQKSVKIAPGAVVCVESEIRGDVTIVTQIISLLTLKIQNQNL

SEQ ID NO: 835175 - protein, 287 aa, Homo sapiens
MLPRLVSQSGTPGLKRSSCLGLSASQSAGLCPVNGCSKLGSTHLYAGLKSAGGPAPLPKVQSCAPRRDAHKSRKLPGPRPTPAPPLPQPCQALQSHVELSLYPGGGVDLRSNWGRTMAEKTQKSVKIAPGAVVCVESEIRGDVTIGPRTVIHPKARIIAEAGPIVIGEGNLIEEQALIINAYPDNITPDTEDPEPKPMIIGTNNVFEVGCYSQAMKMGDNNVIESKAYVGRNVILTSGCIIGACCNLNTFLDENLAKLPPPKEDYERKLNSSKELRTVYNMKITFCL

SEQ ID NO: 835176 - protein, 243 aa, Homo sapiens
MLPRLVSQSGTPGLKRSSCLGLSASQSAGLCPVNGCSKLGSTHLYAGLKSAGGPAPLPKVQSCAPRRDAHKSRKLPGPRPTPAPPLPQPCQALQSHVELSLYPGGGVDLRSNWGRTMAEKTQKSVKIAPGAVVCVESEIRGDVTIGPRTVIHPKARIIAEAGPIVIGEGNLIEEQALIINAYPDNITPDTEDPEPKPMIIGTNNVFEVGCYSLAMPLRRNNVIESKASVGYPEGAFMKMLQAR

SEQ ID NO: 835177 - protein, 306 aa, Homo sapiens [sequence omitted]

SEQ ID NO: 835178 - protein, 306 aa, Homo sapiens [sequence omitted]

SEQ ID NO: 835179 - protein, 192 aa, Homo sapiens
GIPGMETQKSVKIAPGAVVCVESEIRGDVTIGPRTVIHPKARIIAEAGPIVIGEGNLIEEQALIINAYPDNITPDTEDPEPKPMIIGTNNVFEVGCYSQAMKMGDNNVIESKAYVGRNVILTSGCIIGACCNLNTFEVIPENTVIYGADCLRRVQTERPQPQTLQLDFLMKILPNYHHLKKTMKGSSTPVKN

SEQ ID NO: 835180 - protein, 192 aa, Homo sapiens; identical to SEQ ID NO: 835179

SEQ ID NO: 835181 - protein, 106 aa, Homo sapiens
MAGNVFEVGCYSQAMKMGDNNVIESKAYVGRNVILTSGCIIGACCNLNTFEVIPENTVIYGADCLRRVQTERPQPQTLQLDFLMKILPNYHHLKKTMKGSSTPVKN

SEQ ID NO: 835182 - protein, 164 aa, Homo sapiens [sequence omitted]

SEQ ID NO: 835183 - protein, 148 aa, Homo sapiens
MLPRLVSQSGTPGLKRSSCLGLSASQSAGLCPVNGCSKLGSTHLYAGLKSAGGPAPLPKVQSCAPRRDAHKSRKLPGPRPTPAPPLPQPCQALQSHVELSLYPGGGVDLRSNWGRTMAEKTQKSVKIAPGAVVCVESEIRGDVTIGKK

SEQ ID NO: 835184 - protein, 112 aa, Homo sapiens
MESDAGTFLPTGLQFTGSEKARAIMEEVMSLLQPLNITQVLSHGEGTDINFWIQAGVPGASLLDDLYKYFFFHHSHGDTMTVMDPKQMNVAAAVWAVVSYVVADMEEMLPRS

SEQ ID NO: 835185 - protein, 88 aa, Homo sapiens
DLSDIEGLQQAHNLLHDGHGEGTDINFWIQAGVPGASLLDDLYKYFFFHHSHGDTMTVMDPKQMNVAAAVWAVVSYVVADMEEMLPRS

SEQ ID NO: 835186 - protein, 103 aa, Homo sapiens
MKTPKVIVTKTKIDKWDLIKEFLHSKRNYQQSKIDNLQNGRKYFANYVSDKGVISRIYKELKQFNKLKTNNPIKKWAKDMNRHFSNEDRQAANKHMKKCSTSL

SEQ ID NO: 835187 - protein, 472 aa, Homo sapiens
MKFLIFAFFGGVHLLSLCSGKAICKNGISKRTFEEIKEEIASCGDVAKAIINLAVYGKAQNRSYERLALLVDTVGPRLSGSKNLEKAIQIMYQNLQQDGLEKVHLEPVRIPHWERGEESAVMLEPRIHKIAILGLGSSIGTPPEGITAEVLVVTSFDELQRRASEARGKIVVYNQPYINYSRTVQYRTQGAVEAAKVGALASLIRSVASFSIYSPHTGIQEYQDGVPKIPTACITVEDAEMMSRMASHGIKIVIQLKMGAKTYPDTDSFNTVAEITGSKYPEQVVLVSGHLDSWDVGQGAMDDGGGAFISWEALSLIKDLGLRPKRTLRLVLWTAEEQGGVGAFQYYQLHKVNISNYSLVMESDAGTFLPTGLQFTGSEKARAIMEEVMSLLQPLNITQVLSHGEGTDINFWIQAGVPGASLLDDLYKYFFFHHSHGDTMTVMDPKQMNVAAAVWAVVSYVVADMEEMLPRS

SEQ ID NO: 835188 - protein, 472 aa, Homo sapiens; identical to SEQ ID NO: 835187

SEQ ID NO: 835189 - protein, 472 aa, Homo sapiens; identical to SEQ ID NO: 835187

SEQ ID NO: 835190 - protein, 472 aa, Homo sapiens; identical to SEQ ID NO: 835187

SEQ ID NO: 835191 - protein, 129 aa, Homo sapiens [sequence omitted]

SEQ ID NO: 835192 - protein, 127 aa, Homo sapiens
MGSCRRVNISNYSLVMESDAGTFLPTGLQFTGSEKARAIMEEVMSLLQPLNITQVLSHGEGTDINFWIQAGVPGASLLDDLYKYFFFHHSHGDTMTVMDPKQMNVAAAVWAVVSYVVADMEEMLPRS

SEQ ID NO: 835193 - protein, 293 aa, Homo sapiens
MKFLIFAFFGGVHLLSLCSGKAICKNGISKRTFEEIKEEIASCGDVAKAIINLAVYGKAQNRSYERLALLVDTVGPRLSGSKNLEKAIQIMYQNLQQDGLEKVHLEPVRIPHWERGEESAVMLEPRIHKIAILGLGSSIGTPPEGITAEVLVVTSFDELQRRASEARGKIVVYNQPYINYSRTVQYRTQGAVEAAKVGALASLIRSVASFSIYSPHTGIQEYQDGVPKIPTACITVEDAEMMSRMASHGIKIVIQLKMGAKTYPDTDSFNTVAEITGSKYPEQVVGVTMGASS

SEQ ID NO: 835194 - protein, 208 aa, Homo sapiens
MKFLIFAFFGGVHLLSLCSGKAICKNGISKRTFEEIKEEIASCGDVAKAIINLAVYGKAQNRSYERLALLVDTVGPRLSGSKNLEKAIQIMYQNLQQDGLEKVHLEPVRIPHWERGEESVFGLLFLMLLQTWKKCCLGPRNSKKETFSCFWPGILGLQLWKTPLHITISSNSSSKHNSISCFLLLSFLILSKFSDSRKRNHSPLPPTT

SEQ ID NO: 835195 - protein, 141 aa, Homo sapiens
MSSAAPSQVNISNYSLVMESDAGTFLPTGLQFTGKDFMMKTPKVIVTKTKIDKWDLIKEFLHSKRNYQQSKIDNLQNGRKYFANYVSDKGVISRIYKELKQFNKLKTNNPIKKWAKDMNRHFSNEDRQAANKHMKKCSTSL

SEQ ID NO: 835196 - protein, 472 aa, Homo sapiens; identical to SEQ ID NO: 835187

SEQ ID NO: 835197 - protein, 472 aa, Homo sapiens; identical to SEQ ID NO: 835187

SEQ ID NO: 835198 - protein, 472 aa, Homo sapiens; identical to SEQ ID NO: 835187

SEQ ID NO: 835199 - protein, 382 aa, Homo sapiens [sequence omitted]

SEQ ID NO: 835200 - protein, 162 aa, Homo sapiens
RKGKRNGHVSGLRPKRTLRLVLWTAEEQGGVGAFQYYQLHKVNISNYSLVMESDAGTFLPTGLQFTGSEKARAIMEEVMSLLQPLNITQVLSHGEGTDINFWIQAGVPGASLLDDLYKYFFFHHSHGDTMTVMDPKQMNVAAAVWAVVSYVVADMEEMLPRS

SEQ ID NO: 835201 - protein, 422 aa, Homo sapiens
MKFLIFAFFGGVHLLSLCSGKAICKNGISKRTFEEIKEEIASCGDVAKAIINLAVYGKAQNRSYERLALLVDTVGPRLSGSKNLEKAIQIMYQNLQQDGLEKVHLEPVRIPHWERGEESAVMLEPRIHKIAILGLGSSIGTPPEGITAEVLVVTSFDELQRRASEARGKIVVYNQPYINYSRTVQYRTQGAVEAAKVGALASLIRSVASFSIYSPHTGIQEYQDGVPKIPTACITVEDAEMMSRMASHGIKIVIQLKMGAKTYPDTDSFNTVAEITGSKYPEQVVLVSGHLDSWDVGQGAMDDGGGAFISWEALSLIKDLGLRPKRTLRLVLWTAEEQGGVGAFQYYQLHKVNISNYSLVMESDAGTFLPTGLQFTGSEKARAIMEEVMSLLQPLNITQVLSHGEGTDINFWIQAGVPGTSA

SEQ ID NO: 835202 - protein, 127 aa, Homo sapiens; identical to SEQ ID NO: 835192

SEQ ID NO: 835203 - protein, 78 aa, Homo sapiens
GSWTQRHIHTEGRQCEDKEKTVMKAKTVVMNLQAKECRRLPANHQHLGERHEIDSPSQRSEGSKSPDTLNSAFYPSEL

SEQ ID NO: 835204 - protein, 376 aa, Homo sapiens
MDVLAEANGTFALNLLKTLGKDNSKNVFFSPMSMSCALAMVYMGAKGNTAAQMAQILSFNKSGGGGDIHQGFQSLLTEVNKTGTQYLLRMANRLFGEKSCDFLSSFRDSCQKFYQAEMEELDFISAVEKSRKHINTWVAEKTEGKIAELLSPGSVDPLTRLVLVNAVYFRGNWDEQFDKENTEERLFKVSKNEEKPVQMMFKQSTFKKTYIGEIFTQILVLPYVGKELNMIIMLPDETTDLRTVEKELTYEKFVEWTRLDMMDEEEVEVSLPRFKLEESYDMESVLRNLGMTDAFELGKADFSGMSQTDLSLSKVVHKSFVEVNEEGTEAAAATAAIMMMRCARFVPRFCADHPFLFFIQHSKTNGILFCGRFSSP

SEQ ID NO: 835205 - protein, 376 aa, Homo sapiens; identical to SEQ ID NO: 835204

SEQ ID NO: 835206 - protein, 376 aa, Homo sapiens; identical to SEQ ID NO: 835204

SEQ ID NO: 835207 - protein, 376 aa, Homo sapiens; identical to SEQ ID NO: 835204

SEQ ID NO: 835208 - protein, 391 aa, Homo sapiens
VSASTLFLTTDRSAIMDVLAEANGTFALNLLKTLGKDNSKNVFFSPMSMSCALAMVYMGAKGNTAAQMAQILSFNKSGGGGDIHQGFQSLLTEVNKTGTQYLLRMANRLFGEKSCDFLSSFRDSCQKFYQAEMEELDFISAVEKSRKHINTWVAEKTEGKIAELLSPGSVDPLTRLVLVNAVYFRGNWDEQFDKENTEERLFKVSKNEEKPVQMMFKQSTFKKTYIGEIFTQILVLPYVGKELNMIIMLPDETTDLRTVEKELTYEKFVEWTRLDMMDEEEVEVSLPRFKLEESYDMESVLRNLGMTDAFELGKADFSGMSQTDLSLSKVVHKSFVEVNEEGTEAAAATAAIMMMRCARFVPRFCADHPFLFFIQHSKTNGILFCGRFSSP

SEQ ID NO: 835209 - protein, 394 aa, Homo sapiens
SRHSAIVALGSLETWSAIMDVLAEANGTFALNLLKTLGKDNSKNVFFSPMSMSCALAMVYMGAKGNTAAQMAQILSFNKSGGGGDIHQGFQSLLTEVNKTGTQYLLRMANRLFGEKSCDFLSSFRDSCQKFYQAEMEELDFISAVEKSRKHINTWVAEKTEGKIAELLSPGSVDPLTRLVLVNAVYFRGNWDEQFDKENTEERLFKVSKNEEKPVQMMFKQSTFKKTYIGEIFTQILVLPYVGKELNMIIMLPDETTDLRTVEKELTYEKFVEWTRLDMMDEEEVEVSLPRFKLEESYDMESVLRNLGMTDAFELGKADFSGMSQTDLSLSKVVHKSFVEVNEEGTEAAAATAAIMMMRCARFVPRFCADHPFLFFIQHSKTNGILFCGRFSSP

SEQ ID NO: 835210 - protein, 380 aa, Homo sapiens
MSAIMDVLAEANGTFALNLLKTLGKDNSKNVFFSPMSMSCALAMVYMGAKGNTAAQMAQILSFNKSGGGGDIHQGFQSLLTEVNKTGTQYLLRMANRLFGEKSCDFLSSFRDSCQKFYQAEMEELDFISAVEKSRKHINTWVAEKTEGKIAELLSPGSVDPLTRLVLVNAVYFRGNWDEQFDKENTEERLFKVSKNEEKPVQMMFKQSTFKKTYIGEIFTQILVLPYVGKELNMIIMLPDETTDLRTVEKELTYEKFVEWTRLDMMDEEEVEVSLPRFKLEESYDMESVLRNLGMTDAFELGKADFSGMSQTDLSLSKVVHKSFVEVNEEGTEAAAATAAIMMMRCARFVPRFCADHPFLFFIQHSKTNGILFCGRFSSP

SEQ ID NO: 835211 - protein, 376 aa, Homo sapiens; identical to SEQ ID NO: 835204

SEQ ID NO: 835212 - protein, 376 aa, Homo sapiens; identical to SEQ ID NO: 835204

SEQ ID NO: 835213 - protein, 360 aa, Homo sapiens
ESHSVARLECSGTISAHCNLRLPGSSDSLSSASRVAGLQILSFNKSGGGGDIHQGFQSLLTEVNKTGTQYLLRMANRLFGEKSCDFLSSFRDSCQKFYQAEMEELDFISAVEKSRKHINTWVAEKTEGKIAELLSPGSVDPLTRLVLVNAVYFRGNWDEQFDKENTEERLFKVSKNEEKPVQMMFKQSTFKKTYIGEIFTQILVLPYVGKELNMIIMLPDETTDLRTVEKELTYEKFVEWTRLDMMDEEEVEVSLPRFKLEESYDMESVLRNLGMTDAFELGKADFSGMSQTDLSLSKVVHKSFVEVNEEGTEAAAATAAIMMMRCARFVPRFCADHPFLFFIQHSKTNGILFCGRFSSP

SEQ ID NO: 835214 - protein, 259 aa, Homo sapiens
MEELDFISAVEKSRKHINTWVAEKTEGKIAELLSPGSVDPLTRLVLVNAVYFRGNWDEQFDKENTEERLFKVSKNEEKPVQMMFKQSTFKKTYIGEIFTQILVLPYVGKELNMIIMLPDETTDLRTVEKELTYEKFVEWTRLDMMDEEEVEVSLPRFKLEESYDMESVLRNLGMTDAFELGKADFSGMSQTDLSLSKVVHKSFVEVNEEGTEAAAATAAIMMMRCARFVPRFCADHPFLFFIQHSKTNGILFCGRFSSP

SEQ ID NO: 835215 - protein, 362 aa, Homo sapiens
MDVLAEANGTFALNLLKTLGKDNSKNVFFSPMSMSCALAMVYMGAKGNTAAQMAQILSFNKSGGGGDIHQGFQSLLTEVNKTGTQYLLRMANRLFGEKSCDFLSSFRDSCQKFYQAEMEELDFISAVEKSRKHINTWVAEKTEGKIAELLSPGSVDPLTRLVLVNAVYFRGNWDEQFDKENTEERLFKVSKNEEKPVQMMFKQSTFKKTYIGEIFTQILVLPYVGKELNMIIMLPDETTDLRTVEKELTYEKFVEWTRLDMMDEEEVEVSLPRFKLEESYDMESVLRNLGMTDAFELGKADFSGMSQTDLSLSKVVHKSFVEVNEEGTEAAAATAAIMMMRCARFVPRFCADHPFLFLLSVP

SEQ ID NO: 835216 - protein, 177 aa, Homo sapiens
MFKQSTFKKTYIGEIFTQILVLPYVGKELNMIIMLPDETTDLRTVEKELTYEKFVEWTRLDMMDEEEVEVSLPRFKLEESYDMESVLRNLGMTDAFELGKADFSGMSQTDLSLSKVVHKSFVEVNEEGTEAAAATAAIMMMRCARFVPRFCADHPFLFFIQHSKTNGILFCGRFSSP

SEQ ID NO: 835217 - protein, 283 aa, Homo sapiens
MDVLAEANGTFALNLLKTLGKDNSKNVFFSPMSMSCALAMVYMGAKGNTAAQMAQILSFNKSGGGGDIHQGFQSLLTEVNKTGTQYLLRMANRLFGEKSCDFLSSFRDSCQKFYQAEMEELDFISAVEKSRKHINTWVAEKTEGKIAELLSPGSVDPLTRLVLVNAVYFRGNWDEQFDKENTEERLFKVSKNEEKPVQMMFKQSTFKKTYIGEIFTQILVLPYVGKELNMIIMLPDETTDLRTVEKELTYEKFVEWTRLDMMDEEEVEVSLQARRLQPPQLPS

SEQ ID NO: 835218 - protein, 115 aa, Homo sapiens [sequence omitted]

SEQ ID NO: 835219 - protein, 144 aa, Homo sapiens
MRHEETTDLRTVEKELTYEKFVEWTRLDMMDEEEVEVSLPRFKLEESYDMESVLRNLGMTDAFELGKADFSGMSQTDLSLSKVVHKSFVEVNEEGTEAAAATAAIMMMRCARFVPRFCADHPFLFFIQHSKTNGILFCGRFSSP

SEQ ID NO: 835220 - protein, 259 aa, Homo sapiens
MDVLAEANGTFALNLLKTLGKDNSKNVFFSPMSMSCALAMVYMGAKGNTAAQMAQILSFNKSGGGGDIHQGFQSLLTEVNKTGTQYLLRMANRLFGEKSCDFLSSFRDSCQKFYQAEMEELDFISAVEKSRKHINTWVAEKTEGKIAELLSPGSVDPLTRLVLVNAVYFRGNWDEQFDKENTEERLFKVSKDLSLSKVVHKSFVEVNEEGTEAAAATAAIMMMRCARFVPRFCADHPFLFFIQHSKTNGILFCGRFSSP

SEQ ID NO: 835221 - protein, 199 aa, Homo sapiens
MDVLAEANGTFALNLLKTLGKDNSKNVFFSPMSMSCALAMVYMGAKGNTAAQMAQILSFNKSGGGGDIHQGFQSLLTEVNKTGTQYLLRMANRLFGEKSCDFLSSFRDSCQKFYQAEMEELDFISAVEKSRKHINTWVAEKTEGKIAELLSPGSVDPLTRLVLVNAVYFRGNWDEQFDKENTEERLFKVSKASKGPCQE

SEQ ID NO: 835222 - protein, 194 aa, Homo sapiens
MGAAQSLPGHRSAIMDVLAEANGTFALNLLKTLGKDNSKNVFFSPMSMSCALAMVYMGAKGNTAAQMAQILSFNKSGGGGDIHQGFQSLLTEVNKTGTQYLLRMANRLFGEKSCDFLSSFRDSCQKFYQAEMEELDFISAVEKSRKHINTWVAEKTEGENVLLFYFCNNLLIHFIVSSFTRLSIVNRNDFFFSE

SEQ ID NO: 835223 - protein, 123 aa, Homo sapiens
MGAAQSLPGHRSAIMDVLAEANGTFALNLLKTLGKDNSKNVFFSPMSMSCALAMVYMGAKGNTAAQMAQILSFNKSGGGGDIHQGFQSLLTEVNKTGTQYLLRMANRLFGEKSCDFLSVSHTC

SEQ ID NO: 835224 - protein, 376 aa, Homo sapiens; identical to SEQ ID NO: 835204

SEQ ID NO: 835225 - protein, 376 aa, Homo sapiens; identical to SEQ ID NO: 835204

SEQ ID NO: 835226 - protein, 143 aa, Homo sapiens
SRPHIRSRRTVEKELTYEKFVEWTRLDMMDEEEVEVSLPRFKLEESYDMESVLRNLGMTDAFELGKADFSGMSQTDLSLSKVVHKSFVEVNEEGTEAAAATAAIMMMRCARFVPRFCADHPFLFFIQHSKTNGILFCGRFSSP

SEQ ID NO: 835227 - protein, 390 aa, Homo sapiens
MGAAQSLPGHRSAIMDVLAEANGTFALNLLKTLGKDNSKNVFFSPMSMSCALAMVYMGAKGNTAAQMAQILSFNKSGGGGDIHQGFQSLLTEVNKTGTQYLLRMANRLFGEKSCDFLSSFRDSCQKFYQAEMEELDFISAVEKSRKHINTWVAEKTEGKIAELLSPGSVDPLTRLVLVNAVYFRGNWDEQFDKENTEERLFKVSKNEEKPVQMMFKQSTFKKTYIGEIFTQILVLPYVGKELNMIIMLPDETTDLRTVEKELTYEKFVEWTRLDMMDEEEVEVSLPRFKLEESYDMESVLRNLGMTDAFELGKADFSGMSQTDLSLSKVVHKSFVEVNEEGTEAAAATAAIMMMRCARFVPRFCADHPFLFFIQHSKTNGILFCGRFSSP

SEQ ID NO: 835228 - protein, 376 aa, Homo sapiens; identical to SEQ ID NO: 835204

SEQ ID NO: 835229 - protein, 380 aa, Homo sapiens; identical to SEQ ID NO: 835210

SEQ ID NO: 835230 - protein, 376 aa, Homo sapiens; identical to SEQ ID NO: 835204

SEQ ID NO: 835231 - protein, 287 aa, Homo sapiens
MANRLFGEKSCDFLSSFRDSCQKFYQAEMEELDFISAVEKSRKHINTWVAEKTEGKIAELLSPGSVDPLTRLVLVNAVYFRGNWDEQFDKENTEERLFKVSKNEEKPVQMMFKQSTFKKTYIGEIFTQILVLPYVGKELNMIIMLPDETTDLRTVEKELTYEKFVEWTRLDMMDEEEVEVSLPRFKLEESYDMESVLRNLGMTDAFELGKADFSGMSQTDLSLSKVVHKSFVEVNEEGTEAAAATAAIMMMRCARFVPRFCADHPFLFFIQHSKTNGILFCGRFSSP

SEQ ID NO: 835232 - protein, 332 aa, Homo sapiens
MSCPCKQNFLHILSFNKSGGGGDIHQGFQSLLTEVNKTGTQYLLRMANRLFGEKSCDFLSSFRDSCQKFYQAEMEELDFISAVEKSRKHINTWVAEKTEGKIAELLSPGSVDPLTRLVLVNAVYFRGNWDEQFDKENTEERLFKVSKNEEKPVQMMFKQSTFKKTYIGEIFTQILVLPYVGKELNMIIMLPDETTDLRTVEKELTYEKFVEWTRLDMMDEEEVEVSLPRFKLEESYDMESVLRNLGMTDAFELGKADFSGMSQTDLSLSKVVHKSFVEVNEEGTEAAAATAAIMMMRCARFVPRFCADHPFLFFIQHSKTNGILFCGRFSSP

SEQ ID NO: 835233 - protein, 177 aa, Homo sapiens; identical to SEQ ID NO: 835216

SEQ ID NO: 835234 - protein, 256 aa, Homo sapiens
MDVLAEANGTFALNLLKTLGKDNSKNVFFSPMSMSCALAMVYMGAKGNTAAQMAQFLSNKWRWWRLFKVSKNEEKPVQMMFKQSTFKKTYIGEIFTQILVLPYVGKELNMIIMLPDETTDLRTVEKELTYEKFVEWTRLDMMDEEEVEVSLPRFKLEESYDMESVLRNLGMTDAFELGKADFSGMSQTDLSLSKVVHKSFVEVNEEGTEAAAATAAIMMMRCARFVPRFCADHPFLFFIQHSKTNGILFCGRFSSP

SEQ ID NO: 835235 - protein, 283 aa, Homo sapiens; identical to SEQ ID NO: 835217

SEQ ID NO: 835236 - protein, 238 aa, Homo sapiens
MDVLAEANGTFALNLLKTLGKDNSKNVFFSPMSMSCALAMVYMGAKGNTAAQMAQILSFNKSGGGGDIHQGFQSLLTEVNKTGTQYLLRMANRLFGEKSCDFLSSFRDSCQKFYQAEMEELDFISAVEKSRKHINTWVAEKTEGKIAELLSPGSVDPLTRLVLVNAVYFRGNWDEQFDKENTEERLFKVSKNEEKPVQMMFKQSTFKKTTCLCPRSCTSLLWRSMRKARRLQPPQLPS

SEQ ID NO: 835237 - protein, 204 aa, Homo sapiens
MDVLAEANGTFALNLLKTLGKDNSKNVFFSPMSMSCALAMVYMGAKGNTAAQMAQILSFNKSGGGGDIHQGFQSLLTEVNKTGTQYLLRMANRLFGEKSCDFLSSFRDSCQKFYQAEMEELDFISAVEKSRKHINTWVAEKTEGKIAELLSPGSVDPLTRLVLVNAVYFRGNWDEQFDKENTEERLFKVSKTNGILFCGRFSSP

SEQ ID NO: 835238 - protein, 204 aa, Homo sapiens; identical to SEQ ID NO: 835237

SEQ ID NO: 835239 - protein, 300 aa, Homo sapiens [sequence omitted]

SEQ ID NO: 835240 - protein, 300 aa, Homo sapiens [sequence omitted]

SEQ ID NO: 835241 - protein, 300 aa, Homo sapiens [sequence omitted]

SEQ ID NO: 835242 - protein, 300 aa, Homo sapiens [sequence omitted]

SEQ ID NO: 835243 - protein, 300 aa, Homo sapiens [sequence omitted]

SEQ ID NO: 835244 - protein, 246 aa, Homo sapiens
MLHNASLLIDDIEDNSKLRRGFPVAHSIYGIPSVINSANYVYFLGLEKVLTLDHPDAVKLFTRQLLELHQGQGLDIYWRDNYTCPTEEEYKAMVLQKTGGLFGLAVGLMQLFSDYKEDLKPLLNTLGLFFQIRDDYANLHSKEYSENKSFCEDLTEGKFSFPTIHAIWSRPESTQVQNILRQRTENIDIKKYCVHYLEDVGSFEYTRNTLKELEAKAYKQIDARGGNPELVALVKHLSKMFKEENE

SEQ ID NO: 835245 - protein, 155 aa, Homo sapiens
ATRRQPPNHHTPTRGSLRPRHPRKPNHLHSSAASRPHCRDPTEFPVYDNDAISVREETHNKPGVRRRAGRSPLGPRRPAERIRAPTRRVRARGRPGATEGPGGPVGRGQDRPATEPLPTSRSGLRPDKWERDQHLAPPRGQREGRGPRRRNGPHP

SEQ ID NO: 835246 - protein, 300 aa, Homo sapiens [sequence omitted]

SEQ ID NO: 835247 - protein, 300 aa, Homo sapiens [sequence omitted]

SEQ ID NO: 835248 - protein, 300 aa, Homo sapiens [sequence omitted]

SEQ ID NO: 835249 - protein, 1901 aa, Homo sapiens
MATFRNNHMKTKASVRKSFSEDVFQSVKSLLQSQKELCSVTAEDCLQQDEHANLTEVTFLGFNEETDAAHIQDLAAVSLELPDILNSLHFCSLNENEIICMKNINKPLDISSDPLNQSHPSGMLCVMRVSPTSPRLRIDFIFSLLSKYATGIRYTLDTFLHQKHQLETTDEDDDDTNQSVSSIEDDFVTAFEHLEEEETSKPYNDGMNITVLRSQCDAASQTVTGHHLETHDLKILISSGQQKSLAKPSTSSVNVLGHKELPSVKTSVTTSISEPWTQRSFYRSSNASDKDSDLQKTFFSSSPAYSSESECSSPSPVIFLDEEGYQKSLKAKLELPKIPVMKDDIEDSDSEVSEFFDSFDQFDELEQTLETCLFNKDPVIGKSSQRKGHKHGKSCMNPQKFKFDRPALPANVRKPTPRKPESPYGNLCDAPDSPRPVKASREDSGLFSPIRSSAFSPLGGCTPAECFCQTDIGGDRIHENHDSVYYTYEDYAKSISCEVLGSVLRTHHTNTLSNINSIKHGENKTVTFKHGNLDQKNKSKNKSLMIKDSIQKFAADLVEKSFGSAFKDLQKGVSSCTNALYHLAIKLTSSVLQMAFDELRRQRAFSLKERAISGLANFLVSEALSNALKDLQYVKKQIFTNTVARFAADLAEELVFEGIMEVCQFSYPQTPASPQCGSFDFEDKVVKLYAKDLSESVIQEAFIELSQVDVTFTTKAAVSVSTDNIKYVSAESVVPSTQAVTFSPSFHNQAIMVTKPVQEYKKEYTVQQALFCTSGIVTSIPVPLAGSALLPYHISSTACQAKAHLSSDDSNSNGDSAQVHIATKNREEKAACLRNICLPSEHNPGNQNDFKPTNDDIEMQSSSKLPNDPAIISNFSAAVVHTIVNETLESMTSLEVTKMVDERTDYLTKSLKEKTPPFSHCDQAVLQCSEASSNKDMFADRLSKSIIKHSIDKSKSVIPNIDKNAVYKESLPVSGEESQLTPEKSPKFPDSQNQLTHCSLSAAKDCVPECKVSMVHGSSLETLPSCPAVTGQKSDLKESAKDQPLKKHNLNSTSLEALSFGQENPFPHSHTFSSTALTCVDGLHVEDKQKVRDRNVIPDTPPSTPLVPSRASSEWDIKKLTKKLKGELAKEFAPATPPSTPHNSSVGSLSENEQNTIEKEEFMLKLMRSLSEEVESSESGELPEVDVKSEHSGKKVQFAEALATHILSLATEMAASHLDNKIIQEPKVKNPCLNVQSQRSVSPTFLNPSDENLKTLCNFAGDLAAEVITEAEKIAKVRNCMLFKQKKNSCYADGDEDYKVEEKLDIEAVVHPREVDPFILSLPPSSCMSGLMYKYPSCESVTDEYAGHLIQILKQEGGNSELIMDQYANRLAYRSVKSGLQEAAKTTKVQCNSRMFPVPSSQVKTNKELLMFSNKEHHQEADKKRQSKRNEGYFCKNQTCERTLDPYRNEVSQLYSFSTSLVHSITKDAKEELTASLVGLPKSLTDSCLFEKSGYEEDNECHVTPELPKSLQPSSQNHRFYHSTGSLNGYGCGDNVVQAVEQYAKKVVDDTLELTLGSTVFRVSETTKSADRVTYAEKLSPLTGQACRYCDLKELHNCTGNSSQHFFRQGSLASSKPASNPKFSSRYQKSRIFHLSVPQIHVNLDKKAVLAEKIVAEAIEKAERELSSTSLAADSGIGQEGASFAESLATETMTAAVTNVGHAVSSSKEIEDFQSTESVSSQQMNLSIGDDSTGSWSNLSFEDEHQDESSSFHHLSESNGNSSSWSSLGLEGDLYEDNLSFPTSDSDGPDDKDEEHEDEVEGLGQDGKTLLITNIDMEPCTVDPQLRIILQWLIASEAEVAELYFHDSANKEFMLLSKQLQEKGWKVGDLLQAVLQYYEVMEKASSEERCKSLFDWLLENA

SEQ ID NO: 835250 - protein, 1873 aa, Homo sapiens
MATFRNNHMKTKASVRKSFSEDVFQSVKSLLQSQKELCSVTAEDCLQQDEHANLTEVTFLGFNEETDAAHIQDLAAVSLELPDILNSLHFCSLNENEIICMKNINKPLDISSDPLNQSHPSGMLCVMRVSPTSPRLRIDFIFSLLSKYATGIRYTLDTFLHQKHQLETTDEDDDDTNQSVSSIEDDFVTAFEHLEEEETSKPYNDGMNITVLRSQCDAASQTVTGHHLETHDLKILISSGQQKSLAKPSTSSVNVLGHKELPSVKTSVTTSISEPWTQRSFYRSSNASDKDSDLQKTFFSSSPAYSSESECSSPSPVIFLDEEGYQKSLKAKLELPKIPVMKDDIEDSDSEVSEFFDSFDQFDELEQTLETCLFNKDPVIGKSSQRKGHKHGKSCMNPQKFKFDRPALPANVRKPTPRKPESPYGNLCDAPDSPRPVKASREDSGLFSPIRSSAFSPLGGCTPAECFCQTDIGGDRIHENHDSVYYTYEDYAKSISCEVLGSVLRTHHTNTLSNINSIKHGENKTVTFKHGNLDQKNKSKNKSLMIKDSIQKFAADLVEKSFGSAFKDLQKGVSSCTNALYHLAIKLTSSVLQMAFDELRRQRAFSLKERAISGLANFLVSEALSNALKDLQYVKKQIFTNTVARFAADLAEELVFEGIMEVCQFSYPQTPASPQCGSFDFEDKVVKLYAKDLSESVIQEAFIELSQVDVTFTTKAAVSVSTDNIKYVSAESVVPSTQAVTFSPSFHNQAIMVTKPVQEYKKEYTVQQALFCTSGIVTSIPVPLAGSALLPYHISSTACQAKAHLSSDDSNSNGDSAQVHIATKNREEKAACLRNICLPSEHNPGNQNDFKPTNDDIEMQSSSKLPNDPAIISNFSAAVVHTIVNETLESMTSLEVTKMVDERTDYLTKSLKEKTPPFSHCDQAVLQCSEASSNKDMFADRLSKSIIKHSIDKSKSVIPNIDKNAVYKESLPVSGEESQLTPEKSPKFPDSQNQLTHCSLSAAKDCVPECKVSMVHGSSLETLPSCPAVTGQKSDLKESAKDQPLKKHNLNSTSLEALSFGQENPFPHSHTFSSTALTCVDGLHVEDKQKVRDRNVIPDTPPSTPLVPSRASSEWDIKKLTKKLKGELAKEFAPATPPSTPHNSSVGSLSENEQNTIEKEEFMLKLMRSLSEEVESSESGELPEVDVKSEHSGKKVQFAEALATHILSLATEMAASHLDNKIIQEPKVKNPCLNVQSQRSVSPTFLNPSDENLKTLCNFAGDLAAEVITEAEKIAKVRNCMLFKQKKNSCYADGDEDYKVEEKLDIEAVVHPREVDPFILSLPPSSCMSGLMYKYPSCESVTDEYAGHLIQILKQEGGNSELIMDQYANRLAYRSVKSGLQEAAKTTKVQCNSRMFPVPSSQVKTNKELLMFSNKEHHQEADKKRQSKRNEGYFCKNQTCERTLDPYRNEVSQLYSFSTSLVHSITKDAKEELTASLVGLPKSLTDSCLFEKSGYEEDNECHVTPELPKSLQPSSQNHRFYHSTGSLNGYGCGDNVVQAVEQYAKKVVDDTLELTLGSTVFRVSETTKSADRVTYAEKLSPLTGQACRYCDLKELHNCTGNSSQHFFRQGSLASSKPASNPKFSSRYQKSRIFHLSVPQIHVNLDKKAVLAEKIVAEAIEKAERELSSTSLAADSGIGQEGASFAESLATETMTAAVTNVGHAVSSSKEIEDFQSTESVSSQQMNLSIGDDSTGSWSNLSFEDEHQDESSSFHHLSESDGPDDKDEEHEDEVEGLGQDGKTLLITNIDMEPCTVDPQLRIILQWLIASEAEVAELYFHDSANKEFMLLSKQLQEKGWKVGDLLQAVLQYYEVMEKASSEERCKSLFDWLLENA

SEQ ID NO: 835251 - protein, 1448 aa, Homo sapiens
MATFRNNHMKTKASVRKSFSEDVFQSVKSLLQSQKELCSVTAEDCLQQDEHANLTEVTFLGFNEETDAAHIQDLAAVSLELPDILNSLHFCSLNENEIICMKNINKPLDISSDPLNQSHPSGMLCVMRVSPTSPRLRIDFIFSLLSKYATGIRYTLDTFLHQKHQLETTDEDDDDTNQSVSSIEDDFVTAFEHLEEEETSKPYNDGMNITVLRSQCDAASQTVTGHHLETHDLKILISSGQQKSLAKPSTSSVNVLGHKELPSVKTSVTTSISEPWTQRSFYRSSNASDKDSDLQKTFFSSSPAYSSESECSSPSPVIFLDEEGYQKSLKAKLELPKIPVMKDDIEDSDSEVSEFFDSFDQFDELEQTLETCLFNKDPVIGKSSQRKGHKHGKSCMNPQKFKFDRPALPANVRKPTPRKPESPYGNLCDAPDSPRPVKASREDSGLFSPIRSSAFSPLGGCTPAECFCQTDIGGDRIHENHDSVYYTYEDYAKSISCEVLGSVLRTHHTNTLSNINSIKHGENKTVTFKHGNLDQKNKSKNKSLMIKDSIQKFAADLVEKSFGSAFKDLQKGVSSCTNALYHLAIKLTSSVLQMAFDELRRQRAFSLKERAISGLANFLVSEALSNALKDLQYVKKQIFTNTVARFAADLAEELVFEGIMEVCQFSYPQTPASPQCGSFDFEDKVVKLYAKDLSESVIQEAFIELSQVDVTFTTKAAVSVSTDNIKYVSAESVVPSTQAVTFSPSFHNQAIMVTKPVQEYKKEYTVQQALFCTSGIVTSIPVPLAGSALLPYHISSTACQAKAHLSSDDSNSNGDSAQVHIATKNREEKAACLRNICLPSEHNPGNQNDFKPTNDDIEMQSSSKLPNDPAIISNFSAAVVHTIVNETLESMTSLEVTKMVDERTDYLTKSLKEKTPPFSHCDQAVLQCSEASSNKDMFADRLSKSIIKHSIDKSKSVIPNIDKNAVYKESLPVSGEESQLTPEKSPKFPDSQNQLTHCSLSAAKDCVPECKVSMVHGSSLETLPSCPAVTGQKSDLKESAKDQPLKKHNLNSTSLEALSFGQENPFPHSHTFSSTALTCVDGLHVEDKQKVRDRNVIPDTPPSTPLVPSRASSEWDIKKLTKKLKGELAKEFAPATPPSTPHNSSVGSLSENEQNTIEKEEFMLKLMRSLSEEVESSESGELPEVDVKSEHSGKKVQFAEALATHILSLATEMAASHLDNKIIQEPKVKNPCLNVQSQRSVSPTFLNPSDENLKTLCNFAGDLAAEVITEAEKIAKVRNCMLFKQKKNSCYADGDEDYKVEEKLDIEAVVHPREVDPFILSLPPSSCMSGLMYKYPSCESVTDEYAGHLIQILKQEGGNSELIMDQYANRLAYRSVKSGLQEAAKTTKVQCNSRMFPVPSSQVKTNKELLMFSNKEHHQEADKKRQSKRNEGYFCKNQTCERTLWTIS

SEQ ID NO: 835252 - protein, 538 aa, Homo sapiens
MATFRNNHMKTKASVRKSFSEDVFQSVKSLLQSQKELCSVTAEDCLQQDEHANLTEVTFLGFNEETDAAHIQDLAAVSLELPDILNSLHFCSLNENEIICMKNINKPLDISSDPLNQSHPSGMLCVMRVSPTSPRLRIDFIFSLLSKYATGIRYTLDTFLHQKHQLETTDEDDDDTNQSVSSIEDDFVTAFEHLEEEETSKPYNDGMNITVLRSQCDAASQTVTGHHLETHDLKILISSGQQKSLAKPSTSSVNVLGHKELPSVKTSVTTSISEPWTQRSFYRSSNASDKDSDLQKTFFSSSPAYSSESECSSPSPVIFLDEEGYQKSLKAKLELPKIPVMKDDIEDSDSEVSEFFDSFDQFDELEQTLETCLFNKDPVIGKSSQRKGHKHGKSCMNPQKFKFDRPALPANVRKPTPRKPESPYGNLCDAPDSPRPVKASREDSGLFSPIRSSAFSPLGGCTPAECFCQTDIGGDRIHENHDSVYYTYEDYAKSISCEVLGSVLRTHHTNTLSRFPCLKVTVLFYHVNTVILIGIGPA

SEQ ID NO: 835253 - protein, 1854 aa, Homo sapiens
MEVYLFFTQVTFLGFNEETDAAHIQDLAAVSLELPDILNSLHFCSLNENEIICMKNINKPLDISSDPLNQSHPSGMLCVMRVSPTSPRLRIDFIFSLLSKYATGIRYTLDTFLHQKHQLETTDEDDDDTNQSVSSIEDDFVTAFEHLEEEETSKPYNDGMNITVLRSQCDAASQTVTGHHLETHDLKILISSGQQKSLAKPSTSSVNVLGHKELPSVKTSVTTSISEPWTQRSFYRSSNASDKDSDLQKTFFSSSPAYSSESECSSPSPVIFLDEEGYQKSLKAKLELPKIPVMKDDIEDSDSEVSEFFDSFDQFDELEQTLETCLFNKDPVIGKSSQRKGHKHGKSCMNPQKFKFDRPALPANVRKPTPRKPESPYGNLCDAPDSPRPVKASREDSGLFSPIRSSAFSPLGGCTPAECFCQTDIGGDRIHENHDSVYYTYEDYAKSISCEVLGSVLRTHHTNTLSNINSIKHGENKTVTFKHGNLDQKNKSKNKSLMIKDSIQKFAADLVEKSFGSAFKDLQKGVSSCTNALYHLAIKLTSSVLQMAFDELRRQRAFSLKERAISGLANFLVSEALSNALKDLQYVKKQIFTNTVARFAADLAEELVFEGIMEVCQFSYPQTPASPQCGSFDFEDKVVKLYAKDLSESVIQEAFIELSQVDVTFTTKAAVSVSTDNIKYVSAESVVPSTQAVTFSPSFHNQAIMVTKPVQEYKKEYTVQQALFCTSGIVTSIPVPLAGSALLPYHISSTACQAKAHLSSDDSNSNGDSAQVHIATKNREEKAACLRNICLPSEHNPGNQNDFKPTNDDIEMQSSSKLPNDPAIISNFSAAVVHTIVNETLESMTSLEVTKMVDERTDYLTKSLKEKTPPFSHCDQAVLQCSEASSNKDMFADRLSKSIIKHSIDKSKSVIPNIDKNAVYKESLPVSGEESQLTPEKSPKFPDSQNQLTHCSLSAAKDCVPECKVSMVHGSSLETLPSCPAVTGQKSDLKESAKDQPLKKHNLNSTSLEALSFGQENPFPHSHTFSSTALTCVDGLHVEDKQKVRDRNVIPDTPPSTPLVPSRASSEWDIKKLTKKLKGELAKEFAPATPPSTPHNSSVGSLSENEQNTIEKEEFMLKLMRSLSEEVESSESGELPEVDVKSEHSGKKVQFAEALATHILSLATEMAASHLDNKIIQEPKVKNPCLNVQSQRSVSPTFLNPSDENLKTLCNFAGDLAAEVITEAEKIAKVRNCMLFKQKKNSCYADGDEDYKVEEKLDIEAVVHPREVDPFILSLPPSSCMSGLMYKYPSCESVTDEYAGHLIQILKQEGGNSELIMDQYANRLAYRSVKSGLQEAAKTTKVQCNSRMFPVPSSQVKTNKELLMFSNKEHHQEADKKRQSKRNEGYFCKNQTCERTLDPYRNEVSQLYSFSTSLVHSITKDAKEELTASLVGLPKSLTDSCLFEKSGYEEDNECHVTPELPKSLQPSSQNHRFYHSTGSLNGYGCGDNVVQAVEQYAKKVVDDTLELTLGSTVFRVSETTKSADRVTYAEKLSPLTGQACRYCDLKELHNCTGNSSQHFFRQGSLASSKPASNPKFSSRYQKSRIFHLSVPQIHVNLDKKAVLAEKIVAEAIEKAERELSSTSLAADSGIGQEGASFAESLATETMTAAVTNVGHAVSSSKEIEDFQSTESVSSQQMNLSIGDDSTGSWSNLSFEDEHQDESSSFHHLSESNGNSSSWSSLGLEGDLYEDNLSFPTSDSDGPDDKDEEHEDEVEGLGQDGKTLLITNIDMEPCTVDPQLRIILQWLIASEAEVAELYFHDSANKEFMLLSKQLQEKGWKVGDLLQAVLQYYEVMEKASSEERCKSLFDWLLENA

SEQ ID NO: 835254 - protein, 1873 aa, Homo sapiens; identical to SEQ ID NO: 835250

SEQ ID NO: 835255 - protein, 1448 aa, Homo sapiens; identical to SEQ ID NO: 835251

SEQ ID NO: 835256 - protein, 111 aa, Homo sapiens
KTCELLEGNPSLPGSPSTAFRQISTKAPCTETSLSYFKRQHYFTDKCSELSSLTCPQPNLYGLTILLRETVYACAGTHVEGKTGRPTLPQALASLQTVPFTLSLTGKYCLV

SEQ ID NO: 835257 - protein, 81 aa, Homo sapiens
LRKNLRGLLGEWVPQAYFDLRAFSSTEIKCRILVWDTERKTELQCLKGLSPTPATSALPPSPLLRRCGARSNPPGVLRALI

SEQ ID NO: 835258 - protein, 428 aa, Homo sapiens
MSYYLSSENHLDPGPIYMRENGQLHMVNLALDGVRSSLQKPRPFRLFPKGFSVELCMNREDDTARKEKTDHFIFTYTREGNLRYSAKSLFSLVLGFISDNVDHIDSLIGFPEQIAEKLFSAAEARQKFTEPGAGLRALQKFTEAYGSLVLCSLCLRNRYLVISEKLEEIKSFRELTCLDLSCCKLGDEHELLEHLTNEALSSVTQLHLKDNCLSDAGVRKMTAPVRVMKRGLENLTLLDLSCNPEITDAGIGYLFSFRKLNCLDISGTGLKDIKTVKHKLQTHIGLVHSKVPLKEFDHSNCKTEGWADQIVLQWERVTAEAVKPRETSEPRAAAQRFYGKRSRAEAPLKCPLADTHMNSSEKLQFYKEKAPDCHGPVLKHEAISSQESKKSKKRPFEESETEQNNSSQPSKQKYVCLAVEDWDLLNSY

SEQ ID NO: 835259 - protein, 428 aa, Homo sapiens; identical to SEQ ID NO: 835258

SEQ ID NO: 835260 - protein, 427 aa, Homo sapiens
MSYYLSSENHLDPGPIYMRENGQLHMVNLALDGVRSSLQKPRPFRLFPKGFSVELCMNREDDTARKEKTDHFIFTYTREGNLRYSAKSLFSLVLGFISDNVDHIDSLIGFPEQIAEKLFSAAEARQKFTEPGAGLRALQKFTEAYGSLVLCSLCLRNRYLVISEKLEEIKSFRELTCLDLSCCKLGDEHELLEHLTNEALSSVTQLHLKDNCLSDAGVRKMTAPVRVMKRGLENLTLLDLSCNPEITDAGIGYLFSFRKLNCLDISGTGLKDIKTVKHKLQTHIGLVHSKVPLKEFDHSNCKTEGWADQIVLQWERVTAEAVKPRETSEPRAAAQRFYGKRSRAEAPLKCPLADTHMNSSEKLQFYKEKAPDCHGPVLKHEAISSQESKKSKKRPFEESETEQNNSSQPSKQKYVCLAVEDWDFSSV

SEQ ID NO: 835261 - protein, 428 aa, Homo sapiens; identical to SEQ ID NO: 835258

SEQ ID NO: 835262 - protein, 491 aa, Homo sapiens
PRSHGAWLPPAPSLLPPSLCPTLPSFVPGVLSPSPSAGPREEGAVTEELPLAAPGRGTVATKAMSYYLSSENHLDPGPIYMRENGQLHMVNLALDGVRSSLQKPRPFRLFPKGFSVELCMNREDDTARKEKTDHFIFTYTREGNLRYSAKSLFSLVLGFISDNVDHIDSLIGFPEQIAEKLFSAAEARQKFTEPGAGLRALQKFTEAYGSLVLCSLCLRNRYLVISEKLEEIKSFRELTCLDLSCCKLGDEHELLEHLTNEALSSVTQLHLKDNCLSDAGVRKMTAPVRVMKRGLENLTLLDLSCNPEITDAGIGYLFSFRKLNCLDISGTGLKDIKTVKHKLQTHIGLVHSKVPLKEFDHSNCKTEGWADQIVLQWERVTAEAVKPRETSEPRAAAQRFYGKRSRAEAPLKCPLADTHMNSSEKLQFYKEKAPDCHGPVLKHEAISSQESKKSKKRPFEESETEQNNSSQPSKQKYVCLAVEDWDLLNSY

SEQ ID NO: 835263 - protein, 273 aa, Homo sapiens
MSYYLSSENHLDPGPIYMRENGQLHMVNLALDGVRSSLQKPRPFRLFPKGFSVELCMNREDDTARKEKTDHFIFTYTREGNLRYSAKSLFSLVLGFISDNVDHIDSLIGFPEQIAEKLFSAAEARQKFTEPGAGLRALQKFTEAYGSLVLCSLCLRNRYLVISEKLEEIKSFRELTCLDLSCCKLGDEHELLEHLTNEALSSVTQLHLKDNCLSDAGVRKMTAPVRVMKRGLENLTLLDLSCNPEITDAGIGYLFSFRKLNCLDISGTGLKCL

SEQ ID NO: 835264 - protein, 113 aa, Homo sapiens
MPWTCSVSDPTSCDSQAQKMPGVRASRQPGRGRQCLLLLHQVQGIWLKACIFPGHKLPEPLKWEARQFQTNLFSTHHSTFKVCLLLLPVHPPSLQFFHSLTDVGRSLPLSRRR

SEQ ID NO: 835265 - protein, 60 aa, Homo sapiens
MCKDTLHFGLRIRGRPCAVVKHALCWHSRHRANDTHNCGHTAALRTEGGDPGDTGLSGVV

SEQ ID NO: 835266 - protein, 142 aa, Homo sapiens
MPWTCSVSDPTSCDSQAQKMPGVRASRQPGRGRQCLLLLHQVQGIWLKACIFPGHKLPEPLKWEARQFQTNLFSTHHSTFKVCLLLLPVHPPSLQFFHSLTSERVPGGSMVNKLTCMLQKKSKYKQTIHKKKRGAKKIPGGQ

SEQ ID NO: 835267 - protein, 34 aa, Homo sapiens
MCPSLSCPLLVGVGNRVDEVSCRIMNGQIIAGIQ

SEQ ID NO: 835268 - protein, 85 aa, Homo sapiens
MASDLDFSPPEVPEPTFLENLLRYGLFLGAIFQLICVLAIIVPIPKSHEAEAEPSEPRSAEVTRKPKAAVPSVNKRPKKETKKKR

SEQ ID NO: 835269 - protein, 130 aa, Homo sapiens
MEAIKKKMQMLKLDKENALDRAEQAEAEQKQAEERSKQLEDELAAMQKKLKGTEDELDKYSEALKDAQEKLELAEKKAADAEAEVASLNRRIQLVEEELDRAQERLATALQKLEEAEKAADESERGMNGY

SEQ ID NO: 835270 - protein, 360 aa, Homo sapiens
MAGITMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPSNATASRMCTPGCKPWPRHLLSTWMSWARGPAQGLGVVSRNTGACPQHPP

SEQ ID NO: 835271 - protein, 134 aa, Homo sapiens
TPTHIPKQHKLHDEAVRYMDEGTPSGGGRNRSASSSWVGTMAGITTIEAVKRKIQVLQQQADDAEERAERLQREVEGERRAREQAEAEVASLNRRIQLVEEELDRAQERLATALQKLEEAEKAADESERGMNGY

SEQ ID NO: 835272 - protein, 248 aa, Homo sapiens
MAGITTIEAVKRKIQVLQQQADDAEERAERLQREVEGERRAREQAEAEVASLNRRIQLVEEELDRAQERLATALQKLEEAEKAADESERGMKVIENRALKDEEKMELQEIQLKEAKHIAEEADRKYEEVARKLVIIEGDLERTEERAELAESRCREMDEQIRLMDQNLKCLSAAEEKYSQKEDKYEEEIKILTDKLKEAETRAEFAERSVAKLEKTIDDLEDKLKCTKEEHLCTQRMLDQTLLDLNEM

SEQ ID NO: 835273 - protein, 248 aa, Homo sapiens; identical to SEQ ID NO: 835272

SEQ ID NO: 835274 - protein, 248 aa, Homo sapiens; identical to SEQ ID NO: 835272

SEQ ID NO: 835275 - protein, 296 aa, Homo sapiens
MVIYCLRCLVGRDIPLNQGCLAPVRVVIPRGSILDPSPEAAVVGGNVLTSQRVVDVILGAFGACAASQVRGRGGRSSGADWVGRLEEEREGEVGTPCPSPAQRPGALTQGCMNNVTLGNAHMGYYETVAGGAGAGPSWHGRSGVHSHMTNTRITDPEILESRYPVILRRFELRRGSGGRGRFRGGDGVTRELLFREEALLSVLTERRAFRPYGLHGGEPGARGLNLLIRKNGRTVNLGGKTSVTVYPGDVFCLHTPGGGGYGDPEDPAPPPGSPPQALAFPEHGSVYEYRRAQKAV

SEQ ID NO: 835276 - protein, 248 aa, Homo sapiens; identical to SEQ ID NO: 835272

SEQ ID NO: 835277 - protein, 248 aa, Homo sapiens; identical to SEQ ID NO: 835272

SEQ ID NO: 835278 - protein, 424 aa, Homo sapiens
MTWKTLTAHLETLVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPSNATASRMCTPGCKPWPRHLLSTWMSWARGPAQGLGVVSRNTGACPQHPP

SEQ ID NO: 835279 - protein, 247 aa, Homo sapiens
MAGITTIEAVKRKIQVLQQQADDAEERAERLQREVEGERRAREQAEAEVASLNRRIQLVEEELDRAQERLATALQKLEEAEKAADESERGMKVIENRALKDEEKMELQEIQLKEAKHIAEEADRKYEEVARKLVIIEGDLERTEERAELAESRCREMDEQIRLMDQNLKCLSAAEEKYSQKEDKYEEEIKILTDKLKEAETRAEFAERSVAKLEKTIDDLEERLYSQLERNRLLSNELKLTLHDLCD

SEQ ID NO: 835280 - protein, 247 aa, Homo sapiens; identical to SEQ ID NO: 835279

SEQ ID NO: 835281 - protein, 198 aa, Homo sapiens
MTWKMVDPKYTGYIVEYKEEGKEEWEKGNDNEVRGTKLVVTGLKEGAFYKFRVRAVNIVALENLEEVTDVIEMKDRLCHLTFSEIASVQNIESVCPCLEEVIPNHVLMCLESLLQTVPLDHGMKDLNSKEDTIETQALVIPGIQEIGRGSIRGQSLLAKNVSRGKNEDHFVSRLDVHAHGNLSVYTNTVLDGMFPKMS

SEQ ID NO: 835282 - protein, 105 aa, Homo sapiens
MQRSELSASSEKLREKGGPGNRYGDGEAHEGGAGAGVSGKRNKVPFAVEHGPLKAGGLGDEVGISEDGWGSAPVGHQADEGETVLGRAGLTFEEIEPYGVWGVAF

SEQ ID NO: 835283 - protein, 296 aa, Homo sapiens
MVIYCLRCLVGRDIPLNQGCLAPVRVVIPRGSILDPSPEAAVVGGNVLTSQRVVDVILGAFGACAASQVRGRGGLQLGGGLGGQAGVGAGGRGGDALPQPSAATRCPHQGCMNNVTLGNAHMGYYETVAGGAGAGPSWHGRSGVHSHMTNTRITDPEILESRYPVILRRFELRRGSGGRGRFRGGDGVTRELLFREEALLSVLTERRAFRPYGLHGGEPGARGLNLLIRKNGRTVNLGGKTSVTVYPGDVFCLHTPGGGGYGDPEDPAPPPGSPPQALAFPEHGSVYEYRRAQKAV

SEQ ID NO: 835284 - protein, 121 aa, Homo sapiens
MVIRRSRGFTPSGGGRNRSASSSWVGTMAGITTIEAVKRKIQVLQQQADDAEERAERLQREVEGERRAREQAEAEVASLNRRIQLVEEELDRAQERLATALQKLEEAEKAADESERGMNGY

SEQ ID NO: 835285 - protein, 107 aa, Homo sapiens
MQRSELSASSEKLREKGGPGNRYGDGEAHEGGAGAGVSGKRNKVPFAVEHGPLKAGGLGDEVGISEDVAEAEVASLNRRIQLVEEELDRLEEAEKAADESERGMNGY

SEQ ID NO: 835286 - protein, 66 aa, Homo sapiens
LHPVATRPRLATSPRLATSPRLAEEILSRKKITYEEEIKILTDKLKEAETRAEFAERSVAKLGKDN

SEQ ID NO: 835287 - protein, 360 aa, Homo sapiens; identical to SEQ ID NO: 835270

SEQ ID NO: 835288 - protein, 248 aa, Homo sapiens; identical to SEQ ID NO: 835272

SEQ ID NO: 835289 - protein, 248 aa, Homo sapiens; identical to SEQ ID NO: 835272

SEQ ID NO: 835290 - protein, 248 aa, Homo sapiens; identical to SEQ ID NO: 835272

SEQ ID NO: 835291 - protein, 248 aa, Homo sapiens; identical to SEQ ID NO: 835272

SEQ ID NO: 835292 - protein, 248 aa, Homo sapiens; identical to SEQ ID NO: 835272

SEQ ID NO: 835293 - protein, 179 aa, Homo sapiens
GRVGRPTRPSEENDQTFSEKPASSTEENCLEFQESFKHIDSEFEENTNLKNTLKNLNVCESQSLDSGSCSALQNEFVSEKLPKQRLNAEKAKLVKQVQEKEDLLRRLKLVKMYRSKNDLSQLQLLIKKWRSCSQLLLYELQSAVSEENKKLSLTQLIDHYGLDDKLLHYNRSEEEFIDV

SEQ ID NO: 835294 - protein, 249 aa, Homo sapiens
LSLGMAEGEKNQDFTFKMESPSDSAVVLPSTPQASANPSSPYTNSSRKQPMSATLRERLRKTRFSFNSSYNVVKRLKVESEENDQTFSEKPASSTEENCLEFQESFKHIDSEFEENTNLKNTLKNLNVCESQSLDSGSCSALQNEFVSEKLPKQRLNAEKAKLVKQVQEKEDLLRRLKLVKMYRSKNDLSQLQLLIKKWRSCSQLLLYELQSAVSEENKKLSLTQLIDHYGLDDKLLHYNRSEEEFIDV

SEQ ID NO: 835295 - protein, 273 aa, Homo sapiens
SGASRVRQSGQLRIFSAYRTAPPLPQDRFTAAEKNQDFTFKMESPSDSAVVLPSTPQASANPSSPYTNSSRKQPMSATLRERLRKTRFSFNSSYNVVKRLKVESEENDQTFSEKPASSTEENCLEFQESFKHIDSEFEENTNLKNTLKNLNVCESQSLDSGSCSALQNEFVSEKLPKQRLNAEKAKLVKQVQEKEDLLRRLKLVKMYRSKNDLSQLQLLIKKWRSCSQLLLYELQSAVSEENKKLSLTQLIDHYGLDDKLLHYNRSEEEFIDV

SEQ ID NO: 835296 - protein, 119 aa, Homo sapiens
AAPRASGNLANCASFPPTARPRPCHRIDLRPQRKTKISLSRWKVRQTQLWFYLALLRPPASASRVAEITGARHHARLIFAFLVETGFHHVGQAGLELLTSGDPPPRPPKTIRAQRKVSQ

SEQ ID NO: 835297 - protein, 705 aa, Homo sapiens
MTKFGFLRLSYEKQDTLLKLLILSMAAVLSFSTRLFAVLRFESVIHEFDPYFNYRTTRFLAEEGFYKFHNWFDDRAWYPLGRIIGGTIYPGLMITSAAIYHVLHFFHITIDIRNVCVFLAPLFSSFTTIVTYHLTKELKDAGAGLLAAAMIAVVPGYISRSVAGSYDNEGIAIFCMLLTYYMWIKAVKTGSICWAAKCALAYFYMVSSWGGYVFLINLIPLHVLVLMLTGRFSHRIYVAYCTVYCLGTILSMQISFVGFQPVLSSEHMAAFGVFGLCQIHAFVDYLRSKLNPQQFEVLFRSVISLVGFVLLTVGALLMLTGKISPWTGRFYSLLDPSYAKNNIPIIASVSEHQPTTWSSYYFDLQLLVFMFPVGLYYCFSNLSDARIFIIMYGVTSMYFSAVMVRLMLVLAPVMCILSGIGVSQVLSTYMKNLDISRPDKKSKKQQDSTYPIKNEVASGMILVMAFFLITYTFHSTWVTSEAYSSPSIVLSARGGDGSRIIFDDFREAYYWLRHNTPEDAKVMSWWDYGYQITAMANRTILVDNNTWNNTHISRVGQAMASTEEKAYEIMRELDVSYVLVIFGGLTGYSSDDINKFLWMVRIGGSTDTGKHIKENDYYTPTGEFRVDREGSPVLLNCLMYKMCYYRFGQVYTEAKRPPGFDRVRNAEIGNKDFELDVLEEAYTTEHWLVRIYKVKDLDNRGLSRT

SEQ ID NO: 835298 - protein, 191 aa, Homo sapiens
MTKFGFLRLSYEKQDTLLKLLILSMAAVLSFSTRLFAVLRFESVIHEFDPYFNYRTTRFLTEVKPSVRFNLRTSKDPEHEGCYLSVGHSQPLEDCSFNMTAKTFFIIHGWTMSGIFENWLHKLVSALHTREKDANVVVDWLPLAHQLYTDAVNNTRVVGHSIARMLLGCKEKGRFFSPGNVHFSGKSPEAQ

SEQ ID NO: 835299 - protein, 705 aa, Homo sapiens; identical to SEQ ID NO: 835297

SEQ ID NO: 835300 - protein, 524 aa, Homo sapiens
MWIKAVKTGSICWAAKCALAYFYMVSSWGGYVFLINLIPLHVLVLMLTGRFSHRIYVAYCTVYCLGTILSMQISFVGFQPVLSSEHMAAFGVFGLCQIHAFVDYLRSKLNPQQFEVLFRSVISLVGFVLLTVGALLMLTGKISPWTGRFYSLLDPSYAKNNIPIIASVSEHQPTTWSSYYFDLQLLVFMFPVGLYYCFSNLSDARIFIIMYGVTSMYFSAVMVRLMLVLAPVMCILSGIGVSQVLSTYMKNLDISRPDKKSKKQQDSTYPIKNEVASGMILVMAFFLITYTFHSTWVTSEAYSSPSIVLSARGGDGSRIIFDDFREAYYWLRHNTPEDAKVMSWWDYGYQITAMANRTILVDNNTWNNTHISRVGQAMASTEEKAYEIMRELDVSYVLVIFGGLTGYSSDDINKFLWMVRIGGSTDTGKHIKENDYYTPTGEFRVDREGSPVLLNCLMYKMCYYRFGQVYTEAKRPPGFDRVRNAEIGNKDFELDVLEEAYTTEHWLVRIYKVKDLDNRGLSRT

SEQ ID NO: 835301 - protein, 365 aa, Homo sapiens [sequence omitted]

SEQ ID NO: 835302 - protein, 334 aa, Homo sapiens [sequence omitted]

SEQ ID NO: 835303 - protein, 740 aa, Homo sapiens
AVWETRGRVAGDATACRAQLRRAADRRVLPPIHVKMTKFGFLRLSYEKQDTLLKLLILSMAAVLSFSTRLFAVLRFESVIHEFDPYFNYRTTRFLAEEGFYKFHNWFDDRAWYPLGRIIGGTIYPGLMITSAAIYHVLHFFHITIDIRNVCVFLAPLFSSFTTIVTYHLTKELKDAGAGLLAAAMIAVVPGYISRSVAGSYDNEGIAIFCMLLTYYMWIKAVKTGSICWAAKCALAYFYMVSSWGGYVFLINLIPLHVLVLMLTGRFSHRIYVAYCTVYCLGTILSMQISFVGFQPVLSSEHMAAFGVFGLCQIHAFVDYLRSKLNPQQFEVLFRSVISLVGFVLLTVGALLMLTGKISPWTGRFYSLLDPSYAKNNIPIIASVSEHQPTTWSSYYFDLQLLVFMFPVGLYYCFSNLSDARIFIIMYGVTSMYFSAVMVRLMLVLAPVMCILSGIGVSQVLSTYMKNLDISRPDKKSKKQQDSTYPIKNEVASGMILVMAFFLITYTFHSTWVTSEAYSSPSIVLSARGGDGSRIIFDDFREAYYWLRHNTPEDAKVMSWWDYGYQITAMANRTILVDNNTWNNTHISRVGQAMASTEEKAYEIMRELDVSYVLVIFGGLTGYSSDDINKFLWMVRIGGSTDTGKHIKENDYYTPTGEFRVDREGSPVLLNCLMYKMCYYRFGQVYTEAKRPPGFDRVRNAEIGNKDFELDVLEEAYTTEHWLVRIYKVKDLDNRGLSRT

SEQ ID NO: 835304 - protein, 705 aa, Homo sapiens; identical to SEQ ID NO: 835297

SEQ ID NO: 835305 - protein, 705 aa, Homo sapiens; identical to SEQ ID NO: 835297

SEQ ID NO: 835306 - protein, 205 aa, Homo sapiens
MTKFGFLRLSYEKQDTLLKLLILSMAAVLSFSTRLFAVLRFESVIHEFDPYFNYRTTRFLAEEGFYKFHNWFDDRAWYPLGRIIGGTIYPGLMITSAAIYHVLHFFHITIDIRNVCVFLAPLFSSFTTIVTYHLTKELKDAGAGLLAAAMIAVVPGYISRSVAGSYDNEGIAIFCMLLTYYMWIKAVKTGSICWAALALDLSPST

SEQ ID NO: 835307 - protein, 66 aa, Homo sapiens
ITHTVLKMQCQLFRTETSKAVSELNYDYICIKAGTGRPQGTPTIGLVLLVRWAIIYETELQSQPIT

SEQ ID NO: 835308 - protein, 66 aa, Homo sapiens; identical to SEQ ID NO: 835307

SEQ ID NO: 835309 - protein, 66 aa, Homo sapiens; identical to SEQ ID NO: 835307

SEQ ID NO: 835310 - protein, 110 aa, Homo sapiens
HINLLIWNHFASKGQRKITASLSEGKRTGDLGKTQLHLEQGLFPAWQSQLCRRYGTRAVPETKGQARQQTPEVIFIFLFIFSRIMQTESDKHKVAEATRYASILFYIFLF

SEQ ID NO: 835311 - protein, 60 aa, Homo sapiens
MALPQGLLTFRDVAIEFSQEEWKCLDPAQRTLYRDVMLENYRNLVSLELSGECPLAAPAS

SEQ ID NO: 835312 - protein, 120 aa, Homo sapiens
IAWSDGATAAHGVSLLLLRLECNGVISAHCNLRLPGSSDSPASASRVAEITEYCPGCECSLMILGHCNLCFLGSSDSCASASHVAEITGLTSKDSWYVRKKPGRGRGEQRSQGWLFLRVY

SEQ ID NO: 835313 - protein, 120 aa, Homo sapiens; identical to SEQ ID NO: 835312

SEQ ID NO: 835314 - protein, 135 aa, Homo sapiens
MKSSLGSGSGTALGGAVLPPSAWLGSAGSRASVTLLLSPQLTPGGKAAQAGVAVGDWVLSIDGENAGSLTHIEAQNKIRACGERLSLGLSRAQPVQSKPQKVQSLRPRRGPSAVHLCTQRLPQQDGPALWGAPAR

SEQ ID NO: 835315 - protein, 330 aa, Homo sapiens
MAPDKQQPLRPLVPDASKQRLMENTEDWRPRPGTGQSRSFRILAHLTGTEFMQDPDEEHLKKSSQVPRTEAPAPASSTPQEPWPGPTAPSPTSRPPWAVDPAFAERYAPDKTSTVLTRHSQPATPTPLQSRTSIVQAAAGGVPGGGSNNGKTPVCHQCHKVIRGRYLVALGHAYHPEEFVCSQCGKVLEEGGFFEEKGAIFCPPCYDVRYAPSCAKCKKKITGEIMHALKMTWHVHCFTCAACKTPIRNRAFYMEEGVPYCERDYEKMFGTKCHGCDFKIDAGDRFLEALGFSWHDTCFVCAICQINLEGKTFYSKKDRPLCKSHAFSHV

SEQ ID NO: 835316 - protein, 330 aa, Homo sapiens; identical to SEQ ID NO: 835315

SEQ ID NO: 835317 - protein, 165 aa, Homo sapiens
MREEQRRTREPRESTGRTRQRSPRPLRRRRRTPGGARHGQRHRERRRPARTAESRSARDSEQTSDENTPTGRRGGEERAHEQRPAQTKHRHKQEHKRRRRTEAMERAGLRPTEEAAHTRRTRTHTPRDEAEHTSPEQQTTTASKRQQTRTGEHTTATRAETHATD

SEQ ID NO: 835318 - protein, 165 aa, Homo sapiens; identical to SEQ ID NO: 835317

SEQ ID NO: 835319 - protein, 182 aa, Homo sapiens
FFLSRAENVYSMPKAAQTWQTAVPQGKEGGRPIPTRLPGARRRAAPWPGQAGAGIMDSFKVVLEGPAPWGFRLQGGKDFNVPLSISRLTPGGKAAQAGVAVGDWVLSIDGENAGSLTHIEAQNKIRACGERLSLGLSRAQPVQSKPQKVQSLRPRRGPSAVHLCTQRLPQQDGPALWGAPAR

SEQ ID NO: 835320 - protein, 182 aa, Homo sapiens; identical to SEQ ID NO: 835319

SEQ ID NO: 835321 - protein, 330 aa, Homo sapiens; identical to SEQ ID NO: 835315

SEQ ID NO: 835322 - protein, 309 aa, Homo sapiens
MENTEDWRPRPGTGQSRSFRILAHLTGTEFMQDPDEEHLKKSSQVPRTEAPAPASSTPQEPWPGPTAPSPTSRPPWAVDPAFAERYAPDKTSTVLTRHSQPATPTPLQSRTSIVQAAAGGVPGGGSNNGKTPVCHQCHKVIRGRYLVALGHAYHPEEFVCSQCGKVLEEGGFFEEKGAIFCPPCYDVRYAPSCAKCKKKITGEIMHALKMTWHVHCFTCAACKTPIRNRAFYMEEGVPYCERDYEKMFGTKCHGCDFKIDAGDRFLEALGFSWHDTCFVCAICQINLEGKTFYSKKDRPLCKSHAFSHV

SEQ ID NO: 835323 - protein, 309 aa, Homo sapiens; identical to SEQ ID NO: 835322

SEQ ID NO: 835324 - protein, 182 aa, Homo sapiens; identical to SEQ ID NO: 835319

SEQ ID NO: 835325 - protein, 182 aa, Homo sapiens; identical to SEQ ID NO: 835319

SEQ ID NO: 835326 - protein, 165 aa, Homo sapiens; identical to SEQ ID NO: 835317

SEQ ID NO: 835327 - protein, 244 aa, Homo sapiens
FFLSRAENVYSMPKAAQTWQTAVPQGKEGGRPIPTRLPGARRRAAPWPGQAGAGIMDSFKVVLEGPAPWGFRLQGGKDFNVPLSISRLTPGGKAAQAGVAVGDWVLSIDGENAGSLTHIEAQNKIRACGERLSLGLSRAQPVQSKPQKVQTPDKQQPLRPLVPDASKQRLMENTEDWRPRPGTGQSRSFRILAHLTGTEFMQDPDEEHLKKSREKYVLELQSPRYTRLRDWHHQRSAHVLNVQS

SEQ ID NO: 835328 - protein, 146 aa, Homo sapiens
FFLSRAENVYSMPKAAQTWQTAVPQGKEGGRPIPTRLPGARRRAAPWPGQAGAGIMDSFKVVLEGPAPWGFRLQGGKDFNVPLSISRLTPGGKAAQAGVAVGDWVLSIDGENAGSLTHIEAQNKIRPAAEWVQTPVTHSRSDRWSQ

SEQ ID NO: 835329 - protein, 330 aa, Homo sapiens; identical to SEQ ID NO: 835315

SEQ ID NO: 835330 - protein, 479 aa, Homo sapiens
FFLSRAENVYSMPKAAQTWQTAVPQGKEGGRPIPTRLPGARRRAAPWPGQAGAGIMDSFKVVLEGPAPWGFRLQGGKDFNVPLSISRLTPGGKAAQAGVAVGDWVLSIDGENAGSLTHIEAQNKIRACGERLSLGLSRAQPVQSKPQKVQTPDKQQPLRPLVPDASKQRLMENTEDWRPRPGTGQSRSFRILAHLTGTEFMQDPDEEHLKKSSQVPRTEAPAPASSTPQEPWPGPTAPSPTSRPPWAVDPAFAERYAPDKTSTVLTRHSQPATPTPLQSRTSIVQAAAGGVPGGGSNNGKTPVCHQCHKVIRGRYLVALGHAYHPEEFVCSQCGKVLEEGGFFEEKGAIFCPPCYDVRYAPSCAKCKKKITGEIMHALKMTWHVHCFTCAACKTPIRNRAFYMEEGVPYCERDYEKMFGTKCHGCDFKIDAGDRFLEALGFSWHDTCFVCAICQINLEGKTFYSKKDRPLCKSHAFSHV

SEQ ID NO: 835331 - protein, 330 aa, Homo sapiens; identical to SEQ ID NO: 835315

SEQ ID NO: 835332 - protein, 330 aa, Homo sapiens; identical to SEQ ID NO: 835315

SEQ ID NO: 835333 - protein, 542 aa, Homo sapiens
FFLSRAENVYSMPKAAQTWQTAVPQGKEGGRPIPTRLPGARRRAAPWPGQAGAGIMDSFKVVLEGPAPWGFRLQGGKDFNVPLSISRLTPGGKAAQAGVAVGDWVLSIDGENAGSLTHIEAQNKIRACGERLSLGLSRAQPVQSKPQKVQSAPLPPRPPPYPALPALPGCVSAQPPPPPRTLRGTPLHPASPSTRRPGPLGRPRPLTAPRSRMAPDKQQPLRPLVPDASKQRLMENTEDWRPRPGTGQSRSFRILAHLTGTEFMQDPDEEHLKKSSQVPRTEAPAPASSTPQEPWPGPTAPSPTSRPPWAVDPAFAERYAPDKTSTVLTRHSQPATPTPLQSRTSIVQAAAGGVPGGGSNNGKTPVCHQCHKVIRGRYLVALGHAYHPEEFVCSQCGKVLEEGGFFEEKGAIFCPPCYDVRYAPSCAKCKKKITGEIMHALKMTWHVHCFTCAACKTPIRNRAFYMEEGVPYCERDYEKMFGTKCHGCDFKIDAGDRFLEALGFSWHDTCFVCAICQINLEGKTFYSKKDRPLCKSHAFSHV

SEQ ID NO: 835334 - protein, 182 aa, Homo sapiens; identical to SEQ ID NO: 835319

SEQ ID NO: 835335 - protein, 182 aa, Homo sapiens; identical to SEQ ID NO: 835319

SEQ ID NO: 835336 - protein, 165 aa, Homo sapiens; identical to SEQ ID NO: 835317

SEQ ID NO: 835337 - protein, 165 aa, Homo sapiens; identical to SEQ ID NO: 835317

SEQ ID NO: 835338 - protein, 59 aa, Homo sapiens
TEDWRPRPGTGQSRSFRILAHLTGTEFSKCQPRAGGTFLAPSPGVIPDPVSFLVNACLC

SEQ ID NO: 835339 - protein, 116 aa, Homo sapiens
RLPSRLPGAKRDGDGGSRPSPRGRAGMRTPTRPVQALRLPEAEGESGPAWAAAPEEAEVARQEEGKELLVVGRAAAARGEPAATNEELFHLLQDFQLQQAGSHGELLLKRDPFGGI

SEQ ID NO: 835340 - protein, 147 aa, Homo sapiens
RLPSRLPGAKRDGDGGSRPSPRGRAGMRTPTRPVQALRLPEAEGESGPAWAAAPEEAEVARQEEGKELLVVGRAAAARGEPAATNEELFHLLQDFQLQQAVSILEALLCQSISHLSVTATVFSWRTVIEERSIWWDIIKKNESKENL

SEQ ID NO: 835341 - protein, 116 aa, Homo sapiens; identical to SEQ ID NO: 835339

SEQ ID NO: 835342 - protein, 116 aa, Homo sapiens; identical to SEQ ID NO: 835339

SEQ ID NO: 835343 - protein, 156 aa, Homo sapiens
RLPSRLPGAKRDGDGGSRPSPRGRAGMRTPTRPVQALRLPEAEGESGPAWAAAPEEAEVARQEEGKELLVVGRAAAARGEPAATNEELFHLLQDFQLQQADAVPLPGTPSPYLPGKHLFTPLDNSVITSWRDTFPDFPRRFPSPCSAGTPLILLPL

SEQ ID NO: 835344 - protein, 116 aa, Homo sapiens; identical to SEQ ID NO: 835339

SEQ ID NO: 835345 - protein, 107 aa, Homo sapiens
MCFQIDRKRNPNIPKPRRILRSAWGSNPYFRGSYSYTQVGSSGADVEKLAKPLPYTESSKTAPMQVLFSGEATHRKYYSTTHGALLSGQREAARLIEMYRDLFQQGT

SEQ ID NO: 835346 - protein, 132 aa, Homo sapiens
KVDSQGFRWALVMEKCDDEAVAEICTEMLRQFTGNPNIPKPRRILRSAWGSNPYFRGSYSYTQVGSSGADVEKLAKPLPYTESSKTAPMQVLFSGEATHRKYYSTTHGALLSGQREAARLIEMYRDLFQQGT

SEQ ID NO: 835347 - protein, 126 aa, Homo sapiens
GSSSLRLQGLLASRLPAGRARGGARRVPAQRRSGGPGRSGVGRGREAERGPTQAAAAGSGPYGPGGGWRRKPGGWRRRRDGGGRDRSAARRRLTSPAQQGKVRCARSPAPGPGSQPPPGAGRGCGR

SEQ ID NO: 835348 - protein, 555 aa, Homo sapiens
MQSCESSGDSADDPLSRGLRRRGQPRVVVIGAGLAGLAAAKALLEQGFTDVTVLEASSHIGGRVQSVKLGHATFELGATWIHGSHGNPIYHLAEANGLLEETTDGERSVGRISLYSKNGVACYLTNHGRRIPKDVVEEFSDLYNEVYNLTQEFFRHDKPVNAESQNSVGVFTREEVRNRIRNDPDDPEATKRLKLAMIQQYLKVESCESSSHSMDEVSLSAFGEWTEIPGAHHIIPSGFMRVVELLAEGIPAHVIQLGKPVRCIHWDQASARPRGPEIEPRGEGDHNHDTGEGGQGGEEPRGGRWDEDEQWSVVVECEDCELIPADHVIVTVSLGVLKRQYTSFFRPGLPTEKVAAIHRLGIGTTDKIFLEFEEPFWGPECNSLQFVWEDEAESHTLTYPPELWYRKICGFDVLYPPERYGHVLSGWICGEEALVMEKCDDEAVAEICTEMLRQFTGNPNIPKPRRILRSAWGSNPYFRGSYSYTQVGSSGADVEKLAKPLPYTESSKTAPMQVLFSGEATHRKYYSTTHGALLSGQREAARLIEMYRDLFQQGT

SEQ ID NO: 835349 - protein, 585 aa, Homo sapiens
MQSCESSGDSADDPLSRGLRRRGQPRVVVIGAGLAGLAAAKALLEQGFTDVTVLEASSHIGGRVQSVKLGHATFELGATWIHGSHGNPIYHLAEANGLLEETTDGERSVGRISLYSKNGVACYLTNHGRRIPKDVVEEFSDLYNEVYNLTQEFFRHDKPVNAESQNSVGVFTREEVRNRIRNDPDDPEATKRLKLAMIQQYLKVESCESSSHSMDEVSLSAFGEWTEIPGAHHIIPSGFMRVVELLAEGIPAHVIQLGKPVRCIHWDQASARPRGPEIEPRGEGDHNHDTGEGGQGGEEPRGGRWDEDEQWSVVVECEDCELIPADHVIVTVSLGVLKRQYTSFFRPGLPTEKVAAIHRLGIGTTDKIFLEFEEPFWGPECNSLQFVWEDEAESHTLTYPPELWYRKICGFDVLYPPERYGHVLSGWICGEEALVMEKCDDEAVAEICTEMLRQFTGNPNIPKPRRILRSAWGSNPYFRGSYSYTQVGSSGADVEKLAKPLPYTESSKTAHGSSTKQQPGHLFSSKCPEQPLDANRGAVKPMQVLFSGEATHRKYYSTTHGALLSGQREAARLIEMYRDLFQQGT

SEQ ID NO: 835350 - protein, 555 aa, Homo sapiens; identical to SEQ ID NO: 835348

SEQ ID NO: 835351 - protein, 536 aa, Homo sapiens
MQSCESSGDSADDPLSRGLRRRGQPRVVVIGAGLAGLAAAKALLEQGFTDVTVLEASSHIGGRVQSVKLGHATFELGATWIHGSHGNPIYHLAEANGLLEETTDGERSVGRISLYSKNGVACYLTNHGRRIPKDVVEEFSDLYNEVYNLTQEFFRHDKPVNAESQNSVGVFTREEVRNRIRNDPDDPEATKRLKLAMIQQYLKVESCESSSHSMDEVSLSAFGEWTEIPGAHHIIPSGFMRVVELLAEGIPAHVIQLGKPVRCIHWDQASARPRGPEIEPRGEGDHNHDTGEGGQGGEEPRGGRWDEDEQWSVVVECEDCELIPADHVIVTVSLGVLKRQYTSFFRPGLPTEKVAAIHRLGIGTTDKIFLEFEEPFWGPECNSLQFVWEDEAESHTLTYPPELWYRKICGFDVLYPPERYGHVLSGWICGEEALVMEKCDDEAVAEICTEMLRQFTGNPNIPKPRRILRSAWGSNPYFRGSYSYTQVGSSGADVEKLAKPLPYTESSKTAHRGWWNSTCGGWPHRKTALAWALSLS

SEQ ID NO: 835352 - protein, 313 aa, Homo sapiens
MQSCESSGDSADDPLSRGLRRRGQPRVVVIGAGLAGLAAAKALLEQGFTDVTVLEASSHIGGRVQSVKLGHATFELGATWIHGSHGNPIYHLAEANGLLEETTDGERSVGRISLYSKNGVACYLTNHGRRIPKDVVEEFSDLYNEVYNLTQEFFRHDKPVNAESQNSVGVFTREEVRNRIRNDPDDPEATKRLKLAMIQQYLKVESCESSSHSMDEVSLSAFGEWTEIPGAHHIIPSGFMRVVELLAEGIPAHVIQLGKPVRCIHWDQASARPRGPEIEPRGEGDHNHGALLSGQREAARLIEMYRDLFQQGT

SEQ ID NO: 835353 - protein, 121 aa, Homo sapiens
MCFQIDRKSKVERFAGGQQEALRNPNIPKPRRILRSAWGSNPYFRGSYSYTQVGSSGADVEKLAKPLPYTESSKTAPMQVLFSGEATHRKYYSTTHGALLSGQREAARLIEMYRDLFQQGT

SEQ ID NO: 835354 - protein, 555 aa, Homo sapiens; identical to SEQ ID NO: 835348

SEQ ID NO: 835355 - protein, 555 aa, Homo sapiens; identical to SEQ ID NO: 835348

SEQ ID NO: 835356 - protein, 502 aa, Homo sapiens
MQSCESSGDSADDPLSRGLRRRGQPRVVVIGAGLAGLAAAKALLEQGFTDVTVLEASSHIGGRVQSVKLGHATFELGATWIHGSHGNPIYHLAEANGLLEETTDGERSVGRISLYSKNGVACYLTNHGRRIPKDVVEEFSDLYNEVYNLTQEFFRHDKPVNAESQNSVGVFTREEVRNRIRNDPDDPEATKRLKLAMIQQYLKVESCESSSHSMDEVSLSAFGEWTEIPGAHHIIPSGFMRVVELLAEGIPAHVIQLGKPVRCIHWDQASARPRGPEIEPRGVLKRQYTSFFRPGLPTEKVAAIHRLGIGTTDKIFLEFEEPFWGPECNSLQFVWEDEAESHTLTYPPELWYRKICGFDVLYPPERYGHVLSGWICGEEALVMEKCDDEAVAEICTEMLRQFTGNPNIPKPRRILRSAWGSNPYFRGSYSYTQVGSSGADVEKLAKPLPYTESSKTAPMQVLFSGEATHRKYYSTTHGALLSGQREAARLIEMYRDLFQQGT

SEQ ID NO: 835357 - protein, 555 aa, Homo sapiens; identical to SEQ ID NO: 835348

SEQ ID NO: 835358 - protein, 531 aa, Homo sapiens
MQSCESSGDSADDPLSRGLRRRGQPRVVVIGAGLAGLAAAKALLEQGFTDVTVLEASSHIGGRVQSVKLGHATFELGATWIHGSHGNPIYHLAEANGLLEETTDGERSVGRISLYSKNGVACYLTNHGRRIPKDVVEEFSDLYNEVYNLTQEFFRHDKPVNAESQNSVGVFTREEVRNRIRNDPDDPEATKRLKLAMIQQYLKVESCESSSHSMDEVSLSAFGEWTEIPGAHHIIPSGFMRVVELLAEGIPAHVIQLGKPVRCIHWDQASARPRGPEIEPRGEGDHNHDTGEGGQGGEEPRGGRWDEDEQWSVVVECEDCELIPADHVIVTVSLGVLKRQYTSFFRPGLPTEKVAAIHRLGIGTTDKIFLEFEEPFWGPECNSLQFVWEDEAESHTLTYPPELWYRKICGFDVLYPPERYGHVLSGWICGEEALVMEKCDDEAVAEICTEMLRQFTGNPNIPKPRRILRSAWGSNPYFRGSYSYTQPMQVLFSGEATHRKYYSTTHGALLSGQREAARLIEMYRDLFQQGT

SEQ ID NO: 835359 - protein, 476 aa, Homo sapiens
MQSCESSGDSADDPLSRGLRRRGQPRVVVIGAGLAGLAAAKALLEQGFTDVTVLEASSHIGGRVQSVKLGHATFELGATWIHGSHGNPIYHLAEANGLLEETTDGERSVGRISLYSKNGVACYLTNHGRRIPKDVVEEFSDLYNEVYNLTQEFFRHDKPVNAESQNSVGVFTREEVRNRIRNDPDDPEATKRLKLAMIQQYLKVESCESSSHSMDEVSLSAFGEWTEIPGAHHIIPSGFMRVVELLAEGIPAHVIQLGKPVRCIHWDQASARPRGPEIEPRGEGDHNHDTGEGGQGGEEPRGGRWDEDEQWSVVVECEDCELIPADHVIVTVSLGVLKRQYTSFFRPGLPTEKVAAIHRLGIGTTDKIFLEFEEPFWGPECNSLQFVWEDEAESHTLTYPPELWYRKICGFDVLYPPERYGHVLSGWICGEEALVMEKCDDEAVAEICTEMLRQFTEVRHVPHDPLPPPCFFLTCP

SEQ ID NO: 835360 - protein, 132 aa, Homo sapiens; identical to SEQ ID NO: 835346

SEQ ID NO: 835361 - protein, 79 aa, Homo sapiens
WELPEYLTLGTAGVAPMALLSADGLHSFPSEAFLEGVLSSKALWSRLRTKGNQLNRAFHVTTKNDLAQTSRQASVEPGK

SEQ ID NO: 835362 - protein, 241 aa, Homo sapiens
PPHTTTTHHIAGETRLMAEGTLDYLHSEKNVVYRDLKLENLMLDKDGHIKITDFGLCKEGIKDGATMKTFCGTPEYLAPEVLEDNDYGRAVDWWGLGVVMYEMMCGRLPFYNQDHEKLFELILMEEIRFPRTLGPEAKSLLSGLLKKDPKQRLGGGSEDAKEIMQHRFFAGIVWQHVYEKKLSPPFKPQVTSETDTRYFDEEFTAQMITITPPDQDDSMECVDSERRPHFPQFSYSASGTA

SEQ ID NO: 835363 - protein, 167 aa, Homo sapiens
HLPPVQVLEDNDYGRAVDWWGLGVVMYEMMCGRLPFYNQDHEKLFELILMEEIRFPRTLGPEAKSLLSGLLKKDPKQRLGGGSEDAKEIMQHRFFAGIVWQHVYEKKRCGCSPHIHAHACSPHIHTHACTWHARQISHTLTLTSLLQSWYKEGLAAPTSAPGAQRLW

SEQ ID NO: 835364 - protein, 117 aa, Homo sapiens
ARGAAEHRALGTGHRAAAAREARPRAAPPPAAASSPAPPSAGPRGCGAAGAGGRGPARPALAPGRGGPRLWPGQLGSGSASLRGARERRGSLGHHERRGYCEGGLAAQTRGWFMLNV

SEQ ID NO: 835365 - protein, 480 aa, Homo sapiens [sequence omitted]

SEQ ID NO: 835366 - protein, 480 aa, Homo sapiens [sequence omitted]

SEQ ID NO: 835367 - protein, 471 aa, Homo sapiens
CSRGSSREYIKTWRPRYFLLKNDGTFIGYKERPQDVDQREAPLNNFSVAQCQLMKTERPRPNTFIIRCLQWTTVIERTFHVETPEEREEWTTAIQTVADGLKKQEEEEMDFRSGSPSDNSGAEEMEVSLAKPKHRVTMNEFEYLKLLGKGTFGKVILVKEKATGRYYAMKILKKEVIVAKDEVAHTLTENRVLQNSRHPFLTALKYSFQTHDRLCFVMEYANGGELFFHLSRERVFSEDRARFYGAEIVSALDYLHSEKNVVYRDLKLENLMLDKDGHIKITDFGLCKEGIKDGATMKTFCGTPEYLAPEVLEDNDYGRAVDWWGLGVVMYEMMCGRLPFYNQDHEKLFELILMEEIRFPRTLGPEAKSLLSGLLKKDPKQRLGGGSEDAKEIMQHRFFAGIVWQHVYEKKLSPPFKPQVTSETDTRYFDEEFTAQMITITPPDQDDSMECVDSERRPHFPQFSYSASGTA

SEQ ID NO: 835368 - protein, 451 aa, Homo sapiens
ASTGRGLIGRGRPQDVDQREAPLNNFSVAQCQLMKTERPRPNTFIIRCLQWTTVIERTFHVETPEEREEWTTAIQTVADGLKKQEEEEMDFRSGSPSDNSGAEEMEVSLAKPKHRVTMNEFEYLKLLGKGTFGKVILVKEKATGRYYAMKILKKEVIVAKDEVAHTLTENRVLQNSRHPFLTALKYSFQTHDRLCFVMEYANGGELFFHLSRERVFSEDRARFYGAEIVSALDYLHSEKNVVYRDLKLENLMLDKDGHIKITDFGLCKEGIKDGATMKTFCGTPEYLAPEVLEDNDYGRAVDWWGLGVVMYEMMCGRLPFYNQDHEKLFELILMEEIRFPRTLGPEAKSLLSGLLKKDPKQRLGGGSEDAKEIMQHRFFAGIVWQHVYEKKLSPPFKPQVTSETDTRYFDEEFTAQMITITPPDQDDSMECVDSERRPHFPQFSYSASGTA

SEQ ID NO: 835369 - protein, 480 aa, Homo sapiens [sequence omitted]

SEQ ID NO: 835370 - protein, 480 aa, Homo sapiens [sequence omitted]

SEQ ID NO: 835371 - protein, 505 aa, Homo sapiens
MSDVAIVKEGWLHKRGEYIKTWRPRYFLLKNDGTFIGYKERPQDVDQREAPLNNFSVAQCQLMKTERPRPNTFIIRCLQWTTVIERTFHVETPEEREEWTTAIQTVADGLKKQEEEEMDFRSGSPSDNSGAEEMEVSLAKPKHRVTMNEFEYLKLLGKGTFGKVILVKEKATGRYYAMKILKKEVIVAKDEVAHTLTENRVLQNSRHPFLTALKYSFQTHDRLCFVMEYANGGELFFHLSRERVFSEDRARFYGAEIVSALDYLHSEKNVVYRDLKVRWRAGRGAGPWGPGGTDLRPPFPKLENLMLDKDGHIKITDFGLCKEGIKDGATMKTFCGTPEYLAPEVLEDNDYGRAVDWWGLGVVMYEMMCGRLPFYNQDHEKLFELILMEEIRFPRTLGPEAKSLLSGLLKKDPKQRLGGGSEDAKEIMQHRFFAGIVWQHVYEKKLSPPFKPQVTSETDTRYFDEEFTAQMITITPPDQDDSMECVDSERRPHFPQFSYSASGTA

SEQ ID NO: 835372 - protein, 422 aa, Homo sapiens
MSDVAIVKEGWLHKRGEYIKTWRPRYFLLKNDGTFIGYKERPQDVDQREAPLNNFSVAQCQLMKTERPRPNTFIIRCLQWTTVIERTFHVETPEEREEWTTAIQTVADGLKKQEEEEMDFRSGSPSDNSGAEEMEVSLAKPKHRVTMNEFEYLKLLGKGTFGKVILVKEKATGRYYAMKILKKEVIVAKDEVAHTLTENRVLQNSRHPFLTALKYSFQTHDRLCFVMEYANGGELFFHLSRERVFSEDRARFYGAEIVSALDYLHSEKNVVYRDLKLENLMLDKDGHIKITDFGLCKEGIKDGATMKTFCGTPEYLAPEVLEDNDYGRAVDWWGLGVVMYEMMCGRLPFYNQDHEKLFELILMEEIRFPRTLGPEAKSLLSGLLKKDPKQRLGGGSEDAKEIMQHRFFAGIVWQHVYEKKGP

SEQ ID NO: 835373 - protein, 293 aa, Homo sapiens
DFPGPRALWWLVPSLCNAETRSEKPQPCRPWGQRPEPRLCLRLRLPQLFFHLSRERVFSEDRARFYGAEIVSALDYLHSEKNVVYRDLKLENLMLDKDGHIKITDFGLCKEGIKDGATMKTFCGTPEYLAPEVLEDNDYGRAVDWWGLGVVMYEMMCGRLPFYNQDHEKLFELILMEEIRFPRTLGPEAKSLLSGLLKKDPKQRLGGGSEDAKEIMQHRFFAGIVWQHVYEKKLSPPFKPQVTSETDTRYFDEEFTAQMITITPPDQDDSMECVDSERRPHFPQFSYSASGTA

SEQ ID NO: 835374 - protein, 480 aa, Homo sapiens [sequence omitted]

SEQ ID NO: 835375 - protein, 228 aa, Homo sapiens
MAHGSHSLFSPVRDRQPLKLAITTSCSPPPGRGSRVIRTSRQLCKEGIKDGATMKTFCGTPEYLAPEVLEDNDYGRAVDWWGLGVVMYEMMCGRLPFYNQDHEKLFELILMEEIRFPRTLGPEAKSLLSGLLKKDPKQRLGGGSEDAKEIMQHRFFAGIVWQHVYEKKLSPPFKPQVTSETDTRYFDEEFTAQMITITPPDQDDSMECVDSERRPHFPQFSYSASGTA

SEQ ID NO: 835376 - protein, 109 aa, Homo sapiens
MSDVAIVKEGWLHKRGEYIKTWRPRYFLLKNDGTFIGYKERPQDVDQREAPLNNFSVAQCQLMKTERPRPNTFIIRCLQWTTVIERTFHVETPEEREEWTTAIQSHVGD

SEQ ID NO: 835377 - protein, 466 aa, Homo sapiens
MSDVAIVKEGWLHKRGEYIKTWRPRYFLLKNDGTFIGYKERPQDVDQREAPLNNFSVAQCQLMKTERPRPNTFIIRCLQWTTVIERTFHVETPEEREEWTTAIQTVADGLKKQEEEEMDFRSGSPSDNSGAEEMEVSLAKPKHRVTMNEFEYLKLLGKGTFGKVILVKEKATGRYYAMKILKKEVIVAKDEVAHTLTENRVLQNSRHPFLTALKYSFQTHDRLCFVMEYANGGELFFHLSRERVFSEDRARFYGAEIVSALDYLHSEKNVVYRDLKLENLMLDKDGHIKITDFGLCKEGIKDGATMKTFCGTPEYLAPEVLEDNDYGRAVDWWGLGVVMYEMMCGRLPFYNQDHEKLFELILMEEIRFPRTLGPEAKSLLSGLLKKDPKQRLGGGSEDAKEIMQHRFFAGIVWQHVYEKKSPGYGWGGGGCGAGSGCGGGGMWLLWSRWCRMLHDWLLRGLYTTQL

SEQ ID NO: 835378 - protein, 423 aa, Homo sapiens
MSDVAIVKEGWLHKRGEYIKTWRPRYFLLKNDGTFIGYKERPQDVDQREAPLNNFSVAQCQLMKTERPRPNTFIIRCLQWTTVIERTFHVETPEEREEWTTAIQTVADGLKKQEEEEMDFRSGSPSDNSGAEEMEVSLAKPKHRVTMNEFEYLKLLGKGTFGKVILVKEKATGRYYAMKILKKEVIVAKDEVAHTLTENRVLQNSRHPFLTALKYSFQTHDRLCFVMEYANGGELFFHLSRERVFSEDRARFYGAEIVSALDYLHSEKNVVYRDLKLENLMLDKDGHIKITDFGLCKEGIKDGATMKTFCGTPEYLAPEVLEDNDYGRAVDWWGLGVVMYEMMCGRLPFYNQDHEKLFELILMEEIRFPRTLGPEAKSLLSGLLKKDPKQRLGGGSEDAKEIMQHRFFAGIVWQHVYEKKYRR

SEQ ID NO: 835379 - protein, 139 aa, Homo sapiens [sequence omitted]

SEQ ID NO: 835380 - protein, 331 aa, Homo sapiens
MSDVAIVKEGWLHKRGEYIKTWRPRYFLLKNDGTFIGYKERPQDVDQREAPLNNFSVAQCQLMKTERPRPNTFIIRCLQWTTVIERTFHVETPEEREEWTTAIQTVADGLKKQEEEEMDFRSGSPSDNSGAEEMEVSLAKPKHRVTMNEFEYLKLLGKGTFGKVILVKEKATGRYYAMKILKKEVIVAKDEVAHTLTENRVLQNSRHPFLTALKYSFQTHDRLCFVMEYANGGELFFHLSRERVFSEDRARFYGAEIVSALDYLHSEKNVVYRDLKLENLMLDKDGHIKITDFGSGRGHENFGATESGPRFGTRSSGGRGRGGKKIGPFNK

SEQ ID NO: 835381 - protein, 297 aa, Homo sapiens
MSDVAIVKEGWLHKRGEYIKTWRPRYFLLKNDGTFIGYKERPQDVDQREAPLNNFSVAQCQLMKTERPRPNTFIIRCLQWTTVIERTFHVETPEEREEWTTAIQTVADGLKKQEEEEMDFRSGSPSDNSGAEEMEVSLAKPKHRVTMNEFEYLKLLGKGTFGKVILVKEKATGRYYAMKILKKEVIVAKDEVAHTLTENRVLQNSRHPFLTALKYSFQTHDRLCFVMEYANGGELFFHLSRERVFSEDRARFYGAEIVSALDYLHSEKNVVYRDLKLENLMLDKDDHTTTKNSGRGR

SEQ ID NO: 835382 - protein, 213 aa, Homo sapiens
MSDVAIVKEGWLHKRGEYIKTWRPRYFLLKNDGTFIGYKERPQDVDQREAPLNNFSVAQCQLMKTERPRPNTFIIRCLQWTTVIERTFHVETPEEREEWTNTSKVTVVRVTAWYLDEEFIGHDGYYQFEQPTLELNKWTAIGRVWGQERRQATYYPLLVLRYSGRTASDRSLKWPDCVETLVWAVNRITRLVKEGNCGGIGVRRQLRVAPIGG

SEQ ID NO: 835383 - protein, 480 aa, Homo sapiens [sequence omitted]

SEQ ID NO: 835384 - protein, 200 aa, Homo sapiens
MHAEARCEKDDWSSLCKEGIKDGATMKTFCGTPEYLAPEVLEDNDYGRAVDWWGLGVVMYEMMCGRLPFYNQDHEKLFELILMEEIRFPRTLGPEAKSLLSGLLKKDPKQRLGGGSEDAKEIMQHRFFAGIVWQHVYEKKLSPPFKPQVTSETDTRYFDEEFTAQMITITPPDQDDSMECVDSERRPHFPQFSYSASGTA

SEQ ID NO: 835385 - protein, 480 aa, Homo sapiens [sequence omitted]

SEQ ID NO: 835386 - protein, 480 aa, Homo sapiens [sequence omitted]

SEQ ID NO: 835387 - protein, 600 aa, Homo sapiens
APVAIAGARAAAGACWGLAGLGLPPPGRLCRLAQTSSQPPVHGTPSPASSWPSPFSDTARGGSSERGAVVGRVCLPVDPGPFLSLALRNSSRTAPAPWDSGIPGTSVLAHPVPAWLPGEGLTGRVCVALTTRTSVGEYIKTWRPRYFLLKNDGTFIGYKERPQDVDQREAPLNNFSVAQCQLMKTERPRPNTFIIRCLQWTTVIERTFHVETPEEREEWTTAIQTVADGLKKQEEEEMDFRSGSPSDNSGAEEMEVSLAKPKHRVTMNEFEYLKLLGKGTFGKVILVKEKATGRYYAMKILKKEVIVAKDEVAHTLTENRVLQNSRHPFLTALKYSFQTHDRLCFVMEYANGGELFFHLSRERVFSEDRARFYGAEIVSALDYLHSEKNVVYRDLKLENLMLDKDGHIKITDFGLCKEGIKDGATMKTFCGTPEYLAPEVLEDNDYGRAVDWWGLGVVMYEMMCGRLPFYNQDHEKLFELILMEEIRFPRTLGPEAKSLLSGLLKKDPKQRLGGGSEDAKEIMQHRFFAGIVWQHVYEKKLSPPFKPQVTSETDTRYFDEEFTAQMITITPPDQDDSMECVDSERRPHFPQFSYSASGTA

SEQ ID NO: 835388 - protein, 480 aa, Homo sapiens [sequence omitted]

SEQ ID NO: 835389 - protein, 414 aa, Homo sapiens
TRGSRTRGIRCLQWTTVIERTFHVETPEEREEWTTAIQTVADGLKKQEEEEMDFRSGSPSDNSGAEEMEVSLAKPKHRVTMNEFEYLKLLGKGTFGKVILVKEKATGRYYAMKILKKEVIVAKDEVAHTLTENRVLQNSRHPFLTALKYSFQTHDRLCFVMEYANGGELFFHLSRERVFSEDRARFYGAEIVSALDYLHSEKNVVYRDLKLENLMLDKDGHIKITDFGLCKEGIKDGATMKTFCGTPEYLAPEVLEDNDYGRAVDWWGLGVVMYEMMCGRLPFYNQDHEKLFELILMEEIRFPRTLGPEAKSLLSGLLKKDPKQRLGGGSEDAKEIMQHRFFAGIVWQHVYEKKLSPPFKPQVTSETDTRYFDEEFTAQMITITPPDQDDSMECVDSERRPHFPQFSYSASGTA

SEQ ID NO: 835390 - protein, 480 aa, Homo sapiens [sequence omitted]

SEQ ID NO: 835391 - protein, 292 aa, Homo sapiens
MSPGFGYRRPRRSIENRLLQISRALKYSFQTHDRLCFVMEYANGGELFFHLSRERVFSEDRARFYGAEIVSALDYLHSEKNVVYRDLKLENLMLDKDGHIKITDFGLCKEGIKDGATMKTFCGTPEYLAPEVLEDNDYGRAVDWWGLGVVMYEMMCGRLPFYNQDHEKLFELILMEEIRFPRTLGPEAKSLLSGLLKKDPKQRLGGGSEDAKEIMQHRFFAGIVWQHVYEKKLSPPFKPQVTSETDTRYFDEEFTAQMITITPPDQDDSMECVDSERRPHFPQFSYSASGTA

SEQ ID NO: 835392 - protein, 484 aa, Homo sapiens
MSDVAIVKEGWLHKRGEYIKTWRPRYFLLKNDGTFIGYKERPQDVDQREAPLNNFSVAQCQLMKTERPRPNTFIIRCLQWTTVIERTFHVETPEEREEWTTAIQTVADGLKKQEEEEMDFRSGSPSDNSGAEEMEVSLAKPKHRVTMNEFEYLKLLGKGTFGKVILVKEKATGRYYAMKILKKEVIVAKDEVAHTLTENRVLQNSRHPFLTALKYSFQTHDRLCFVMEYANGGELFFHLSRERVFSEDRARFYGAEIVSALDYLHSEKNVVYRDLKLENLMLDKDGHIKITDFGLCKEGIKDGATMKTFCGTPEYLAPEVLEDNDYGRAVDWWGLGVVMYEMMCGRLPFYNQDHEKLFELILMEEIRFPRTLGPEAKSLLSGLLKKDPKQRLGGGSEDAKEIMQHRFFAGIVWQHVYEKKLSPPFKPQVTSETDTRYFDEEFTAQMITITPPDQVLLLGQRHGLRRRWTALDDSLEGWRGGLVP

SEQ ID NO: 835393 - protein, 243 aa, Homo sapiens
MMYEAIPVLFRHRLRSALIIVVALDYLHSEKNVVYRDLKLENLMLDKDGHIKITDFGLCKEGIKDGATMKTFCGTPEYLAPEVLEDNDYGRAVDWWGLGVVMYEMMCGRLPFYNQDHEKLFELILMEEIRFPRTLGPEAKSLLSGLLKKDPKQRLGGGSEDAKEIMQHRFFAGIVWQHVYEKKLSPPFKPQVTSETDTRYFDEEFTAQMITITPPDQDDSMECVDSERRPHFPQFSYSASGTA

SEQ ID NO: 835394 - protein, 480 aa, Homo sapiens [sequence omitted]

SEQ ID NO: 835395 - protein, 480 aa, Homo sapiens [sequence omitted]

SEQ ID NO: 835396 - protein, 467 aa, Homo sapiens
MSDVAIVKEGWLHKRGEYIKTWRPRYFLLKNDGTFIGYKERPQDVDQREAPLNNFSVAQCQLMKTERPRPNTFIIRCLQWTTVIERTFHVETPEEREEWTTAIQTVADGLKKQEEEEMDFRSGSPSDNSGAEEMEVSLAKPKHRVTMNEFEYLKLLGKGTFGKVILVKEKATGRYYAMKILKKEVIVAKDEVAHTLTENRVLQNSRHPFLTALKYSFQTHDRLCFVMEYANGGELFFHLSRERVFSEDRARFYGAEIVSALDYLHSEKNVVYRDLKLENLMLDKDGHIKITDFGLCKEGIKDGATMKTFCGTPEYLAPEVLEDNDYGRAVDWWGLGVVMYEMMCGRLPFYNQDHEKLFELILMEEIRFPRTLGPEAKSLLSGLLKKDPKQRLGGGSEDAKEIMQHRFFAGIVWQHVYEKKLSPPFKPQVTSETDTRYFDEEFTAQMITITPPDQVLGDCPTGSLPLR

SEQ ID NO: 835397 - protein, 422 aa, Homo sapiens; identical to SEQ ID NO: 835372

SEQ ID NO: 835398 - protein, 147 aa, Homo sapiens [sequence omitted]

SEQ ID NO: 835399 - protein, 285 aa, Homo sapiens
MSDVAIVKEGWLHKRGEYIKTWRPRYFLLKNDGTFIGYKERPQDVDQREAPLNNFSVAQCQLMKTERPRPNTFIIRCLQWTTVIERTFHVETPEEREEWTTAIQTVADGLKKQEEEEMDFRSGSPSDNSGAEEMEVSLAKPKHRVAMWHWGAGQVLPMCPLTLSASRPGLSVTSYLSSLWGPGPQFNLVAPDATSLWYAGQHPLLGVAGTQQPPSTKAVSLRTSSEAGPLGWDQGWGMGQGLPSGTEEQGLNLLLCIMLFKCILGVFNLCDRKALPLPLLCHSSW

SEQ ID NO: 835400 - protein, 335 aa, Homo sapiens
MSDVAIVKEGWLHKRGEYIKTWRPRYFLLKNDGTFIGYKERPQDVDQREAPLNNFSVAQCQLMKTERPRPNTFIIRCLQWTTVIERTFHVETPEEREEWTTAIQTVADGLKKQEEEEMDFRSGSPSDNSGAEEMEVSLAKPKHRVTMNEFEYLKLLGKGTFGKVILVKEKATGRYYAMKILKKEVIVAKDEVAHTLTENRVLQNSRHPFLTALKYSFQTHDRLCFVMEYANGGELFFHLSRERVFSEDRARFYGAEIVSALDYLHSEKNVVYRDLKRRTHAGQAAFNPTRLAGGRTGPEIGTNRPVRNRHTGRVQNGPKQKDREPNDLKPDHWHP

SEQ ID NO: 835401 - protein, 118 aa, Homo sapiens
MVFISRVHLREATLSSRAQMERRFCAVGSTLPRSGVGKKTILRVLIYFIQFVLRVWPQPSEQSDSRREMLRTSAAMRNVALGGRAGPAHVSPHSVSQPPWAVCHQLSVISLGPWASVQ

SEQ ID NO: 835402 - protein, 1191 aa, Homo sapiens
MPAPEQASLVEEGQPQTRQEAASTGPGMEPETTATTILASVKEQELQFQRLTRELEVERQIVASQLERCRLGAESPSIASTSSTEKSFPWRSTDVPNTGVSKPRVSDAVQPNNYLIRTEPEQGTLYSPEQTSLHESEGSLGNSRSSTQMNSYSDSGYQEAGSFHNSQNVSKADNRQQHSFIGSTNNHVVRNSRAEGQTLVQPSVANRAMRRVSSVPSRAQSPSYVISTGVSPSRGSLRTSLGSGFGSPSVTDPRPLNPSAYSSTTLPAARAASPYSQRPASPTAIRRIGSVTSRQTSNPNGPTPQYQTTARVGSPLTLTDAQTRVASPSQGQVGSSSPKRSGMTAVPQHLGPSLQRTVHDMEQFGQQQYDIYERMVPPRPDSLTGLRSSYASQHSQLGQDLRSAVSPDLHITPIYEGRTYYSPVYRSPNHGTVELQGSQTALYRTGSGIGNLQRTSSQRSTLTYQRNNYALNTTATYAEPYRPIQYRVQECNYNRLQHAVPADDGTTRSPSIDSIQKDPREFAWRDPELPEVIHMLQHQFPSVQANAAAYLQHLCFGDNKVKMEVCRLGGIKHLVDLLDHRVLEVQKNACGALRNLVFGKSTDENKIAMKNVGGIPALLRLLRKSIDAEVRELVTGVLWNLSSCDAVKMTIIRDALSTLTNTVIVPHSGWNNSSFDDDHKIKFQTSLVLRNTTGCLRNLSSAGEEARKQMRSCEGLVDSLLYVIHTCVNTSDYDSKTVENCVCTLRNLSYRLELEVPQARLLGLNELDDLLGKESPSKDSEPSCWGKKKKKKKRTPQEDQWDGVGPIPGLSKSPKGVEMLWHPSVVKPYLTLLAESSNPATLEGSAGSLQNLSAGNWKFAAYIRAAVRKEKGLPILVELLRMDNDRVVSSVATALRNMALDVRNKELIGKYAMRDLVNRLPGGNGPSVLSDETMAAICCALHEVTSKNMENAKALADSGGIEKLVNITKGRGDRSSLKVVKAAAQVLNTLWQYRDLRSIYKKDGWNQNHFITPVSTLERDRFKSHPSLSTTNQQMSPIIQSVGSTSSSPALLGIRDPRSEYDRTQPPMQYYNSQGDATHKGLYPGSSKPSPIYISSYSSPAREQNRRLQHQQLYYSQDDSNRKNFDAYRLYLQSPHSYEDPYFDDRVHFPASTDYSTQYGLKSTTNYVDFYSTKRPSYRAEQYPGSPDSWV

SEQ ID NO: 835403 - protein, 1148 aa, Homo sapiens
MPAPEQASLVEEGQPQTRQEAASTGPGMEPETTATTILASVKEQELQFQRLTRELEVERQIVASQLERCRLGAESPSIASTSSTEKSFPWRSTDVPNTGVSKPRVSDAVQPNNYLIRTEPEQGTLYSPEQTSLHESEGSLGNSRSSTQMNSYSDSGYQEAGSFHNSQNVSKADNRQQHSFIGSTNNHVVRNSRAEGQTLVQPSVANRAMRRVSSVPSRAQSPSYVISTGVSPSRGSLRTSLGSGFGSPSVTDPRPLNPSAYSSTTLPAARAASPYSQRPASPTAIRRIGSVTSRQTSNPNGPTPQYQTTARVGSPLTLTDAQTRVASPSQGQVGSSSPKRSGMTAVPQHLGPSLQRTVHDMEQFGQQQYDIYERMVPPRPDSLTGLRSSYASQHSQLGQDLRSAVSPDLHITPIYEGRTYYSPVYRSPNHGTVELQGSQTALYRTGSGIGNLQRTSSQRSTLTYQRNNYALNTTATYAEPYRPIQYRVQECNYNRLQHAVPADDGTTRSPSIDSIQKDPREFAWRDPELPEVIHMLQHQFPSVQANAAAYLQHLCFGDNKVKMEVCRLGGIKHLVDLLDHRVLEVQKNACGALRNLVFGKSTDENKIAMKNVGGIPALLRLLRKSIDAEVRELVTGVLWNLSSCDAVKMTIIRDALSTLTNTVIVPHSGWNNSSFDDDHKIKFQTSLVLRNTTGCLRNLSSAGEEARKQMRSCEGLVDSLLYVIHTCVNTSDYDSKTVENCVCTLRNLSYRLELEVPQARLLGLNELDDLLGKESPSKDSEPSCWGKKKKKKKRTPQEDQWDGVGPIPGLSKSPKGVEMLWHPSVVKPYLTLLAESSNPATLEGSAGSLQNLSAGNWKFAAYIRAAVRKEKGLPILVELLRMDNDRVVSSVATALRNMALDVRNKELIGKYAMRDLVNRLPGGNGPSVLSDETMAAICCALHEVTSKNMENAKALADSGGIEKLVNITKGRGDRSSLKVVKAAAQVLNTLWQYRDLRSIYKKDGWNQNHFITPVSTLERDRFKSHPSLSTTNQQMSPIIQSGSSKPSPIYISSYSSPAREQNRRLQHQQLYYSQDDSNRKNFDAYRLYLQSPHSYEDPYFDDRVHFPASTDYSTQYGLKSTTNYVDFYSTKRPSYRAEQYPGSPDSWV

SEQ ID NO: 835404 - protein, 1035 aa, Homo sapiens
MPAPEQASLVEEGQPQTRQEAASTGPGMEPETTATTILASVKEQELQFQRLTRELEVERQIVASQLERCRLGAESPSIASTSSTEKSFPWRSTDVPNTGVSKPRVSDAVQPNNYLIRTEPEQGTLYSPEQTSLHESEGSLGNSRSSTQMNSYSDSGYQEAGSFHNSQNVSKADNRQQHSFIGSTNNHVVRNSRAEGQTLVQPSVANRAMRRVSSVPSRAQSPSYVISTGVSPSRGSLRTSLGSGFGSPSVTDPRPLNPSAYSSTTLPAARAASPYSQRPASPTAIRRIGSVTSRQTSNPNGPTPQYQTTARVGSPLTLTDAQTRVASPSQGQVGSSSPKRSGMTAVPQHLGPSLQRTVHDMEQFGQQQYDIYERMVPPRPDSLTGLRSSYASQHSQLGQDLRSAVSPDLHITPIYEGRTYYSPVYRSPNHGTVELQGSQTALYRTGSGIGNLQRTSSQRSTLTYQRNNYALNTTATYAEPYRPIQYRVQECNYNRLQHAVPADDGTTRSPSIDSIQKDPREFAWRDPELPEVIHMLQHQFPSVQANAAAYLQHLCFGDNKVKMEVCRLGGIKHLVDLLDHRVLEVQKNACGALRNLVFGKSTDENKIAMKNVGGIPALLRLLRKSIDAEVRELVTGVLWNLSSCDAVKMTIIRDALSTLTNTVIVPHSGWNNSSFDDDHKIKFQTSLVLRNTTGCLRNLSSAGEEARKQMRSCEGLVDSLLYVIHTCVNTSDYDSKTVENCVCTLRNLSYRLELEVPQARLLGLNELDDLLGKESPSKDSEPSCWGKKKKKKKRTPQEDQWDGVGPIPGLSKSPKGVEMLWHPSVVKPYLTLLAESSNPATLEGSAGSLQNLSAGNWKFAAYIRAAVRKEKGLPILVELLRMDNDRVVSSVATALRNMALDVRNKELIGKYAMRDLVNRLPGGNGPSVLSDETMAAICCALHEVTSKNMENAKALADSGGIEKLVNITKGRGDRSSLKVVKAAAQVLNTLWQYRDLRSIYKKETDSNHILPCLPPTNRCHPSFSQSAAPLPHQHC

SEQ ID NO: 835405 - protein, 1047 aa, Homo sapiens
MPAPEQASLVEEGQPQTRQEAASTGPGMEPETTATTILASVKEQELQFQRLTRELEVERQIVASQLERCRLGAESPSIASTSSTEKSFPWRSTDVPNTGVSKPRVSDAVQPNNYLIRTEPEQGTLYSPEQTSLHESEGSLGNSRSSTQMNSYSDSGYQEAGSFHNSQNVSKADNRQQHSFIGSTNNHVVRNSRAEGQTLVQPSVANRAMRRVSSVPSRAQSPSYVISTGVSPSRGSLRTSLGSGFGSPSVTDPRPLNPSAYSSTTLPAARAASPYSQRPASPTAIRRIGSVTSRQTSNPNGPTPQYQTTARVGSPLTLTDAQTRVASPSQGQVGSSSPKRSGMTAVPQHLGPSLQRTVHDMEQFGQQQYDIYERMVPPRPDSLTGLRSSYASQHSQLGQDLRSAVSPDLHITPIYEGRTYYSPVYRSPNHGTVELQGSQTALYRTGSGIGNLQRTSSQRSTLTYQRNNYALNTTATYAEPYRPIQYRVQECNYNRLQHAVPADDGTTRSPSIDSIQKDPREFAWRDPELPEVIHMLQHQFPSVQANAAAYLQHLCFGDNKVKMEVCRLGGIKHLVDLLDHRVLEVQKNACGALRNLVFGKSTDENKIAMKNVGGIPALLRLLRKSIDAEVRELVTGVLWNLSSCDAVKMTIIRDALSTLTNTVIVPHSGWNNSSFDDDHKIKFQTSLVLRNTTGCLRNLSSAGEEARKQMRSCEGLVDSLLYVIHTCVNTSDYDSKTVENCVCTLRNLSYRLELEVPQARLLGLNELDDLLGKESPSKDSEPSCWGKKKKKKKRTPQEDQWDGVGPIPGLSKSPKGVEMLWHPSVVKPYLTLLAESSNPATLEGSAGSLQNLSAGNWKFAAYIRAAVRKEKGLPILVELLRMDNDRVVSSVATALRNMALDVRNKELIGKYAMRDLVNRLPGGNGPSVLSDETMAAICCALHEVTSKNMENAKALADSGGIEKLVNITKGRGDRSSLKVVKAAAQVLNTLWQYRDLRSIYKKDGWNQNHFITPVSTLERDRFKSHPSLSTTNQQMSPIIQSASTAVL

SEQ ID NO: 835406 - protein, 765 aa, Homo sapiens
KHTYTDTHTLTHTGRHTHRHRNTHAHTGRHTDTETHTLTHTGRHTDTETHTLTHTGRHTDTETHTLTHTEETSSQRSTLTYQRNNYALNTTATYAEPYRPIQYRVQECNYNRLQHAVPADDGTTRSPSIDSIQKDPREFAWRDPELPEVIHMLQHQFPSVQANAAAYLQHLCFGDNKVKMEVCRLGGIKHLVDLLDHRVLEVQKNACGALRNLVFGKSTDENKIAMKNVGGIPALLRLLRKSIDAEVRELVTGVLWNLSSCDAVKMTIIRDALSTLTNTVIVPHSGWNNSSFDDDHKIKFQTSLVLRNTTGCLRNLSSAGEEARKQMRSCEGLVDSLLYVIHTCVNTSDYDSKTVENCVCTLRNLSYRLELEVPQARLLGLNELDDLLGKESPSKDSEPSCWGKKKKKKKRTPQEDQWDGVGPIPGLSKSPKGVEMLWHPSVVKPYLTLLAESSNPATLEGSAGSLQNLSAGNWKFAAYIRAAVRKEKGLPILVELLRMDNDRVVSSVATALRNMALDVRNKELIGKYAMRDLVNRLPGGNGPSVLSDETMAAICCALHEVTSKNMENAKALADSGGIEKLVNITKGRGDRSSLKVVKAAAQVLNTLWQYRDLRSIYKKDGWNQNHFITPVSTLERDRFKSHPSLSTTNQQMSPIIQSGSSKPSPIYISSYSSPAREQNRRLQHQQLYYSQDDSNRKNFDAYRLYLQSPHSYEDPYFDDRVHFPASTDYSTQYGLKSTTNYVDFYSTKRPSYRAEQYPGSPDSWV

SEQ ID NO: 835407 - protein, 540 aa, Homo sapiens
MKNVGGIPALLRLLRKSIDAEVRELVTGVLWNLSSCDAVKMTIIRDALSTLTNTVIVPHSGWNNSSFDDDHKIKFQTSLVLRNTTGCLRNLSSAGEEARKQMRSCEGLVDSLLYVIHTCVNTSDYDSKTVENCVCTLRNLSYRLELEVPQARLLGLNELDDLLGKESPSKDSEPSCWGKKKKKKKRTPQEDQWDGVGPIPGLSKSPKGVEMLWHPSVVKPYLTLLAESSNPATLEGSAGSLQNLSAGNWKFAAYIRAAVRKEKGLPILVELLRMDNDRVVSSVATALRNMALDVRNKELIGKYAMRDLVNRLPGGNGPSVLSDETMAAICCALHEVTSKNMENAKALADSGGIEKLVNITKGRGDRSSLKVVKAAAQVLNTLWQYRDLRSIYKKDGWNQNHFITPVSTLERDRFKSHPSLSTTNQQMSPIIQSGSSKPSPIYISSYSSPAREQNRRLQHQQLYYSQDDSNRKNFDAYRLYLQSPHSYEDPYFDDRVHFPASTDYSTQYGLKSTTNYVDFYSTKRPSYRAEQYPGSPDSWV

SEQ ID NO: 835408 - protein, 1110 aa, Homo sapiens
MPAPEQASLVEEGQPQTRQEAASTGPGMEPETTATTILASVKEQELQFQRLTRELEVERQIVASQLERCRLGAESPSIASTSSTEKSFPWRSTDVPNTGVSKPRVSDAVQPNNYLIRTEPEQGTLYSPEQTSLHESEGSLGNSRSSTQMNSYSDSGYQEAGSFHNSQNVSKADNRQQHSFIGSTNNHVVRNSRAEGQTLVQPSVANRAMRRVSSVPSRAQSPSYVISTGVSPSRGSLRTSLGSGFGSPSVTDPRPLNPSAYSSTTLPAARAASPYSQRPASPTAIRRIGSVTSRQTSNPNGPTPQYQTTARVGSPLTLTDAQTRVASPSQGQVGSSSPKRSGMTAVPQHLGPSLQRTVHDMEQFGQQQYDIYERMVPPRPDSLTGLRSSYASQHSQLGQDLRSAVSPDLHITPIYEGRTYYSPVYRSPNHGTVELQGSQTALYRTGSGIGNLQRTSSQRSTLTYQRNNYALNTTATYAEPYRPIQYRVQECNYNRLQHAVPADDGTTRSPSIDSIQKDPREFAWRDPELPEVIHMLQHQFPSVQANAAAYLQHLCFGDNKVKMEVCRLGGIKHLVDLLDHRVLEVQKNACGALRNLVFGKSTDENKIAMKNVGGIPALLRLLRKSIDAEVRELVTGVLWNLSSCDAVKMTIIRDALSTLTNTVIVPHSGWNNSSFDDDHKIKFQTSLVLRNTTGCLRNLSSAGEEARKQMRSCEGLVDSLLYVIHTCVNTSDYDSKTVENCVCTLRNLSYRLELEVPQARLLGLNELDDLLGKESPSKDSEPSCWGKKKKKKKRTPQEDQWDGVGPIPGLSKSPKGVEMLWHPSVVKPYLTLLAESSNPATLEGSAGSLQNLSAGNWKFAAYIRAAVRKEKGLPILVELLRMDNDRVVSSVATALRNMALDVRNKELIGKYAMRDLVNRLPGGNGPSVLSDETMAAICCALHEVTSKNMENAKALADSGGIEKLVNITKGRGDRSSLKVVKAAAQVLNTLWQYRDLRSIYKKDGWNQNHFITPVSTLERDRFKSHPSLSTTNQQMSPIIQSVGSTSSSPALLGIRDPRSEYDRTQPPMQYYNSQGDATHKGLYPGKTPVGCVIQSLEKPHFQALGQWPGK

SEQ ID NO: 835409 - protein, 1126 aa, Homo sapiens
MPAPEQASLVEEGQPQTRQEAASTGPGMEPETTATTILASVKEQELQFQRLTRELEVERQIVASQLERCRLGAESPSIASTSSTEKSFPWRSTDVPNTGVSKPRVSDAVQPNNYLIRTEPEQGTLYSPEQTSLHESEGSLGNSRSSTQMNSYSDSGYQEAGSFHNSQNVSKADNRQQHSFIGSTNNHVVRNSRAEGQTLVQPSVANRAMRRVSSVPSRAQSPSYVISTGVSPSRGSLRTSLGSGFGSPSVTDPRPLNPSAYSSTTLPAARAASPYSQRPASPTAIRRIGSVTSRQTSNPNGPTPQYQTTARVGSPLTLTDAQTRVASPSQGQVGSSSPKRSGMTAVPQHLGPSLQRTVHDMEQFGQQQYDIYERMVPPRPDSLTGLRSSYASQHSQLGQDLRSAVSPDLHITPIYEGRTYYSPVYRSPNHGTVELQGSQTALYRTGSGIGNLQRTSSQRSTLTYQRNNYALNTTATYAEPYRPIQYRVQECNYNRLQHAVPADDGTTRSPSIDSIQKDPREFAWRDPELPEVIHMLQHQFPSVQANAAAYLQHLCFGDNKVKMEVCRLGGIKHLVDLLDHRVLEVQKNACGALRNLVFGKSTDENKIAMKNVGGIPALLRLLRKSIDAEVRELVTGVLWNLSSCDAVKMTIIRDALSTLTNTVIVPHSGWNNSSFDDDHKIKFQTSLVLRNTTGCLRNLSSAGEEARKQMRSCEGLVDSLLYVIHTCVNTSDYDSKTVENCVCTLRNLSYRLELEVPQARLLGLNELDDLLGKESPSKDSEPSCWGKKKKKKKRTPQEDQWDGVGPIPGLSKSPKGVEMLWHPSVVKPYLTLLAESSNPATLEGSAGSLQNLSAGNWKFAAYIRAAVRKEKGLPILVELLRMDNDRVVSSVATALRNMALDVRNKELIGKYAMRDLVNRLPGGNGPSVLSDETMAAICCALHEVTSKNMENAKALADSGGIEKLVNITKGRGDRSSLKVVKAAAQVLNTLWQYRDLRSIYKKDGWNQNHFITPVSTLERDRFKSHPSLSTTNQQMSPIIQSVGSTSSSPALLGIRDPRSEYDRTQPPMQYYNSQGDATHKGLYPAQKIADATFQHQALGKRKCTYQLKCMVASDLQQPALSYRSPL

SEQ ID NO: 835410 - protein, 330 aa, Homo sapiens [sequence omitted]

SEQ ID NO: 835411 - protein, 450 aa, Homo sapiens
MPAPEQASLVEEGQPQTRQEAASTGPGMEPETTATTILASVKEQELQFQRLTRELEVERQIVASQLERCRLGAESPSIASTSSTEKSFPWRSTDVPNTGVSKPRVSDAVQPNNYLIRTEPEQGTLYSPEQTSLHESEGSLGNSRSSTQMNSYSDSGYQEAGSFHNSQNVSKADNRQQHSFIGSTNNHVVRNSRAEGQTLVQPSVANRAMRRVSSVPSRAQSPSYVISTGVSPSRGSLRTSLGSGFGSPSVTDPRPLNPSAYSSTTLPAARAASPYSQRPASPTAIRRIGSVTSRQTSNPNGPTPQYQTTARVGSPLTLTDAQTRVASPSQGQVGSSSPKRSGMTAVPQHLGPSLQRTVHDMEQFGQQQYDIYERMVPPRPDSLTGLRSSYASQHSQLGQDLRSAVSPDLHITPIYEEYGTRCSQQGAHRQIRHARPGQPAPRRQWPQCLV

SEQ ID NO: 835412 - protein, 527 aa, Homo sapiens
MPAPEQASLVEEGQPQTRQEAASTGPGMEPETTATTILASVKEQELQFQRLTRELEVERQIVASQLERCRLGAESPSIASTSSTEKSFPWRSTDVPNTGVSKPRVSDAVQPNNYLIRTEPEQGTLYSPEQTSLHESEGSLGNSRSSTQMNSYSDSGYQEAGSFHNSQNVSKADNRQQHSFIGSTNNHVVRNSRAEGQTLVQPSVANRAMRRVSSVPSRAQSPSYVISTGVSPSRGSLRTSLGSGFGSPSVTDPRPLNPSAYSSTTLPAARAASPYSQRPASPTAIRRIGSVTSRQTSNPNGPTPQYQTTARVGSPLTLTDAQTRVASPSQGQVGSSSPKRSGMTAVPQHLGPSLQRTVHDMEQFGQQQYDIYERMVPPRPDSLTGLRSSYASQHSQLGQDLRSAVSPDLHITPIYEGRTYYSPVYRSPNHGTVELQGSQTALYRTGSGIGNLQRTSSQRSTLTYQRNNYALNTTATYAEPYRPIQYRVQECNYNRLQHAVPADDGTTRSPSIDSIQKDPRRVPVRSL

SEQ ID NO: 835413 - protein, 1191 aa, Homo sapiens; identical to SEQ ID NO: 835402

SEQ ID NO: 835414 - protein, 1125 aa, Homo sapiens
WPDRPGPCETQHHYSSIVKEQELQFQRLTRELEVERQIVASQLERCRLGAESPSIASTSSTEKSFPWRSTDVPNTGVSKPRVSDAVQPNNYLIRTEPEQGTLYSPEQTSLHESEGSLGNSRSSTQMNSYSDSGYQEAGSFHNSQNVSKADNRQQHSFIGSTNNHVVRNSRAEGQTLVQPSVANRAMRRVSSVPSRAQSPSYVISTGVSPSRGSLRTSLGSGFGSPSVTDPRPLNPSAYSSTTLPAARAASPYSQRPASPTAIRRIGSVTSRQTSNPNGPTPQYQTTARVGSPLTLTDAQTRVASPSQGQVGSSSPKRSGMTAVPQHLGPSLQRTVHDMEQFGQQQYDIYERMVPPRPDSLTGLRSSYASQHSQLGQDLRSAVSPDLHITPIYEGRTYYSPVYRSPNHGTVELQGSQTALYRTGSGIGNLQRTSSQRSTLTYQRNNYALNTTATYAEPYRPIQYRVQECNYNRLQHAVPADDGTTRSPSIDSIQKDPREFAWRDPELPEVIHMLQHQFPSVQANAAAYLQHLCFGDNKVKMEVCRLGGIKHLVDLLDHRVLEVQKNACGALRNLVFGKSTDENKIAMKNVGGIPALLRLLRKSIDAEVRELVTGVLWNLSSCDAVKMTIIRDALSTLTNTVIVPHSGWNNSSFDDDHKIKFQTSLVLRNTTGCLRNLSSAGEEARKQMRSCEGLVDSLLYVIHTCVNTSDYDSKTVENCVCTLRNLSYRLELEVPQARLLGLNELDDLLGKESPSKDSEPSCWGKKKKKKKRTPQEDQWDGVGPIPGLSKSPKGVEMLWHPSVVKPYLTLLAESSNPATLEGSAGSLQNLSAGNWKFAAYIRAAVRKEKGLPILVELLRMDNDRVVSSVATALRNMALDVRNKELIGKYAMRDLVNRLPGGNGPSVLSDETMAAICCALHEVTSKNMENAKALADSGGIEKLVNITKGRGDRSSLKVVKAAAQVLNTLWQYRDLRSIYKKDGWNQNHFITPVSTLERDRFKSHPSLSTTNQQMSPIIQSGSSKPSPIYISSYSSPAREQNRRLQHQQLYYSQDDSNRKNFDAYRLYLQSPHSYEDPYFDDRVHFPASTDYSTQYGLKSTTNYVDFYSTKRPSYRAEQYPGSPDSWV

SEQ ID NO: 835415 - protein, 540 aa, Homo sapiens; identical to SEQ ID NO: 835407

SEQ ID NO: 835416 - protein, 1184 aa, Homo sapiens
MPAPEQASLVEEGQPQTRQEAASTGPGMEPETTATTILASVKEQELQFQRLTRELEVERQIVASQLERCRLGAESPSIASTSSTEKSFPWRSTDVPNTGVSKPRVSDAVQPNNYLIRTEPEQGTLYSPEQTSLHESEGSLGNSRSSTQMNSYSDSGYQEAGSFHNSQNVSKADNRQQHSFIGSTNNHVVRNSRAEGQTLVQPSVANRAMRRVSSVPSRAQSPSYVISTGVSPSRGSLRTSLGSGFGSPSVTDPRPLNPSAYSSTTLPAARAASPYSQRPASPTAIRRIGSVTSRQTSNPNGPTPQYQTTARVGSPLTLTDAQTRVASPSQGQVGSSSPKRSGMTAVPQHLGPSLQRTVHDMEQFGQQQYDIYERMVPPRPDSLTGLRSSYASQHSQLGQDLRSAVSPDLHITPIYEGRTYYSPVYRSPNHGTVELQGSQTALYRTGSGIGNLQRTSSQRSTLTYQRNNYALNTTATYAEPYRPIQYRVQECNYNRLQHAVPADDGTTRSPSIDSIQKDPREFAWRDPELPEVIHMLQHQFPSVQANAAAYLQHLCFGDNKVKMEVCRLGGIKHLVDLLDHRVLEVQKNACGALRNLVFGKSTDENKIAMKNVGGIPALLRLLRKSIDAEVRELVTGVLWNLSSCDAVKMTIIRDALSTLTNTVIVPHSGWNNSSFDDDHKIKFQTSLVLRNTTGCLRNLSSAGEEARKQMRSCEGLVDSLLYVIHTCVNTSDYDSKEATLQIKGQVSKVTGARTWQLKKIILRTVRTEWLGVTVENCVCTLRNLSYRLELEVPQARLLGLNELDDLLGKESPSKDSEPSCWGKKKKKKKRTPQEDQWDGVGPIPGLSKSPKGVEMLWHPSVVKPYLTLLAESSNPATLEGSAGSLQNLSAGNWKFAAYIRAAVRKEKGLPILVELLRMDNDRVVSSVATALRNMALDVRNKELIGKYAMRDLVNRLPGGNGPSVLSDETMAAICCALHEVTSKNMENAKALADSGGIEKLVNITKGRGDRSSLKVVKAAAQVLNTLWQYRDLRSIYKKDGWNQNHFITPVSTLERDRFKSHPSLSTTNQQMSPIIQSGSSKPSPIYISSYSSPAREQNRRLQHQQLYYSQDDSNRKNFDAYRLYLQSPHSYEDPYFDDRVHFPASTDYSTQYGLKSTTNYVDFYSTKRPSYRAEQYPGSPDSWV

SEQ ID NO: 835417 - protein, 267 aa, Homo sapiens [sequence omitted]

SEQ ID NO: 835418 - protein, 236 aa, Homo sapiens [sequence omitted]

SEQ ID NO: 835419 - protein, 290 aa, Homo sapiens
MPAPEQASLVEEGQPQTRQEAASTGPGMEPETTATTILASVKEQELQFQRLTRELEVERQIVASQLERCRLGAESPSIASTSSTEKSFPWRSTDVPNTGVSKPRVSDAVQPNNYLIRTEPEQGTLYSPEQTSLHESEGSLGNSRSSTQMNSYSDSGYQEAGSFHNSQNVSKADNRQQHSFIGSTNNHVVRNSRAEGQTLVQVSQTHQDLCKEIPSGRAQWLMPVIPAFWEAEAGGSPEVRSSRPACLTWRNPVSTKNTKISRAWWRAPVISATREAEAGESLEPRRQSLQ

SEQ ID NO: 835420 - protein, 111 aa, Homo sapiens
MLQAEKTEVAEALTKAEAGRMELELSVTKLRAEEASLQDSLSKLSALNESLAQDKLDLNCLVTQLEEEKATLQGRQRQAEQEATVAPAEQEWLEELWLEQEVARQGLEGSL

SEQ ID NO: 835421 - protein, 111 aa, Homo sapiens; identical to SEQ ID NO: 835420

SEQ ID NO: 835422 - protein, 111 aa, Homo sapiens; identical to SEQ ID NO: 835420

SEQ ID NO: 835423 - protein, 111 aa, Homo sapiens; identical to SEQ ID NO: 835420

SEQ ID NO: 835424 - protein, 111 aa, Homo sapiens; identical to SEQ ID NO: 835420

SEQ ID NO: 835425 - protein, 159 aa, Homo sapiens
MAFKWLHKQQAFCGDFFFHLTPYPLLVSPPLSPRVHLSGSLLVSPHLLPTFLPFLISWGLTLQAEAGRMELELSVTKLRAEEASLQDSLSKLSALNESLAQDKLDLNCLVTQLEEEKATLQGRQRQAEQEATVAPAEQEWLEELWLEQEVARQGLEGSL

SEQ ID NO: 835426 - protein, 50 aa, Homo sapiens
MASKGAGVSFSRKSCRLTSDAEKSRVTAIVQEKLLNDYLTPATYEVRALS

SEQ ID NO: 835427 - protein, 150 aa, Homo sapiens
MAFKWLHKQQAFCGDFFFHLTPYPLLVSPPLSPRVHLSGSLLVSPHLLPTFLPFLISWGLTLQAEAGRMELELSVTKLRAEEASLQDSLSKLSALNESLAQDKLDLNCLVTQVHCAPAGPPTLPTRPPHSVRHPGPGPAPVLAPASLSVS

SEQ ID NO: 835428 - protein, 111 aa, Homo sapiens; identical to SEQ ID NO: 835420

SEQ ID NO: 835429 - protein, 111 aa, Homo sapiens; identical to SEQ ID NO: 835420

SEQ ID NO: 835430 - protein, 111 aa, Homo sapiens; identical to SEQ ID NO: 835420

SEQ ID NO: 835431 - protein, 111 aa, Homo sapiens; identical to SEQ ID NO: 835420

SEQ ID NO: 835432 - protein, 202 aa, Homo sapiens
MLQAEKTEVAEALTKLEEEKATLQGRQRQAEQEATVAPAEQEWLEELWLEQEVARQGLEGSLLVAEQAQEALEQQLPTLHHELSWLQEQLAQEAAWRELEAERAQLQSQLQREQEELLARRKAEKEQLSEEIAALQQEHDEGLLLAESEKQQALSLKESEKMALSEKLMGTRHSLATISLEMERQKPDAQSRQEQDRVGLPS

SEQ ID NO: 835433 - protein, 452 aa, Homo sapiens
RGSRGRCRRRRRALCSRRAPARQGPGPARLPGMVSKALLRLVSAVNRRRMKLLLGIALLAYVASVWGNFVNMRSIQENGELKIESKIEEMVEPLREKIRDLEKSFTQKYPPVKFLSEKDRKRILITGGAGFVGSHLTDKLMMDGHEVTVVDNFFTGRKRNVEHWIGHENFELINHDVVEPLYIEVDQIYHLASPASPPNYMYNPIKTLKTNTIGTLNMLGLAKRVGARLLLASTSEVYGDPEVHPQSEDYWGHVNPIGPRACYDEGKRVAETMCYAYMKQEGVEVRVARIFNTFGPRMHMNDGRVVSNFILQALQGEPLTVYGSGSQTRAFQYVSDLVNGLVALMNSNVSSPVNLGNPEEHTILEFAQLIKNLVGSGSEIQFLSEAQDDPQKRKPDIKKAKLMLGWEPVVPLEEGLNKAIHYFRKELEYQANNQYIPKPKPARIKKGRTRHS

SEQ ID NO: 835434 - protein, 252 aa, Homo sapiens
MYNPIKTLKTNTIGTLNMLGLAKRVGARLLLASTSEVYGDPEVHPQSEDYWGHVNPIGPRACYDEGKRVAETMCYAYMKQEGVEVRVARIFNTFGPRMHMNDGRVVSNFILQALQGEPLTVYGSGSQTRAFQYVSDLVNGLVALMNSNVSSPVNLGNPEEHTILEFAQLIKNLVGSGSEIQFLSEAQDDPQKRKPDIKKAKLMLGWEPVVPLEEGLNKAIHYFRKELEYQANNQYIPKPKPARIKKGRTRHS

SEQ ID NO: 835435 - protein, 355 aa, Homo sapiens
RGSRGRCRRRRRALCSRRAPARQGPGPARLPGMVSKALLRLVSAVNRRRMKLLLGIALLAYVASVWGNFVNMRSIQENGELKIESKIEEMVEPLREKIRDLEKSFTQKYPPVKFLSEKDRKRILITGGAGFVGSHLTDKLMMDGHEVTVVDNFFTGRKRNVEHWIGHENFELINHDVVEPLYIEVDQIYHLASPASPPNYMYNPIKTLKTNTIGTLNMLGLAKRVGARLLLASTSEVYGDPEVHPQSEDYWGHVNPIGPRACYDEGKRVAETMCYAYMKQEGVEVRVARIFNTFGPRMHMNDGRVVSNFILQALQGEPLTRSSEWPRGSHEQQRQQPGQPGEPRRTHNPRICSVN

SEQ ID NO: 835436 - protein, 452 aa, Homo sapiens; identical to SEQ ID NO: 835433

SEQ ID NO: 835437 - protein, 173 aa, Homo sapiens
VGGNSGLLRQNNLPPTELLLGACTQSAWPQQLQEHSLDFHAEQSLGSSGASQRTAFPPPAPYSHHIWGLPLMWMVRLCLPMLCDSLLPFFSLNISGSGSEIQFLSEAQDDPQKRKPDIKKAKLMLGWEPVVPLEEGLNKAIHYFRKELEYQANNQYIPKPKPARIKKGRTRHS

SEQ ID NO: 835438 - protein, 373 aa, Homo sapiens
RGSRGRCRRRRRALCSRRAPARQGPGPARLPGMVSKALLRLVSAVNRRRMKLLLGIALLAYVASVWGNFVNMRSIQENGELKIESKIEEMVEPLREKIRDLEKSFTQKYPPVKFLSEKDRKRILITGGAGFVGSHLTDKLMMDGHEVTVVDNFFTGRKRNVEHWIGHENFELINHDVVEPLYIEVDQIYHLASPASPPNYMYNPIKTLKTNTIGTLNMLGLAKRVGARLLLASTSEVYGDPEVHPQSEDYWGHVNPIGPRACYDEGKRVAETMCYAYMKQEGVEVRVARIFNTFGPRMHMNDGRVVSNFILQALQGEPLTVYGSGSQTRAFQYVSDLVNGLVALMNSNVSSPVNLVSAPLPPLCRTAQTFVHL

SEQ ID NO: 835439 - protein, 452 aa, Homo sapiens; identical to SEQ ID NO: 835433

SEQ ID NO: 835440 - protein, 372 aa, Homo sapiens
AAGTLRIPVWFLLDTREKSEIRQSFTQKYPPVKFLSEKDRKRILITGGAGFVGSHLTDKLMMDGHEVTVVDNFFTGRKRNVEHWIGHENFELINHDVVEPLYIEVDQIYHLASPASPPNYMYNPIKTLKTNTIGTLNMLGLAKRVGARLLLASTSEVYGDPEVHPQSEDYWGHVNPIGPRACYDEGKRVAETMCYAYMKQEGVEVRVARIFNTFGPRMHMNDGRVVSNFILQALQGEPLTVYGSGSQTRAFQYVSDLVNGLVALMNSNVSSPVNLGNPEEHTILEFAQLIKNLVGSGSEIQFLSEAQDDPQKRKPDIKKAKLMLGWEPVVPLEEGLNKAIHYFRKELEYQANNQYIPKPKPARIKKGRTRHS

SEQ ID NO: 835441 - protein, 548 aa, Homo sapiens
MAAPPARADADPSPTSPPTARDTPGRQAEKSETACEDRSNAESLDRLLPPVGTGRSPRKRTTSQCKSEPPLLRTSKRTIYTAGRPPWYNEHGTQSKEAFAIGLGGGSASGKTTVARMIIEALDVPWVVLLSMDSFYKVLTEQQQEQAAHNNFNFDHPDAFDFDLIISTLKKLKQGKSVKVPIYDFTTHSRKKDWKTLYGANVIIFEGIMAFADKTLLELLDMKIFVDTDSDIRLVRRLRRDISERGRDIEGVIKQYNKFVKPSFDQYIQPTMRLADIVVPRGSGNTVAIDLIVQHVHSQLEERELSVRAALASAHQCHPLPRTLSVLKSTPQVRGMHTIIRDKETSRDEFIFYSKRLMRLLIEHALSFLPFQDCVVQTPQGQDYAGKCYAGKQITGVSILRAGETMEPALRAVCKDVRIGTILIQTNQLTGEPELHYLRLPKDISDDHVILMDCTVSTGAAAMMAVRVLLDHDVPEDKIFLLSLLMAEMGVHSVAYAFPRVRIITTAVDKRVNDLFRIIPGIGNFGDRYFGTDAVPDGSDEEEVAYTG

SEQ ID NO: 835442 - protein, 394 aa, Homo sapiens
MAAPPARADADPSPTSPPTARDTPGRQAEKSETACEDRSNAESLDRLLPPVGTGRSPRKRTTSQCKSEPPLLRTSKRTIYTAGRPPWYNEHGTQSKEAFAIGLGGGSASGKTTVARMIIEALDVPWVVLLSMDSFYKVLTEQQQEQAAHNNFNFDHPDAFDFDLIISTLKKLKQGKSVKVPIYDFTTHSRKKDWKTLYGANVIIFEGIMAFADKTLLELLDMKIFVDTDSDIRLVRRLRRDISERGRDIEGVIKQYNKFVKPSFDQYIQPTMRLADIVVPRGSGNTVAIDLIVQHVHSQLEERELSVRAALASAHQCHPLPRTLSVLKSTPQGQGDQSRRVHLLLQETDAAAHRARALLPALSGLRRTDPAGAGLCGQVLCGEADHRCVHSARR

SEQ ID NO: 835443 - protein, 525 aa, Homo sapiens
MPCTDSDCGSELLPISNAESLDRLLPPVGTGRSPRKRTTSQCKSEPPLLRTSKRTIYTAGRPPWYNEHGTQSKEAFAIGLGGGSASGKTTVARMIIEALDVPWVVLLSMDSFYKVLTEQQQEQAAHNNFNFDHPDAFDFDLIISTLKKLKQGKSVKVPIYDFTTHSRKKDWKTLYGANVIIFEGIMAFADKTLLELLDMKIFVDTDSDIRLVRRLRRDISERGRDIEGVIKQYNKFVKPSFDQYIQPTMRLADIVVPRGSGNTVAIDLIVQHVHSQLEERELSVRAALASAHQCHPLPRTLSVLKSTPQVRGMHTIIRDKETSRDEFIFYSKRLMRLLIEHALSFLPFQDCVVQTPQGQDYAGKCYAGKQITGVSILRAGETMEPALRAVCKDVRIGTILIQTNQLTGEPELHYLRLPKDISDDHVILMDCTVSTGAAAMMAVRVLLDHDVPEDKIFLLSLLMAEMGVHSVAYAFPRVRIITTAVDKRVNDLFRIIPGIGNFGDRYFGTDAVPDGSDEEEVAYTG

SEQ ID NO: 835444 - protein, 568 aa, Homo sapiens
MSHHAQPRQSSYVPPMSLPASAMPVEGVGGDALWAGHASGYLGGGQLWATSEYIPLCSSNAESLDRLLPPVGTGRSPRKRTTSQCKSEPPLLRTSKRTIYTAGRPPWYNEHGTQSKEAFAIGLGGGSASGKTTVARMIIEALDVPWVVLLSMDSFYKVLTEQQQEQAAHNNFNFDHPDAFDFDLIISTLKKLKQGKSVKVPIYDFTTHSRKKDWKTLYGANVIIFEGIMAFADKTLLELLDMKIFVDTDSDIRLVRRLRRDISERGRDIEGVIKQYNKFVKPSFDQYIQPTMRLADIVVPRGSGNTVAIDLIVQHVHSQLEERELSVRAALASAHQCHPLPRTLSVLKSTPQVRGMHTIIRDKETSRDEFIFYSKRLMRLLIEHALSFLPFQDCVVQTPQGQDYAGKCYAGKQITGVSILRAGETMEPALRAVCKDVRIGTILIQTNQLTGEPELHYLRLPKDISDDHVILMDCTVSTGAAAMMAVRVLLDHDVPEDKIFLLSLLMAEMGVHSVAYAFPRVRIITTAVDKRVNDLFRIIPGIGNFGDRYFGTDAVPDGSDEEEVAYTG

SEQ ID NO: 835445 - protein, 525 aa, Homo sapiens; identical to SEQ ID NO: 835443

SEQ ID NO: 835446 - protein, 340 aa, Homo sapiens
MAFADKTLLELLDMKIFVDTDSDIRLVRRLRRDISERGRDIEGVIKQYNKFVKPSFDQYIQPTMRLADIVVPRGSGNTVAIDLIVQHVHSQLEERELSVRAALASAHQCHPLPRTLSVLKSTPQVRGMHTIIRDKETSRDEFIFYSKRLMRLLIEHALSFLPFQDCVVQTPQGQDYAGKCYAGKQITGVSILRAGETMEPALRAVCKDVRIGTILIQTNQLTGEPELHYLRLPKDISDDHVILMDCTVSTGAAAMMAVRVLLDHDVPEDKIFLLSLLMAEMGVHSVAYAFPRVRIITTAVDKRVNDLFRIIPGIGNFGDRYFGTDAVPDGSDEEEVAYTG

SEQ ID NO: 835447 - protein, 656 aa, Homo sapiens
MSSPPAYPGIRISGCRALGAEGSSNAESLDRLLPPVGTGRSPRKRTTSQCKSEPPLLRTSKRTIYTAGRPPWYNEHGTQSKEAFAIGGAAGGWDLLPDACLRLPSSACGAGEGSRATAGSGSGMGTSGTYLCRQPACSSQRVSTPAGRLGRRQCLWEDHCGQNDHRGPGCALGGLAVHGLLLQGGPPPSSPEDPFVLSLTLDPLQKKVPGLSPSVAAPGRPRAPVRWHWVRALLCPQLLHSLPHQVLTEQQQEQAAHNNFNFDHPDAFDFDLIISTLKKLKQGKSVKVPIYDFTTHSRKKDWKTLYGANVIIFEGIMAFADKTLLELLDMKIFVDTDSDIRLVRRLRRDISERGRDIEGVIKQYNKFVKPSFDQYIQPTMRLADIVVPRGSGNTVAIDLIVQHVHSQLEERELSVRAALASAHQCHPLPRTLSVLKSTPQVRGMHTIIRDKETSRDEFIFYSKRLMRLLIEHALSFLPFQDCVVQTPQGQDYAGKCYAGKQITGVSILRAGETMEPALRAVCKDVRIGTILIQTNQLTGEPELHYLRLPKDISDDHVILMDCTVSTGAAAMMAVRVLLDHDVPEDKIFLLSLLMAEMGVHSVAYAFPRVRIITTAVDKRVNDLFRIIPGIGNFGDRYFGTDAVPDGSDEEEVAYTG

SEQ ID NO: 835448 - protein, 213 aa, Homo sapiens [sequence omitted]

SEQ ID NO: 835449 - protein, 191 aa, Homo sapiens [sequence omitted]

SEQ ID NO: 835450 - protein, 511 aa, Homo sapiens
MAAPPARADADPSPTSPPTARDTPGRQAEKSETACEDRSNAESLDRLLPPVGTGRSPRKRTTSQCKSEPPLLRTSKRTIYTAGRPPWYNEHGTQSKEAFAIGLGGGSASGKTTVARMIIEALDVPWVVLLSMDSFYKVLTEQQQEQAAHNNFNFDHPDAFDFDLIISTLKKLKQGKSVKVPIYDFTTHSRKKDWKTLYGANVIIFEGIMAFADKTLLELLDMKIFVDTDSDIRLVRRLRRDISERGRDIEGVIKQYNKFVKPSFDQYIQPTMRLADIVVPRGSGNTVAIDLIVQHVHSQLEERELSVRAALASAHQCHPLPRTLSVLKSTPQVRGMHTIIRDKETSRDEFIFYSKRLMRLLIEHALSFLPFQDCVVQTPQGQDYAGKCYAGKQITGVSILRAGETMEPALRAVCKDVRIGTILIQTNQLTGEPEVPGGSRGDEPGGRGQRELTARGRREPHLQPDPCCPQLHYLRLPKDISDDHVILMDCTVSTGAAAMMAVRVLLVSEPW

SEQ ID NO: 835451 - protein, 143 aa, Homo sapiens
MDCTVSTGAAAMMAVRVLLVSEPWVGGAGSGRGGIYLPNTLGEDHDVPEDKIFLLSLLMAEMGVHSVAYAFPRVRIITTAVDKRVNDLFRIIPGIGEAARALQPHMRAGWVALGGPTTLDPPPPFSRELWRPLLWDRRGPRWQ

SEQ ID NO: 835452 - protein, 548 aa, Homo sapiens; identical to SEQ ID NO: 835441

SEQ ID NO: 835453 - protein, 548 aa, Homo sapiens; identical to SEQ ID NO: 835441

SEQ ID NO: 835454 - protein, 533 aa, Homo sapiens
MSSPPAYPGIRISGCRALGAEGSSNAESLDRLLPPVGTGRSPRKRTTSQCKSEPPLLRTSKRTIYTAGRPPWYNEHGTQSKEAFAIGLGGGSASGKTTVARMIIEALDVPWVVLLSMDSFYKVLTEQQQEQAAHNNFNFDHPDAFDFDLIISTLKKLKQGKSVKVPIYDFTTHSRKKDWKTLYGANVIIFEGIMAFADKTLLELLDMKIFVDTDSDIRLVRRLRRDISERGRDIEGVIKQYNKFVKPSFDQYIQPTMRLADIVVPRGSGNTVAIDLIVQHVHSQLEERELSVRAALASAHQCHPLPRTLSVLKSTPQVRGMHTIIRDKETSRDEFIFYSKRLMRLLIEHALSFLPFQDCVVQTPQGQDYAGKCYAGKQITGVSILRAGETMEPALRAVCKDVRIGTILIQTNQLTGEPELHYLRLPKDISDDHVILMDCTVSTGAAAMMAVRVLLDHDVPEDKIFLLSLLMAEMGVHSVAYAFPRVRIITTAVDKRVNDLFRIIPGIGNFGDRYFGTDAVPDGSDEEEVAYTG

SEQ ID NO: 835455 - protein, 550 aa, Homo sapiens
MAEAGRLIGVGGDALWAGHASGYLGGGQLWATSEYIPLCSSNAESLDRLLPPVGTGRSPRKRTTSQCKSEPPLLRTSKRTIYTAGRPPWYNEHGTQSKEAFAIGLGGGSASGKTTVARMIIEALDVPWVVLLSMDSFYKVLTEQQQEQAAHNNFNFDHPDAFDFDLIISTLKKLKQGKSVKVPIYDFTTHSRKKDWKTLYGANVIIFEGIMAFADKTLLELLDMKIFVDTDSDIRLVRRLRRDISERGRDIEGVIKQYNKFVKPSFDQYIQPTMRLADIVVPRGSGNTVAIDLIVQHVHSQLEERELSVRAALASAHQCHPLPRTLSVLKSTPQVRGMHTIIRDKETSRDEFIFYSKRLMRLLIEHALSFLPFQDCVVQTPQGQDYAGKCYAGKQITGVSILRAGETMEPALRAVCKDVRIGTILIQTNQLTGEPELHYLRLPKDISDDHVILMDCTVSTGAAAMMAVRVLLDHDVPEDKIFLLSLLMAEMGVHSVAYAFPRVRIITTAVDKRVNDLFRIIPGIGNFGDRYFGTDAVPDGSDEEEVAYTG

SEQ ID NO: 835456 - protein, 340 aa, Homo sapiens; identical to SEQ ID NO: 835446

SEQ ID NO: 835457 - protein, 595 aa, Homo sapiens
MSSPPAYPGIRISGCRALGAEGSSNAESLDRLLPPVGTGRSPRKRTTSQCKSEPPLLRTSKRTIYTAGRPPWYNEHGTQSKEAFAIGGEQRGGGTCCRTPASGSPPVPVEQEKEAGQPQAAAAGWAPLGPICAGSLPVPHRGSPLPPAGLGGGSASGKTTVARMIIEALDVPWVVLLSMDSFYKVLTEQQQEQAAHNNFNFDHPDAFDFDLIISTLKKLKQGKSVKVPIYDFTTHSRKKDWKTLYGANVIIFEGIMAFADKTLLELLDMKIFVDTDSDIRLVRRLRRDISERGRDIEGVIKQYNKFVKPSFDQYIQPTMRLADIVVPRGSGNTVAIDLIVQHVHSQLEERELSVRAALASAHQCHPLPRTLSVLKSTPQVRGMHTIIRDKETSRDEFIFYSKRLMRLLIEHALSFLPFQDCVVQTPQGQDYAGKCYAGKQITGVSILRAGETMEPALRAVCKDVRIGTILIQTNQLTGEPELHYLRLPKDISDDHVILMDCTVSTGAAAMMAVRVLLDHDVPEDKIFLLSLLMAEMGVHSVAYAFPRVRIITTAVDKRVNDLFRIIPGIGNFGDRYFGTDAVPDGSDEEEVAYTG

SEQ ID NO: 835458 - protein, 340 aa, Homo sapiens; identical to SEQ ID NO: 835446

SEQ ID NO: 835459 - protein, 555 aa, Homo sapiens
MAAPPARADADPSPTSPPTARDTPGRQAEKSETACEDRSNAESLDRLLPPVGTGRSPRKRTTSQCKSEPPLLRTSKRTIYTAGRPPWYNEHGTQSKEAFAIGLGGGSASGKTTVARMIIEALDVPWVVLLSMDSFYKVLTEQQQEQAAHNNFNFDHPDAFDFDLIISTLKKLKQGKSVKVPIYDFTTHSRKKDWKTLYGANVIIFEGIMAFADKTLLELLDMKIFVDTDSDIRLVRRLRRDISERGRDIEGVIKQYNKFVKPSFDQYIQPTMRLADIVVPRGSGNTVAIDLIVQHVHSQLEERELSVRAALASAHQCHPLPRTLSVLKSTPQVRGMHTIIRDKETSRDEFIFYSKRLMRLLIEHALSFLPFQDCVVQTPQGQDYAGKCYAGKQITGVSILRAGETMEPALRAVCKDVRIGTILIQTNQLTGEPEPDPCCPQLHYLRLPKDISDDHVILMDCTVSTGAAAMMAVRVLLDHDVPEDKIFLLSLLMAEMGVHSVAYAFPRVRIITTAVDKRVNDLFRIIPGIGNFGDRYFGTDAVPDGSDEEEVAYTG

SEQ ID NO: 835460 - protein, 584 aa, Homo sapiens
MAAPPARADADPSPTSPPTARDTPGRQAEKSETACEDRSNAESLDRLLPPVGTGRSPRKRTTSQCKSEPPLLRTSKRTIYTAGRPPWYNEHGTQSKEAFAIGLGGGSASGKTTVARMIIEALDVPWVVLLSMDSFYKVLTEQQQEQAAHNNFNFDHPDAFDFDLIISTLKKLKQGKSVKVPIYDFTTHSRKKDWKTLYGANVIIFEGIMAFADKTLLELLDMKIFVDTDSDIRLVRRLRRDISERGRDIEGVIKQYNKFVKPSFDQYIQPTMRLADIVVPRGSGNTVAIDLIVQHVHSQLEERELSVRAALASAHQCHPLPRTLSVLKSTPQVRGMHTIIRDKETSRDEFIFYSKRLMRLLIEHALSFLPFQDCVVQTPQGQDYAGKCYAGKQITGVSILRAGETMEPALRAVCKDVRIGTILIQTNQLTGEPEVPGGSRGDEPGGRGQRELTARGRREPHLQPDPCCPQLHYLRLPKDISDDHVILMDCTVSTGAAAMMAVRVLLDHDVPEDKIFLLSLLMAEMGVHSVAYAFPRVRIITTAVDKRVNDLFRIIPGIGNFGDRYFGTDAVPDGSDEEEVAYTG

SEQ ID NO: 835461 - protein, 262 aa, Homo sapiens
CVRVGCCACCTIQLEERELSVRAALASAHQCHPLPRTLSVLKSTPQVRGMHTIIRDKETSRDEFIFYSKRLMRLLIEHALSFLPFQDCVVQTPQGQDYAGKCYAGKQITGVSILRAGETMEPALRAVCKDVRIGTILIQTNQLTGEPELHYLRLPKDISDDHVILMDCTVSTGAAAMMAVRVLLDHDVPEDKIFLLSLLMAEMGVHSVAYAFPRVRIITTAVDKRVNDLFRIIPGIGNFGDRYFGTDAVPDGSDEEEVAYTG

SEQ ID NO: 835462 - protein, 1072 aa, Homo sapiens
MAKATSGAAGLRLLLLLLLPLLGKVALGLYFSRDAYWEKLYVDQAAGTPLLYVHALRDAPEEVPSFRLGQHLYGTYRTRLHENNWICIQEDTGLLYLNRSLDHSSWEKLSVRNRGFPLLTVYLKVFLSPTSLREGECQWPGCARVYFSFFNTSFPACSSLKPRELCFPETRPSFRIRENRPPGTFHQFRLLPVQFLCPNISVAYRLLEGEGLPFRCAPDSLEVSTRWALDREQREKYELVAVCTVHAGAREEVVMVPFPVTVYDEDDSAPTFPAGVDTASAVVEFKRKEDTVVATLRVFDADVVPASGELVRRYTSTLLPGDTWAQQTFRVEHWPNETSVQANGSFVRATVHDYRLVLNRNLSISENRTMQLAVLVNDSDFQGPGAGVLLLHFNVSVLPVSLHLPSTYSLSVSRRARRFAQIGKVCVENCQAFSGINVQYKLHSSGANCSTLGVVTSAEDTSGILFVNDTKALRRPKCAELHYMVVATDQQTSRQAQAQLLVTVEGSYVAEEAGCPLSCAVSKRRLECEECGGLGSPTGRCEWRQGDGKGITRNFSTCSPSTKTCPDGHCDVVETQDINICPQDCLRGSIVGGHEPGEPRGIKAGYGTCNCFPEEEKCFCEPEDIQDPLCDELCRTVIAAAVLFSFIVSVLLSAFCIHCYHKFAHKPPISSAEMTFRRPAQAFPVSYSSSGARRPSLDSMENQVSVDAFKILEDPKWEFPRKNLVLGKTLGEGEFGKVVKATAFHLKGRAGYTTVAVKMLKENASPSELRDLLSEFNVLKQVNHPHVIKLYGACSQDGPLLLIVEYAKYGSLRGFLRESRKVGPGYLGSGGSRNSSSLDHPDERALTMGDLISFAWQISQGMQYLAEMKLVHRDLAARNILVAEGRKMKISDFGLSRDVYEEDSYVKRSQGRIPVKWMAIESLFDHIYTTQSDVWSFGVLLWEIVTLGGNPYPGIPPERLFNLLKTGHRMERPDNCSEEMYRLMLQCWKQEPDKRPVFADISKDLEKMMVKRRDYLDLAASTPSDSLIYDDGLSEEETPLVDCNNAPLPRALPSTWIENKLYGRISHAFTRF

SEQ ID NO: 835463 - protein, 1114 aa, Homo sapiens
MAKATSGAAGLRLLLLLLLPLLGKVALGLYFSRDAYWEKLYVDQAAGTPLLYVHALRDAPEEVPSFRLGQHLYGTYRTRLHENNWICIQEDTGLLYLNRSLDHSSWEKLSVRNRGFPLLTVYLKVFLSPTSLREGECQWPGCARVYFSFFNTSFPACSSLKPRELCFPETRPSFRIRENRPPGTFHQFRLLPVQFLCPNISVAYRLLEGEGLPFRCAPDSLEVSTRWALDREQREKYELVAVCTVHAGAREEVVMVPFPVTVYDEDDSAPTFPAGVDTASAVVEFKRKEDTVVATLRVFDADVVPASGELVRRYTSTLLPGDTWAQQTFRVEHWPNETSVQANGSFVRATVHDYRLVLNRNLSISENRTMQLAVLVNDSDFQGPGAGVLLLHFNVSVLPVSLHLPSTYSLSVSRRARRFAQIGKVCVENCQAFSGINVQYKLHSSGANCSTLGVVTSAEDTSGILFVNDTKALRRPKCAELHYMVVATDQQTSRQAQAQLLVTVEGSYVAEEAGCPLSCAVSKRRLECEECGGLGSPTGRCEWRQGDGKGITRNFSTCSPSTKTCPDGHCDVVETQDINICPQDCLRGSIVGGHEPGEPRGIKAGYGTCNCFPEEEKCFCEPEDIQDPLCDELCRTVIAAAVLFSFIVSVLLSAFCIHCYHKFAHKPPISSAEMTFRRPAQAFPVSYSSSGARRPSLDSMENQVSVDAFKILEDPKWEFPRKNLVLGKTLGEGEFGKVVKATAFHLKGRAGYTTVAVKMLKENASPSELRDLLSEFNVLKQVNHPHVIKLYGACSQDGPLLLIVEYAKYGSLRGFLRESRKVGPGYLGSGGSRNSSSLDHPDERALTMGDLISFAWQISQGMQYLAEMKLVHRDLAARNILVAEGRKMKISDFGLSRDVYEEDSYVKRSQGRIPVKWMAIESLFDHIYTTQSDVWSFGVLLWEIVTLGGNPYPGIPPERLFNLLKTGHRMERPDNCSEEMYRLMLQCWKQEPDKRPVFADISKDLEKMMVKRRDYLDLAASTPSDSLIYDDGLSEEETPLVDCNNAPLPRALPSTWIENKLYGMSDPNWPGESPVPLTRADGTNTGFPRYPNDSVYANWMLSPSAAKLMDTFDS

SEQ ID NO: 835464 - protein, 545 aa, Homo sapiens
ALVPGAQLGAPLCSPGAHSFAARPSSPPPPCCSSSFPQPAAAMADSASESDTDGAGGNSSSSAAMQSSCSSTSGGGGGGGGGGGGGKSGGIVISPFRLEELTNRLASLQQENKVLKIELETYKLKCKALQEENRDLRKASVTIEDPKWEFPRKNLVLGKTLGEGEFGKVVKATAFHLKGRAGYTTVAVKMLKENASPSELRDLLSEFNVLKQVNHPHVIKLYGACSQDGPLLLIVEYAKYGSLRGFLRESRKVGPGYLGSGGSRNSSSLDHPDERALTMGDLISFAWQISQGMQYLAEMKLVHRDLAARNILVAEGRKMKISDFGLSRDVYEEDSYVKRSQGRIPVKWMAIESLFDHIYTTQSDVWSFGVLLWEIVTLGGNPYPGIPPERLFNLLKTGHRMERPDNCSEEMYRLMLQCWKQEPDKRPVFADISKDLEKMMVKRRDYLDLAASTPSDSLIYDDGLSEEETPLVDCNNAPLPRALPSTWIENKLYGMSDPNWPGESPVPLTRADGTNTGFPRYPNDSVYANWMLSPSAAKLMDTFDS

SEQ ID NO: 835465 - protein, 165 aa, Homo sapiens
MAKATSGAAGLRLLLLLLLPLLGKDVAEEAGCPLSCAVSKRRLECEECGGLGSPTGRCEWRQGDGKGITRNFSTCSPSTKTCPDGHCDVVETQDINICPQDCLRGQHCLARSTDALGRSPPRGTLHRLWAYFGNSLAISWLFPLWNGKATATHGLALFQGREGPP

SEQ ID NO: 835466 - protein, 516 aa, Homo sapiens
ALVPGAQLGAPLCSPGAHSFAARPSSPPPPCCSSSFPQPAAAMADSASESDTDGAGGNSSSSAAMQSSCSSTSGGGGGGGGGGGGGKSGGIVISPFRLEELTNRLASLQQENKVLKIELETYKLKCKALQEENRDLRKASVTIQARAEQEEEFISNTLFKKIQALQKEKETLAVNYEKEEEFLTNELSRKLMQLQHEKAELEQHLEQEQEFQVNKLMKKIKKLENDTISKQLTLEQLRREKIDLENTLEQEQEALVNRLWKRMDKLEAEKRILQEKLDQPVSAPPSPRDISMEIDSPENMMRHIRFLKNEVERLKKQLRAAQLQHSEKMAQYLEEERHMREENLRLQRKLQREMERREALCRQLSESESSLEMDDERYFNEMSAQGLRPRTVSSPIPYTPSPSSSRPISPGLSYASHTVGFTPPTSLTRAGMSYYNSPGLHVQHMGTSHGITRPSPRRSNSPDKFKRPTPPPSPNTQTPVQPPPPPPPPPMQPTVPSAATSQPTPSQHSAHPSSQP

SEQ ID NO: 835467 - protein, 1072 aa, Homo sapiens; identical to SEQ ID NO: 835462

SEQ ID NO: 835468 - protein, 1091 aa, Homo sapiens
RSSCSHAAVCGTCRRDAGPGGSWAPPYCTSIPYGSTVKEVPSFRLGQHLYGTYRTRLHENNWICIQEDTGLLYLNRSLDHSSWEKLSVRNRGFPLLTVYLKVFLSPTSLREGECQWPGCARVYFSFFNTSFPACSSLKPRELCFPETRPSFRIRENRPPGTFHQFRLLPVQFLCPNISVAYRLLEGEGLPFRCAPDSLEVSTRWALDREQREKYELVAVCTVHAGAREEVVMVPFPVTVYDEDDSAPTFPAGVDTASAVVEFKRKEDTVVATLRVFDADVVPASGELVRRYTSTLLPGDTWAQQTFRVEHWPNETSVQANGSFVRATVHDYRLVLNRNLSISENRTMQLAVLVNDSDFQGPGAGVLLLHFNVSVLPVSLHLPSTYSLSVSRRARRFAQIGKVCVENCQAFSGINVQYKLHSSGANCSTLGVVTSAEDTSGILFVNDTKALRRPKCAELHYMVVATDQQTSRQAQAQLLVTVEGSYVAEEAGCPLSCAVSKRRLECEECGGLGSPTGRCEWRQGDGKGITRNFSTCSPSTKTCPDGHCDVVETQDINICPQDCLRGSIVGGHEPGEPRGIKAGYGTCNCFPEEEKCFCEPEDIQDPLCDELCRTVIAAAVLFSFIVSVLLSAFCIHCYHKFAHKPPISSAEMTFRRPAQAFPVSYSSSGARRPSLDSMENQVSVDAFKILEDPKWEFPRKNLVLGKTLGEGEFGKVVKATAFHLKGRAGYTTVAVKMLKENASPSELRDLLSEFNVLKQVNHPHVIKLYGACSQDGPLLLIVEYAKYGSLRGFLRESRKVGPGYLGSGGSRNSSSLDHPDERALTMGDLISFAWQISQGMQYLAEMKLVHRDLAARNILVAEGRKMKISDFGLSRDVYEEDSYVKRSQGRIPVKWMAIESLFDHIYTTQSDVWSFGVLLWEIVTLGGNPYPGIPPERLFNLLKTGHRMERPDNCSEEMYRLMLQCWKQEPDKRPVFADISKDLEKMMVKRRDYLDLAASTPSDSLIYDDGLSEEETPLVDCNNAPLPRALPSTWIENKLYGMSDPNWPGESPVPLTRADGTNTGFPRYPNDSVYANWMLSPSAAKLMDTFDS

SEQ ID NO: 835469 - protein, 458 aa, Homo sapiens
MAKATSGAAGLRLLLLLLLPLLGKVALGLYFSRDAYWEKLYVDQAAGTPLLYVHALRDAPEEVPSFRLGQHLYGTYRTRLHENNWICIQEDTGLLYLNRSLDHSSWEKLSVRNRGFPLLTVYLKVFLSPTSLREGECQWPGCARVYFSFFNTSFPACSSLKPRELCFPETRPSFRIRENRPPGTFHQFRLLPVQFLCPNISVAYRLLEGEGLPFRCAPDSLEVSTRWALDREQREKYELVAVCTVHAGAREEVVMVPFPVTVYDEDDSAPTFPAGVDTASAVVEFKRKEDTVVATLRVFDADVVPASGELVRRYTSTLLPGDTWAQQTFRVEHWPNETSVQANGSFVRATVHDYRLVLNRNLSISENRTMQLAVLVNDSDFQGPGAGVLLLHFNVSVLPVSLHLPSTYSLSVSRRARRFAQIGKVCVENCLADLTGDAVSGRDEARSSGLGSQKHPGS

SEQ ID NO: 835470 - protein, 898 aa, Homo sapiens
MSWFVDLAGKAEDLLNRVDQGAATALSRKDNASNIYSKNTDYTELHQQNTDLIYQTGPKSTYISSAADNIRNQKATILAGTANVKVGSRTPVEASHPVENASVPRPSSHFVRRKKSEPDDELLFDFLNSSQKEPTGRVEIRKEKGKTPVFQSSQTSSVSSVNPSVTTIKTIEENSFGSQTHEAASNSDSSHEGQEESSKENVSSNAACPDHTPTPNDDGKSHELSNLRLENQLLRNEVQSLNQEMASLLQRSKETQEELNKARARVEKWNADHSKSDRMTRGLRAQVDDLTEAVAAKDSQLAVLKVRLQEADQLLSTRTEALEALQSEKSRIMQDQSEGNSLQNQALQTLQERLHEADATLKREQESYKQMQSEFAARLNKVEMERQNLAEAITLAERKYSDEKKRVDELQQQVKLYKLNLESSKQELIDYKQKATRILQSKEKLINSLKEGSGFEGLDSSTASSMELEELRHEKEMQREEIQKLMGQIHQLQIRIEDPKWEFPRKNLVLGKTLGEGEFGKVVKATAFHLKGRAGYTTVAVKMLKENASPSELRDLLSEFNVLKQVNHPHVIKLYGACSQDGPLLLIVEYAKYGSLRGFLRESRKVGPGYLGSGGSRNSSSLDHPDERALTMGDLISFAWQISQGMQYLAEMKLVHRDLAARNILVAEGRKMKISDFGLSRDVYEEDSYVKRSQGRIPVKWMAIESLFDHIYTTQSDVWSFGVLLWEIVTLGGNPYPGIPPERLFNLLKTGHRMERPDNCSEEMYRLMLQCWKQEPDKRPVFADISKDLEKMMVKRRDYLDLAASTPSDSLIYDDGLSEEETPLVDCNNAPLPRALPSTWIENKLYGMSDPNWPGESPVPLTRADGTNTGFPRYPNDSVYANWMLSPSAAKLMDTFDS

SEQ ID NO: 835471 - protein, 435 aa, Homo sapiens
MEELIVELRLFLELLDHEYLTSTVREKKAVITNILLRIQSSKGFDVKDHAQKQETANSLPAPPQMPLPEIPQPWLEDPKWEFPRKNLVLGKTLGEGEFGKVVKATAFHLKGRAGYTTVAVKMLKENASPSELRDLLSEFNVLKQVNHPHVIKLYGACSQDGPLLLIVEYAKYGSLRGFLRESRKVGPGYLGSGGSRNSSSLDHPDERALTMGDLISFAWQISQGMQYLAEMKLVHRDLAARNILVAEGRKMKISDFGLSRDVYEEDSYVKRSQGRIPVKWMAIESLFDHIYTTQSDVWSFGVLLWEIVTLGGNPYPGIPPERLFNLLKTGHRMERPDNCSEEMYRLMLQCWKQEPDKRPVFADISKDLEKMMVKRRDYLDLAASTPSDSLIYDDGLSEEETPLVDCNNAPLPRALPSTWIENKLYGRISHAFTRF

SEQ ID NO: 835472 - protein, 542 aa, Homo sapiens
ALVPGAQLGAPLCSPGAHSFAARPSSPPPPCCSSSFPQPAAAMADSASESDTDGAGGNSSSSAAMQSSCSSTSGGGGGGGGGGGGGKSGGIVISPFRLEELTNRLASLQQENKVLKIELETYKLKCKALQEENRDLRKASVTIILENRPSVLFLPVPWRLPRNRPSLDSMENQVSVDAFKILEDPKWEFPRKNLVLGKTLGEGEFGKVVKATAFHLKGRAGYTTVAVKMLKENASPSELRDLLSEFNVLKQVNHPHVIKLYGACSQDGPLLLIVEYAKYGSLRGFLRESRKVGPGYLGSGGSRNSSSLDHPDERALTMGDLISFAWQISQGMQYLAEMKLVHRDLAARNILVAEGRKMKISDFGLSRDVYEEDSYVKRSQGRIPVKWMAIESLFDHIYTTQSDVWSFGVLLWEIVTLGGNPYPGIPPERLFNLLKTGHRMERPDNCSEEMYRLMLQCWKQEPDKRPVFADISKDLEKMMVKRRDYLDLAASTPSDSLIYDDGLSEEETPLVDCNNAPLPRALPSTWIENKLYGRISHAFTRF

SEQ ID NO: 835473 - protein, 121 aa, Homo sapiens
KLNLEALGCLDLQLPGTGAAGNMWPEWNGAGQGWGRWVGMKALRGGGQGARGGCCLQAQLGAVPGLRLCGNLYPQAITGRSSCLAKVFPCAPLDRESLCGKLPGVQWHQRPVQAAFLWCQL

SEQ ID NO: 835474 - protein, 1114 aa, Homo sapiens; identical to SEQ ID NO: 835463

SEQ ID NO: 835475 - protein, 1106 aa, Homo sapiens
MAKATSGAAGLRLLLLLLLPLLGKVALGLYFSRDAYWEKLYVDQAAGTPLLYVHALRDAPEEVPSFRLGQHLYGTYRTRLHENNWICIQEDTGLLYLNRSLDHSSWEKLSVRNRGFPLLTVYLKVFLSPTSLREGECQWPGCARVYFSFFNTSFPACSSLKPRELCFPETRPSFRIRENRPPGTFHQFRLLPVQFLCPNISVAYRLLEGEGLPFRCAPDSLEVSTRWALDREQREKYELVAVCTVHAGAREEVVMVPFPVTVYDEDDSAPTFPAGVDTASAVVEFKRKEDTVVATLRVFDADVVPASGELVRRYTSTLLPGDTWAQQTFRVEHWPNETSVQANGSFVRATVHDYRLVLNRNLSISENRTMQLAVLVNDSDFQGPGAGVLLLHFNVSVLPVSLHLPSTYSLSVSRRARRFAQIGKVCVENCQAFSGINVQYKLHSSGANCSTLGVVTSAEDTSGILFVNDTKALRRPKCAELHYMVVATDQQTSRQAQAQLLVTVEGSYVAEEAGCPLSCAVSKRRLECEECGGLGSPTGRCEWRQGDGKGITRNFSTCSPSTKTCPDGHCDVVETQDINICPQDCLRGSIVGGHEPGEPRGIKAGYGTCNCFPEEEKCFCEPEDIQDPLCDELCRTVIAAAVLFSFIVSVLLSAFCIHCYHKFAHKPPISSAEMTFRRPAQAFPVSYSSSGARRPSLDSMENQVSVDAFKILEDPKWEFPRKNLVLGKTLGEGEFGKVVKATAFHLKGRAGYTTVAVKMLKENASPSELRDLLSEFNVLKQVNHPHVIKLYGACSQDGPLLLIVEYAKYGSLRGFLRESRKVGPGYLGSGGSRNSSSLDHPDERALTMGDLISFAWQISQGMQYLAEMKLVHRDLAARNILVAEGRKMKISDFGLSRDVYEEDSYVKRSQGRIPVKWMAIESLFDHIYTTQSDVWSFGVLLWEIVTLGGNPYPGIPPERLFNLLKTGHRMERPDNCSEEMYRLMLQCWKQEPDKRPVFADISKDLEKMMVKRRDYLDLAASTPSDSLIYDDGLSEEETPLVDCNNAPLPRALPSTWIENKLYDAQHSSSLVGAAFGKSQQLFWLCCQHCNFAEKSRITKTLPALQT

SEQ ID NO: 835476 - protein, 99 aa, Homo sapiens
RFVHRIVSHGSSGSGTWGSPGLEAGCITAQRTTALEDPGPILIQADGSKIAHLAPIRFLKNEVERLKKQLRAAQLQHSEKMAQYLEEERLMGVLLPSAT

SEQ ID NO: 835477 - protein, 516 aa, Homo sapiens; identical to SEQ ID NO: 835466

SEQ ID NO: 835478 - protein, 1072 aa, Homo sapiens; identical to SEQ ID NO: 835462

SEQ ID NO: 835479 - protein, 805 aa, Homo sapiens
QAGAMASGSVAECLQQETTCPVCLQYFAEPMMLDCGHNICCACLARCWGTAETNVSCPQCRETFPQRHMRPNRHLANVTQLVKQLRTERPSGPGGEMGVCEKHREPLKLYCEEDQMPICVVCDRSREHRGHSVLPLEEAVEGFKEQIQNQLDHLKRVKDLKKRRRAQGEQARAELLSLTQMEREKIVWEFEQLYHSLKEHEYRLLARLEELDLAIYNSINGAITQFSCNISHLSSLIAQLEEKQQQPTRELLQDIGDTLSRAERIRIPEPWITPPDLQEKIHIFAPKCLFLTESLKQFTEKMQSDMEKIQELREAQLYSGGSIVGGHEPGEPRGIKAGYGTCNCFPEEEKCFCEPEDIQDPLCDELCRTVIAAAVLFSFIVSVLLSAFCIHCYHKFAHKPPISSAEMTFRRPAQAFPVSYSSSGARRPSLDSMENQVSVDAFKILEDPKWEFPRKNLVLGKTLGEGEFGKVVKATAFHLKGRAGYTTVAVKMLKENASPSELRDLLSEFNVLKQVNHPHVIKLYGACSQDGPLLLIVEYAKYGSLRGFLRESRKVGPGYLGSGGSRNSSSLDHPDERALTMGDLISFAWQISQGMQYLAEMKLVHRDLAARNILVAEGRKMKISDFGLSRDVYEEDSYVKRSQGRIPVKWMAIESLFDHIYTTQSDVWSFGVLLWEIVTLGGNPYPGIPPERLFNLLKTGHRMERPDNCSEEMYRLMLQCWKQEPDKRPVFADISKDLEKMMVKRRDYLDLAASTPSDSLIYDDGLSEEETPLVDCNNAPLPRALPSTWIENKLYGRISHAFTRF

SEQ ID NO: 835480 - protein, 599 aa, Homo sapiens
QRTMESGSTAASEEARSLRECELYVQKHNIQALLKDSIVQLCTARPERPMAFLREYFERLEKEEAKQIQNLQKAGTRTDSREDEISPPPPNPVVKGRRRRGAISAEVYTEEDAASYVRKVIPKDYKTMAALAKAIEKNVLFSHLDDNERSDIFDAMFSVSFIAGETVIQQGDEGDNFYVIDQGETDVYVNNEWATSVGEGGSFGELALIYGTPRAATVKAKTNVKLWGIDRDSYRRILMEDPKWEFPRKNLVLGKTLGEGEFGKVVKATAFHLKGRAGYTTVAVKMLKENASPSELRDLLSEFNVLKQVNHPHVIKLYGACSQDGPLLLIVEYAKYGSLRGFLRESRKVGPGYLGSGGSRNSSSLDHPDERALTMGDLISFAWQISQGMQYLAEMKLVHRDLAARNILVAEGRKMKISDFGLSRDVYEEDSYVKRSQGRIPVKWMAIESLFDHIYTTQSDVWSFGVLLWEIVTLGGNPYPGIPPERLFNLLKTGHRMERPDNCSEEMYRLMLQCWKQEPDKRPVFADISKDLEKMMVKRRDYLDLAASTPSDSLIYDDGLSEEETPLVDCNNAPLPRALPSTWIENKLYGRISHAFTRF

SEQ ID NO: 835481 - protein, 963 aa, Homo sapiens
MAKATSGAAGLRLLLLLLLPLLGKVALGLYFSRDAYWEKLYVDQAAGTPLLYVHALRDAPEEVPSFRLGQHLYGTYRTRLHENNWICIQEDTGLLYLNRSLDHSSWEKLSVRNRGFPLLTVYLKVFLSPTSLREGECQWPGCARVYFSFFNTSFPACSSLKPRELCFPETRPSFRIRENRPPGTFHQFRLLPVQFLCPNISVAYRLLEGEGLPFRCAPDSLEVSTRWALDREQREKYELVAVCTVHAGAREEVVMVPFPVTVYDEDDSAPTFPAGVDTASAVVEFKRKEDTVVATLRVFDADVVPASGELVRRYTSTLLPGDTWAQQTFRVEHWPNETSVQANGSFVRATVHDYRLVLNRNLSISENRTMQLAVLVNDSDFQGPGAGVLLLHFNVSVLPVSLHLPSTYSLSVSRRARRFAQIGKVCVENCQAFSGINVQYKLHSSGANCSTLGVVTSAEDTSGILFVNDTKALRRPKCAELHYMVVATDQQTSRQAQAQLLVTVEGSYVAEEAGCPLSCAVSKRRLECEECGGLGSPTGRCEWRQGDGKGITRNFSTCSPSTKTCPDGHCDVVETQDINICPQDCLRGSIVGGHEPGEPRGIKAGYGTCNCFPEEEKCFCEPEDIQDPLCDELCRTVIAAAVLFSFIVSVLLSAFCIHCYHKFAHKPPISSAEMTFRRPAQAFPVSYSSSGARRPSLDSMENQVSVDAFKILEDPKWEFPRKNLVLGKTLGEGEFGKVVKATAFHLKGRAGYTTVAVKMLKENASPSELRDLLSEFNVLKQVNHPHVIKLYGACSQDGPLLLIVEYAKYGSLRGFLRESRKVGPGYLGSGGSRNSSSLDHPDERALTMGDLISFAWQISQGMQYLAEMKLVHRDLAARNILVAEGRKMKISDFGLSRDVYEEDSYVKRSQVRIRFTGGIDSFDHFIHSKCCWSLALRGNPALGNPSGFPGGPLDAGGAPLRFP

SEQ ID NO: 835482 - protein, 127 aa, Homo sapiens
RLQWGGASLRGWDSSLGTALLIKAWLLQESRLQSRKFSPPATSSPTPCKVPSTPASSWEGSMKRVGSPTRAPGIRGPLSKRLALECSRRADACATPSSAWGLTTHLTRGPTWGKPEGPPSPQPQDQA

SEQ ID NO: 835483 - protein, 190 aa, Homo sapiens
VYIYICKCLQYISKIETILCLPGERVVAFAAVEGVFFSGSFAAIFWLKKRGLMPGLTFSNELISRDEGLHCDFACLMFQYLVNKPSEERVREIIVDAVKIEQEFLTEALPVGLIGMNCILMKQYIEFVADRLLVELGFSKVFQAENPFDFMENISLEGKTNFFEKRVSEYQRFAVMAETTDNVFTLDADF

SEQ ID NO: 835484 - protein, 351 aa, Homo sapiens
MGDPERPEAAGLDQDERSSSDTNESEIKSNEEPLLRKSSRRFVIFPIQYPDIWKMYKQAQASFWTAEEVDLSKDLPHWNKLKADEKYFISHILAFFAASDGIVNENLVERFSQEVQVPEARCFYGFQILIENVHSEMYSLLIDTYIRDPKKREFLFNAIETMPYVKKKADWALRWIADRKSTFGERVVAFAAVEGVFFSGSFAAIFWLKKRGLMPGLTFSNELISRDEGLHCDFACLMFQYLVNKPSEERVREIIVDAVKIEQEFLTEALPVGLIGMNCILMKQYIEFVADRLLVELGFSKVFQAENPFDFMENISLEGKTNFFEKRVSEYQRFAVMAETTDNVFTLDADF

SEQ ID NO: 835485 - protein, 351 aa, Homo sapiens; identical to SEQ ID NO: 835484

SEQ ID NO: 835486 - protein, 351 aa, Homo sapiens; identical to SEQ ID NO: 835484

SEQ ID NO: 835487 - protein, 351 aa, Homo sapiens; identical to SEQ ID NO: 835484

SEQ ID NO: 835488 - protein, 393 aa, Homo sapiens
RLVRGWVNRPRELKKDPKGVILKNSASVGIIQRDESPMEKGLSGLRGRDFELSDVFYFSKKGLEAIVEDEVTQRFSSEELVSWNLLTRTNVNFQYISLRLTMVWVLGVIVRYCVLLPLRVTLAFIGISLLVIGTTLVGQLPDSSLKNWLSELVHLTCCRICVRALSGTIHYHNKQYRPQKGGICVANHTSPIDVLILTTDGCYAMVGQVHGGLMGIIQRAMVKACPHVWFERSEMKDRHLVTKRLKEHIADKKKLPILIFPEGTCINNTSVMMFKKGSFEIGGTIHPVAIKYNPQFGDAFWNSSKYNMVSYLLRMMTSWAIVCDVWYMPPMTREEGEDAVQFANRVKSAIAIQGGLTELPWDGGLKRAKVKDIFKEEQQKNYSKMIVGNGSLS

SEQ ID NO: 835489 - protein, 82 aa, Homo sapiens
SYGQGCPHVWFERSEMKDDTWLLRGNQVSIPHVWFERSEMKDRHLVTKRKAVKLLSIHWSSIKADQSWPCYQRGPSSTESQN

SEQ ID NO: 835490 - protein, 244 aa, Homo sapiens
RLVRGWVNRPRELKKDPKGVILKNSASVGIIQRDESPMEKGLSGLRGRDFELSDVFYFSKKGLEAIVEDEVTQRFSSEELVSWNLLTRTNVNFQYISLRLTMVWVLGVIVRYCVLLPLRVTLAFIGISLLVIGTTLVGQLPDSSLKNWLSELVHLTCCRICVRALSGTIHYHNKQYRPQKGGICVANHTSPIDVLILTTDGCYAMVGQVHGGLMGIIQRAMVKACPHVWFERSEMKDRHLVTKR

SEQ ID NO: 835491 - protein, 76 aa, Homo sapiens
DTGRRAGRRVRREPRPPQQRVCACPGAGFRGFPPLWVHSWTSGVLVWSTPFESRREKLLCVLSVLKEGVRWPSYPS

SEQ ID NO: 835492 - protein, 76 aa, Homo sapiens; identical to SEQ ID NO: 835491

SEQ ID NO: 835493 - protein, 76 aa, Homo sapiens; identical to SEQ ID NO: 835491

SEQ ID NO: 835494 - protein, 75 aa, Homo sapiens
MVKHMRILHVNGFNGDENASKVQDIKNNLKEAIETIVAAMSNLLPPVELANPENQFREDYLLSVMNVPDYDFPPE

SEQ ID NO: 835495 - protein, 42 aa, Homo sapiens
RRRRESSSQEEEVIDGFAIASFSTLEALEKDMALKPHERKEK

SEQ ID NO: 835496 - protein, 456 aa, Homo sapiens
PPSPAGAAGEPGVAGCVGLPRRVSPRALPADSLGTQAQGLEPRDESAQGRCEPGGLPANLSLKPQKRALRPGLPCLRPSMRLSVRRVLLAAGCALVLVLAVQLGQQVLECRAVLAGLRSPRGAMRPEQEELVMVGTNHVEYRYGKAMPLIFVGGVPRSGTTLMRAMLDAHPEVRCGEETRIIPRVLAMRQAWSKSGREKLRLDEAGVTDEVLDAAMQAFILEVIAKHGEPARVLCNKDPFTLKSSVYLSRLFPNSKFLLMVRDGRASVHSMITRKVTIAGFDLSSYRDCLTKWNKAIEVMYAQCMEVGKEKCLPVYYEQLVLHPRRSLKLILDFLGIAWSDAVLHHEDLIGKPGGVSLSKIERSTDQVIKPVNLEALSKWTGHIPGDVVRDMAQIAPMLAQLGYDPYANPPNYGNPDPFVINNTQRVLKGDYKTPANLKGYFQVNQNSTSSHLGSS

SEQ ID NO: 835497 - protein, 500 aa, Homo sapiens
PPSPAGAAGEPGVAGCVGLPRRVSPRALPADSLGTQAQGLEPRDESAQGRCEPGGLPANLSLKPQKRALRPGLPCLRPSMRLSVRRVLLAAGCALVLVLAVQLGQQVLECRAVLAGLRSPRGAMRPEQEELVMVGTNHVEYRYGKAMPLIFVGGVPRSGTTLMRAMLDAHPEVRCGEETRIIPRVLAMRQAWSKSGREKLRLDEAGVTDEVLDAAMQAFILEVIAKHGEPARVLCNKDPFTLKSSVYLSRLFPNSKFLLMVRDGRASVHSMITRKVTIAGFDLSSYRDCLTKWNKAIEVMYAQCMEVGKEKCLPVYYEQLVLHPRRSLKLILDFLGIAWSDAVLHHEDLIGKPGGVSLSKIERSTDQVIKPVNLEALSKWTGHIPGDVVRDMAQIAPMLAQLGYDPYANPPNYGNPDPFVINNTQRVSVHLYLWKCTLGDMGLLQMWKLQPPEEMFSLSIPGHLICSCLMDTVNYMIACISILLGLQGSSKPTGSLSLIL

SEQ ID NO: 835498 - protein, 360 aa, Homo sapiens
PPSPAGAAGEPGVAGCVGLPRRVSPRALPADSLGTQAQGLEPRDESAQGRCEPGGLPANLSLKPQKRALRPGLPCLRPSMRLSVRRVLLAAGCALVLVLAVQLGQQVLECRAVLAGLRSPRGAMRPEQEELVMVGTNHVEYRYGKAMPLIFVGGVPRSGTTLMRAMLDAHPEVRCGEETRIIPRVLAMRQAWSKSGREKLRLDEAGVTDEVLDAAMQAFILEVIAKHGEPARVLCNKDPFTLKSSVYLSRLFPNSKFLLMVRDGRASVHSMITRKVTIAGFDLSSYRDCLTKWNKAIEVMYAQCMEVGKEKCLPVYYEQLVLHPRRSLKLILDFLGIAWSDAVLHHEDLIGKPGGVSLSK

SEQ ID NO: 835499 - protein, 456 aa, Homo sapiens; identical to SEQ ID NO: 835496

SEQ ID NO: 835500 - protein, 456 aa, Homo sapiens; identical to SEQ ID NO: 835496

SEQ ID NO: 835501 - protein, 241 aa, Homo sapiens
MQAFILEVIAKHGEPARVLCNKDPFTLKSSVYLSRLFPNSKFLLMVRDGRASVHSMITRKVTIAGFDLSSYRDCLTKWNKAIEVMYAQCMEVGKEKCLPVYYEQLVLHPRRSLKLILDFLGIAWSDAVLHHEDLIGKPGGVSLSKIERSTDQVIKPVNLEALSKWTGHIPGDVVRDMAQIAPMLAQLGYDPYANPPNYGNPDPFVINNTQRVLKGDYKTPANLKGYFQVNQNSTSSHLGSS

SEQ ID NO: 835502 - protein, 92 aa, Homo sapiens
MPSSTGRTMYVLPFSMGPVGSPLSRIGVQLTDSAYVVASMRIMTRLGTPVLQALGDGDFVKCLHSVGQPLTGQGKHLLCPKGNTEAFLYSEE

SEQ ID NO: 835503 - protein, 235 aa, Homo sapiens
MAALYRPGLRLNWHGLSPLGWPSCRSIQTLRVLSGDLGQLPTGIRDFVEHSARLCQPEGIHICDGTEAENTATLTLLEQQGLIRKLPKYNNCWLARTDPKDVARVESKTVIVTPSQRDTVPLPPGGARGQLGNWMSPADFQRAVDERFPGCMQGRTMYVLPFSMGPVGSPLSRIGVQLTDSAYVVASMRIMTRLGTPVLQALGDGDFVKCLHSVGQPLTGQGEPVSQLACTKRKT

SEQ ID NO: 835504 - protein, 106 aa, Homo sapiens
KGSENGIAEVLGERVPVKLTRRAGVRVQRKGLPVTLFIGDLGVPLVYEAFNWRHGVFVGSAMRSESTAAAEHKGEHPHHSSLSCVCTQHVLSPFLSQTFLLSTPGV

SEQ ID NO: 835505 - protein, 84 aa, Homo sapiens
CMCVLGVDMTLEIIVFVFPLPGDKEPCAHPNSRFCAPARQCPIMDPAWEAPEGVPIDAIIFGGRRPKGKQHMSSMFLAKGLSLY

SEQ ID NO: 835506 - protein, 640 aa, Homo sapiens
MAALYRPGLRLNWHGLSPLGWPSCRSIQTLRVLSGDLGQLPTGIRDFVEHSARLCQPEGIHICDGTEAENTATLTLLEQQGLIRKLPKYNNCWLARTDPKDVARVESKTVIVTPSQRDTVPLPPGGARGQLGNWMSPADFQRAVDERFPGCMQGRTMYVLPFSMGPVGSPLSRIGVQLTDSAYVVASMRIMTRLGTPVLQALGDGDFVKCLHSVGQPLTGQGEPVSQWPCNPEKTLIGHVPDQREIISFGSGYGGNSLLGKKCFALRIASRLARDEGWLAEHMLILGITSPAGKKRYVAAAFPSACGKTNLAMMRPALPGWKVECVGDDIAWMRFDSEGRLRAINPENGFFGVAPGTSATTNPNAMATIQSNTIFTNVAETSDGGVYWEGIDQPLPPGVTVTSWLGKPWKPGDKEPCAHPNSRFCAPARQCPIMDPAWEAPEGVPIDAIIFGGRRPKGVPLVYEAFNWRHGVFVGSAMRSESTAAAEHKGKIIMHDPFAMRPFFGYNFGHYLEHWLSMEGRKGAQLPRIFHVNWFRRDEAGHFLWPGFGENARVLDWICRRLEGEDSARETPIGLVPKEGALDLSGLRAIDTTQLFSLPKDFWEQEVRDIRSYLTEQVNQDLPKEVLAELEALERRVHKM

SEQ ID NO: 835507 - protein, 640 aa, Homo sapiens; identical to SEQ ID NO: 835506

SEQ ID NO: 835508 - protein, 497 aa, Homo sapiens
MAALYRPGLRLNWHGLSPLGWPSCRSIQTLRVLSGDLGQLPTGIRDFVEHSARLCQPEGIHICDGTEAENTATLTLLEQQGLIRKLPKYNNCWLARTDPKDVARVESKTVIVTPSQRDTVPLPPGGARGQLGNWMSPADFQRAVDERFPGCMQGRTMYVLPFSMGPVGSPLSRIGVQLTDSAYVVASMRIMTRLGTPVLQALGDGDFVKCLHSVGQPLTGQGEPVSQWPCNPEKTLIGHVPDQREIISFGSGYGGNSLLGKKCFALRIASRLARDEGWLAEHMLILGITSPAGKKRYVAAAFPSACGKTNLAMMRPALPGWKVECVGDDIAWMRFDSEGRLRAINPENGFFGVAPGTSATTNPNAMATIQSNTIFTNVAETSDGGVYWEGIDQPLPPGVTVTSWLGKPWKPGDKEPCAHPNSRFCAPARQCPIMDPAWEAPEGVPIDAIIFGGRRPKGVPLVYEAFNWRHGVFVGSAMRSESTAAAEHKGLLGTGGS

SEQ ID NO: 835509 - protein, 498 aa, Homo sapiens
MAALYRPGLRLNWHGLSPLGWPSCRSIQTLRVLSGDLGQLPTGIRDFVEHSARLCQPEGIHICDGTEAENTATLTLLEQQGLIRKLPKYNNCWLARTDPKDVARVESKTVIVTPSQRDTVPLPPGGARGQLGNWMSPADFQRAVDERFPGCMQGRTMYVLPFSMGPVGSPLSRIGVQLTDSAYVVASMRIMTRLGTPVLQALGDGDFVKCLHSVGQPLTGQGEPVSQWPCNPEKTLIGHVPDQREIISFGSGYGGNSLLGKKCFALRIASRLARDEGWLAEHMLILGITSPAGKKRYVAAAFPSACGKTNLAMMRPALPGWKVECVGDDIAWMRFDSEGRLRAINPENGFFGVAPGTSATTNPNAMATIQSNTIFTNVAETSDGGVYWEGIDQPLPPGVTVTSWLGKPWKPGDKEPCAHPNSRFCAPARQCPIMDPAWEAPEGVPIDAIIFGGRRPKEMGFRHIAQADLKFLWSSELPASASQSTGITGVSYHAYYTF

SEQ ID NO: 835510 - protein, 441 aa, Homo sapiens
MAALYRPGLRLNWHGLSPLGWPSCRSIQTLRVLSGDLGQLPTGIRDFVEHSARLCQPEGIHICDGTEAENTATLTLLEQQGLIRKLPKYNNCWLARTDPKDVARVESKTVIVTPSQRDTVPLPPGGARGQLGNWMSPADFQRAVDERFPGCMQGRTMYVLPFSMGPVGSPLSRIGVQLTDSAYVVASMRIMTRLGTPVLQALGDGDFVKCLHSVGQPLTGQGEPVSQWPCNPEKTLIGHVPDQREIISFGSGYGGNSLLGKKCFALRIASRLARDEGWLAEHMLILGITSPAGKKRYVAAAFPSACGKTNLAMMRPALPGWKVECVGDDIAWMRFDSEGRLRAINPENGFFGVAPGTSATTNPNAMATIQSNTIFTNVAETSDGGVYWEGIDQPLPPGVTVTSWLGKPWKPGMCGGEGVAQPPGLSTLMVEKLSPQPPTIF

SEQ ID NO: 835511 - protein, 441 aa, Homo sapiens; identical to SEQ ID NO: 835510

SEQ ID NO: 835512 - protein, 664 aa, Homo sapiens
MAALYRPGLRLTPSESELPASCCSTLPPTPKLSRLNWHGLSPLGWPSCRSIQTLRVLSGDLGQLPTGIRDFVEHSARLCQPEGIHICDGTEAENTATLTLLEQQGLIRKLPKYNNCWLARTDPKDVARVESKTVIVTPSQRDTVPLPPGGARGQLGNWMSPADFQRAVDERFPGCMQGRTMYVLPFSMGPVGSPLSRIGVQLTDSAYVVASMRIMTRLGTPVLQALGDGDFVKCLHSVGQPLTGQGEPVSQWPCNPEKTLIGHVPDQREIISFGSGYGGNSLLGKKCFALRIASRLARDEGWLAEHMLILGITSPAGKKRYVAAAFPSACGKTNLAMMRPALPGWKVECVGDDIAWMRFDSEGRLRAINPENGFFGVAPGTSATTNPNAMATIQSNTIFTNVAETSDGGVYWEGIDQPLPPGVTVTSWLGKPWKPGDKEPCAHPNSRFCAPARQCPIMDPAWEAPEGVPIDAIIFGGRRPKGVPLVYEAFNWRHGVFVGSAMRSESTAAAEHKGKIIMHDPFAMRPFFGYNFGHYLEHWLSMEGRKGAQLPRIFHVNWFRRDEAGHFLWPGFGENARVLDWICRRLEGEDSARETPIGLVPKEGALDLSGLRAIDTTQLFSLPKDFWEQEVRDIRSYLTEQVNQDLPKEVLAELEALERRVHKM

SEQ ID NO: 835513 - protein, 643 aa, Homo sapiens
MVLREAAGPWGQGLNWHGLSPLGWPSCRSIQTLRVLSGDLGQLPTGIRDFVEHSARLCQPEGIHICDGTEAENTATLTLLEQQGLIRKLPKYNNCWLARTDPKDVARVESKTVIVTPSQRDTVPLPPGGARGQLGNWMSPADFQRAVDERFPGCMQGRTMYVLPFSMGPVGSPLSRIGVQLTDSAYVVASMRIMTRLGTPVLQALGDGDFVKCLHSVGQPLTGQGEPVSQWPCNPEKTLIGHVPDQREIISFGSGYGGNSLLGKKCFALRIASRLARDEGWLAEHMLILGITSPAGKKRYVAAAFPSACGKTNLAMMRPALPGWKVECVGDDIAWMRFDSEGRLRAINPENGFFGVAPGTSATTNPNAMATIQSNTIFTNVAETSDGGVYWEGIDQPLPPGVTVTSWLGKPWKPGDKEPCAHPNSRFCAPARQCPIMDPAWEAPEGVPIDAIIFGGRRPKGVPLVYEAFNWRHGVFVGSAMRSESTAAAEHKGKIIMHDPFAMRPFFGYNFGHYLEHWLSMEGRKGAQLPRIFHVNWFRRDEAGHFLWPGFGENARVLDWICRRLEGEDSARETPIGLVPKEGALDLSGLRAIDTTQLFSLPKDFWEQEVRDIRSYLTEQVNQDLPKEVLAELEALERRVHKM

SEQ ID NO: 835514 - protein, 657 aa, Homo sapiens
FKNWGTNWSGLEKARRLSGLGGQVRFGTDEASSEGNPWTDKVGVYVRVCIFVACLYLPTGIRDFVEHSARLCQPEGIHICDGTEAENTATLTLLEQQGLIRKLPKYNNCWLARTDPKDVARVESKTVIVTPSQRDTVPLPPGGARGQLGNWMSPADFQRAVDERFPGCMQGRTMYVLPFSMGPVGSPLSRIGVQLTDSAYVVASMRIMTRLGTPVLQALGDGDFVKCLHSVGQPLTGQGEPVSQWPCNPEKTLIGHVPDQREIISFGSGYGGNSLLGKKCFALRIASRLARDEGWLAEHMLILGITSPAGKKRYVAAAFPSACGKTNLAMMRPALPGWKVECVGDDIAWMRFDSEGRLRAINPENGFFGVAPGTSATTNPNAMATIQSNTIFTNVAETSDGGVYWEGIDQPLPPGVTVTSWLGKPWKPGDKEPCAHPNSRFCAPARQCPIMDPAWEAPEGVPIDAIIFGGRRPKGVPLVYEAFNWRHGVFVGSAMRSESTAAAEHKGKIIMHDPFAMRPFFGYNFGHYLEHWLSMEGRKGAQLPRIFHVNWFRRDEAGHFLWPGFGENARVLDWICRRLEGEDSARETPIGLVPKEGALDLSGLRAIDTTQLFSLPKDFWEQEVRDIRSYLTEQVNQDLPKEVLAELEALERRVHKM

SEQ ID NO: 835515 - protein, 633 aa, Homo sapiens
YDSFLAHDSFTTRFLPTTRIQTLRVLSGDLGQLPTGIRDFVEHSARLCQPEGIHICDGTEAENTATLTLLEQQGLIRKLPKYNNCWLARTDPKDVARVESKTVIVTPSQRDTVPLPPGGARGQLGNWMSPADFQRAVDERFPGCMQGRTMYVLPFSMGPVGSPLSRIGVQLTDSAYVVASMRIMTRLGTPVLQALGDGDFVKCLHSVGQPLTGQGEPVSQWPCNPEKTLIGHVPDQREIISFGSGYGGNSLLGKKCFALRIASRLARDEGWLAEHMLILGITSPAGKKRYVAAAFPSACGKTNLAMMRPALPGWKVECVGDDIAWMRFDSEGRLRAINPENGFFGVAPGTSATTNPNAMATIQSNTIFTNVAETSDGGVYWEGIDQPLPPGVTVTSWLGKPWKPGDKEPCAHPNSRFCAPARQCPIMDPAWEAPEGVPIDAIIFGGRRPKGVPLVYEAFNWRHGVFVGSAMRSESTAAAEHKGKIIMHDPFAMRPFFGYNFGHYLEHWLSMEGRKGAQLPRIFHVNWFRRDEAGHFLWPGFGENARVLDWICRRLEGEDSARETPIGLVPKEGALDLSGLRAIDTTQLFSLPKDFWEQEVRDIRSYLTEQVNQDLPKEVLAELEALERRVHKM

SEQ ID NO: 835516 - protein, 484 aa, Homo sapiens
MYVLPFSMGPVGSPLSRIGVQLTDSAYVVASMRIMTRLGTPVLQALGDGDFVKCLHSVGQPLTGQGEPVSQWPCNPEKTLIGHVPDQREIISFGSGYGGNSLLGKKCFALRIASRLARDEGWLAEHMLILGITSPAGKKRYVAAAFPSACGKTNLAMMRPALPGWKVECVGDDIAWMRFDSEGRLRAINPENGFFGVAPGTSATTNPNAMATIQSNTIFTNVAETSDGGVYWEGIDQPLPPGVTVTSWLGKPWKPGDKEPCAHPNSRFCAPARQCPIMDPAWEAPEGVPIDAIIFGGRRPKGVPLVYEAFNWRHGVFVGSAMRSESTAAAEHKGKIIMHDPFAMRPFFGYNFGHYLEHWLSMEGRKGAQLPRIFHVNWFRRDEAGHFLWPGFGENARVLDWICRRLEGEDSARETPIGLVPKEGALDLSGLRAIDTTQLFSLPKDFWEQEVRDIRSYLTEQVNQDLPKEVLAELEALERRVHKM

SEQ ID NO: 835517 - protein, 269 aa, Homo sapiens
MAALYRPGLRLNWHGLSPLGWPSCRSIQTLRVLSGDLGQLPTGIRDFVEHSARLCQPEGIHICDGTEAENTATLTLLEQQGLIRKLPKYNNCWLARTDPKDVARVESKTVIVTPSQRDTVPLPPGGARGQLGNWMSPADFQRAVDERFPGCMQGRTMYVLPFSMGPVGSPLSRIGVQLTDSAYVVASMRIMTRLGTPVLQALGDGDFVKCLHSVGQPLTGQGEPVSQWPCNPEKTLIGHVPDQREIISFGSGYGGNSLWKMLPRIPGGR

SEQ ID NO: 835518 - protein, 551 aa, Homo sapiens
MAALYRPGLRLNWHGLSPLGWPSCRSIQTLRVLSGDLGQLPTGIRDFVEHSARLCQPEGIHICDGTEAENTATLTLLEQQGLIRKLPKYNNCWLARTDPKDVARVESKTLQALGDGDFVKCLHSVGQPLTGQGEPVSQWPCNPEKTLIGHVPDQREIISFGSGYGGNSLLGKKCFALRIASRLARDEGWLAEHMLILGITSPAGKKRYVAAAFPSACGKTNLAMMRPALPGWKVECVGDDIAWMRFDSEGRLRAINPENGFFGVAPGTSATTNPNAMATIQSNTIFTNVAETSDGGVYWEGIDQPLPPGVTVTSWLGKPWKPGDKEPCAHPNSRFCAPARQCPIMDPAWEAPEGVPIDAIIFGGRRPKGVPLVYEAFNWRHGVFVGSAMRSESTAAAEHKGKIIMHDPFAMRPFFGYNFGHYLEHWLSMEGRKGAQLPRIFHVNWFRRDEAGHFLWPGFGENARVLDWICRRLEGEDSARETPIGLVPKEGALDLSGLRAIDTTQLFSLPKDFWEQEVRDIRSYLTEQVNQDLPKEVLAELEALERRVHKM

SEQ ID NO: 835519 - protein, 235 aa, Homo sapiens; identical to SEQ ID NO: 835503

SEQ ID NO: 835520 - protein, 269 aa, Homo sapiens; identical to SEQ ID NO: 835517

SEQ ID NO: 835521 - protein, 640 aa, Homo sapiens; identical to SEQ ID NO: 835506

SEQ ID NO: 835522 - protein, 640 aa, Homo sapiens; identical to SEQ ID NO: 835506

SEQ ID NO: 835523 - protein, 613 aa, Homo sapiens
MAALYRPGLRLNWHGLSPLGWPSCRSIQTLRVLSGDLGQLPTGIRDFVEHSARLCQPEGIHICDGTEAENTATLTLLEQQGLIRKLPKYNNCWLARTDPKDVARVESKTVIVTPSQRDTVPLPPGGARGQLGNWMSPADFQRAVDERFPGCMQGRTMYVLPFSMGPVGSPLSRIGVQLTDSAYVVASMRIMTRLGTPVLQALGDGDFVKCLHSVGQPLTGQGEPVSQWPCNPEKTLIGHVPDQREIISFGSGYGGNSLLGKKCFALRIASRLARDEGWLAEHMLILGITSPAGKKRYVAAAFPSACGKTNLAMMRPALPGWKVECVGDDIAWMRFDSEGRLRAINPENGFFGVAPGTSATTNPNAMATIQSNTIFTNVAETSDGGVYWEGIDQPLPPGVTVTSWLGKPWKPGDKEPCAHPNSRFCAPARQCPIMDPAWEAPEGVPIDAIIFGGRRPKGVPLVYEAFNWRHGVFVGSAMRSESTAAAEHKGKIIMHDPFAMRPFFGYNFGHYLEHWFLWPGFGENARVLDWICRRLEGEDSARETPIGLVPKEGALDLSGLRAIDTTQLFSLPKDFWEQEVRDIRSYLTEQVNQDLPKEVLAELEALERRVHKM

SEQ ID NO: 835524 - protein, 522 aa, Homo sapiens
MAALYRPGLRLNWHGLSPLGWPSCRSIQTLRVLSGDLGQLPTGIRDFVEHSARLCQPEGIHICDGTEAENTATLTLLEQQGLIRKLPKYNNCWLARTDPKDVARVESKTVIVTPSQRDTVPLPPGGARGQLGNWMSPADFQRAVDERFPGCMQGRTMYVLPFSMGPVGSPLSRIGVQLTDSAYVVASMRIMTRLGTPVLQALGDGDFVKCLHSVGQPLTGQGEPVSQWPCNPEKTLIGHVPDQREIISFGSGYGGNSLLGKKCFALRIASRLARDEGWLAEHMLILGITSPAGKKRYVAAAFPSACGKTNLAMMRPALPGWKVECVGDDIAWMRFDSEGRLRAINPENGFFGVAPGTSATTNPNAMATIQSNTIFTNVAETSDGGVYWEGIDQPLPPGVTVTSWLGKPWKPGDKEPCAHPNSRFCAPARQCPIMDPAWEAPEGVPIDAIIFGGRRPKGVPLVYEAFNWRHGVFVGSAMRSESTAAAEHKGEHPHHSSLSCVCTQHVLSPFLSQTFLLSTPGV

SEQ ID NO: 835525 - protein, 441 aa, Homo sapiens; identical to SEQ ID NO: 835510

SEQ ID NO: 835526 - protein, 677 aa, Homo sapiens
PGPRELACQRGGGKLVPALPDTSLGPLTGSQPAPQVLREAAGPWGQGLNWHGLSPLGWPSCRSIQTLRVLSGDLGQLPTGIRDFVEHSARLCQPEGIHICDGTEAENTATLTLLEQQGLIRKLPKYNNCWLARTDPKDVARVESKTVIVTPSQRDTVPLPPGGARGQLGNWMSPADFQRAVDERFPGCMQGRTMYVLPFSMGPVGSPLSRIGVQLTDSAYVVASMRIMTRLGTPVLQALGDGDFVKCLHSVGQPLTGQGEPVSQWPCNPEKTLIGHVPDQREIISFGSGYGGNSLLGKKCFALRIASRLARDEGWLAEHMLILGITSPAGKKRYVAAAFPSACGKTNLAMMRPALPGWKVECVGDDIAWMRFDSEGRLRAINPENGFFGVAPGTSATTNPNAMATIQSNTIFTNVAETSDGGVYWEGIDQPLPPGVTVTSWLGKPWKPGDKEPCAHPNSRFCAPARQCPIMDPAWEAPEGVPIDAIIFGGRRPKGVPLVYEAFNWRHGVFVGSAMRSESTAAAEHKGKIIMHDPFAMRPFFGYNFGHYLEHWLSMEGRKGAQLPRIFHVNWFRRDEAGHFLWPGFGENARVLDWICRRLEGEDSARETPIGLVPKEGALDLSGLRAIDTTQLFSLPKDFWEQEVRDIRSYLTEQVNQDLPKEVLAELEALERRVHKM

SEQ ID NO: 835527 - protein, 650 aa, Homo sapiens
GAEGAGLPAGRRKASASPTRLNWHGLSPLGWPSCRSIQTLRVLSGDLGQLPTGIRDFVEHSARLCQPEGIHICDGTEAENTATLTLLEQQGLIRKLPKYNNCWLARTDPKDVARVESKTVIVTPSQRDTVPLPPGGARGQLGNWMSPADFQRAVDERFPGCMQGRTMYVLPFSMGPVGSPLSRIGVQLTDSAYVVASMRIMTRLGTPVLQALGDGDFVKCLHSVGQPLTGQGEPVSQWPCNPEKTLIGHVPDQREIISFGSGYGGNSLLGKKCFALRIASRLARDEGWLAEHMLILGITSPAGKKRYVAAAFPSACGKTNLAMMRPALPGWKVECVGDDIAWMRFDSEGRLRAINPENGFFGVAPGTSATTNPNAMATIQSNTIFTNVAETSDGGVYWEGIDQPLPPGVTVTSWLGKPWKPGDKEPCAHPNSRFCAPARQCPIMDPAWEAPEGVPIDAIIFGGRRPKGVPLVYEAFNWRHGVFVGSAMRSESTAAAEHKGKIIMHDPFAMRPFFGYNFGHYLEHWLSMEGRKGAQLPRIFHVNWFRRDEAGHFLWPGFGENARVLDWICRRLEGEDSARETPIGLVPKEGALDLSGLRAIDTTQLFSLPKDFWEQEVRDIRSYLTEQVNQDLPKEVLAELEALERRVHKM

SEQ ID NO: 835528 - protein, 667 aa, Homo sapiens
MAALYRPGLRYLPRTSNWALSQRPRVLREAAGPWGQGLNWHGLSPLGWPSCRSIQTLRVLSGDLGQLPTGIRDFVEHSARLCQPEGIHICDGTEAENTATLTLLEQQGLIRKLPKYNNCWLARTDPKDVARVESKTVIVTPSQRDTVPLPPGGARGQLGNWMSPADFQRAVDERFPGCMQGRTMYVLPFSMGPVGSPLSRIGVQLTDSAYVVASMRIMTRLGTPVLQALGDGDFVKCLHSVGQPLTGQGEPVSQWPCNPEKTLIGHVPDQREIISFGSGYGGNSLLGKKCFALRIASRLARDEGWLAEHMLILGITSPAGKKRYVAAAFPSACGKTNLAMMRPALPGWKVECVGDDIAWMRFDSEGRLRAINPENGFFGVAPGTSATTNPNAMATIQSNTIFTNVAETSDGGVYWEGIDQPLPPGVTVTSWLGKPWKPGDKEPCAHPNSRFCAPARQCPIMDPAWEAPEGVPIDAIIFGGRRPKGVPLVYEAFNWRHGVFVGSAMRSESTAAAEHKGKIIMHDPFAMRPFFGYNFGHYLEHWLSMEGRKGAQLPRIFHVNWFRRDEAGHFLWPGFGENARVLDWICRRLEGEDSARETPIGLVPKEGALDLSGLRAIDTTQLFSLPKDFWEQEVRDIRSYLTEQVNQDLPKEVLAELEALERRVHKM

SEQ ID NO: 835529 - protein, 506 aa, Homo sapiens
MSPADFQRAVDERFPGCMQGRTMYVLPFSMGPVGSPLSRIGVQLTDSAYVVASMRIMTRLGTPVLQALGDGDFVKCLHSVGQPLTGQGEPVSQWPCNPEKTLIGHVPDQREIISFGSGYGGNSLLGKKCFALRIASRLARDEGWLAEHMLILGITSPAGKKRYVAAAFPSACGKTNLAMMRPALPGWKVECVGDDIAWMRFDSEGRLRAINPENGFFGVAPGTSATTNPNAMATIQSNTIFTNVAETSDGGVYWEGIDQPLPPGVTVTSWLGKPWKPGDKEPCAHPNSRFCAPARQCPIMDPAWEAPEGVPIDAIIFGGRRPKGVPLVYEAFNWRHGVFVGSAMRSESTAAAEHKGKIIMHDPFAMRPFFGYNFGHYLEHWLSMEGRKGAQLPRIFHVNWFRRDEAGHFLWPGFGENARVLDWICRRLEGEDSARETPIGLVPKEGALDLSGLRAIDTTQLFSLPKDFWEQEVRDIRSYLTEQVNQDLPKEVLAELEALERRVHKM

SEQ ID NO: 835530 - protein, 492 aa, Homo sapiens
MPSSTGRTMYVLPFSMGPVGSPLSRIGVQLTDSAYVVASMRIMTRLGTPVLQALGDGDFVKCLHSVGQPLTGQGEPVSQWPCNPEKTLIGHVPDQREIISFGSGYGGNSLLGKKCFALRIASRLARDEGWLAEHMLILGITSPAGKKRYVAAAFPSACGKTNLAMMRPALPGWKVECVGDDIAWMRFDSEGRLRAINPENGFFGVAPGTSATTNPNAMATIQSNTIFTNVAETSDGGVYWEGIDQPLPPGVTVTSWLGKPWKPGDKEPCAHPNSRFCAPARQCPIMDPAWEAPEGVPIDAIIFGGRRPKGVPLVYEAFNWRHGVFVGSAMRSESTAAAEHKGKIIMHDPFAMRPFFGYNFGHYLEHWLSMEGRKGAQLPRIFHVNWFRRDEAGHFLWPGFGENARVLDWICRRLEGEDSARETPIGLVPKEGALDLSGLRAIDTTQLFSLPKDFWEQEVRDIRSYLTEQVNQDLPKEVLAELEALERRVHKM

SEQ ID NO: 835531 - protein, 451 aa, Homo sapiens
MRGFQAACRLQALGDGDFVKCLHSVGQPLTGQGEPVSQWPCNPEKTLIGHVPDQREIISFGSGYGGNSLLGKKCFALRIASRLARDEGWLAEHMLILGITSPAGKKRYVAAAFPSACGKTNLAMMRPALPGWKVECVGDDIAWMRFDSEGRLRAINPENGFFGVAPGTSATTNPNAMATIQSNTIFTNVAETSDGGVYWEGIDQPLPPGVTVTSWLGKPWKPGDKEPCAHPNSRFCAPARQCPIMDPAWEAPEGVPIDAIIFGGRRPKGVPLVYEAFNWRHGVFVGSAMRSESTAAAEHKGKIIMHDPFAMRPFFGYNFGHYLEHWLSMEGRKGAQLPRIFHVNWFRRDEAGHFLWPGFGENARVLDWICRRLEGEDSARETPIGLVPKEGALDLSGLRAIDTTQLFSLPKDFWEQEVRDIRSYLTEQVNQDLPKEVLAELEALERRVHKM

SEQ ID NO: 835532 - protein, 269 aa, Homo sapiens
MAALYRPGLRLNWHGLSPLGWPSCRSIQTLRVLSGDLGQLPTGIRDFVEHSARLCQPEGIHICDGTEAENTATLTLLEQQGLIRKLPKYNNCWLARTDPKDVARVESKTVIVTPSQRDTVPLPPGGARGQLGNWMSPADFQRAVDERFPGCMQGNQGRGTVARARKMWNRFGTFIQGMPSSTGRTMYVLPFSMGPVGSPLSRIGVQLTDSAYVVASMRIMTRLGTPVLQALGDGDFVKCLHSVGQPLTGQGKHLLCPKGNTEAFLYSEE

SEQ ID NO: 835533 - protein, 414 aa, Homo sapiens
RPVGNRGAGGERGSRVLRSGARGSVAPSWTQSPRHRPRPAAVSCASQRREFEHPPRRPLLGARSGEAKCERPRTPALSLPAARTTMTHFNKGPSYGLSAEVKNKIASKYDHQAEEDLRNWIEEVTGMSIGPNFQLGLKDGIILCELINKLQPGSVKKVNESSLNWPQLENIGNFIKAIQAYGMKPHDIFEANDLFENGNMTQVQTTLVALAGLAKTKGFHTTIDIGVKYAEKQTRRFDEGKLKAGQSVIGLQMGTNKCASQAGMTAYGTRRHLYDPKMQTDKPFDQTTISLQMGTNKGASQAGMLAPGTRRDIYDQKLTLQPVDNSTISLQMGTNKVASQKGMSVYGLGRQVYDPKYCAAPTEPVIHNGSQGTGTNGSEISDSDYQAEYPDEYHGEYQDDYPRDYQYSDQGIDY

SEQ ID NO: 835534 - protein, 206 aa, Homo sapiens
RPVGNRGAGGERGSRVLRSGARGSVAPSWTQSPRHRPRPAAVSCASQRREFEHPPRRPLLGARSGEAKCERPRTPALSLPAARTTMTHFNKGPSYGLSAEVKNKIASKYDHQAEEDLRNWIEEVTGMSIGPNFQLGLKDGIILCELINKLQPGSVKKVNESSLNWPQLENIGNFIKAIQAYGMKPHDIFEANDLFENGNMTSFLKY

SEQ ID NO: 835535 - protein, 414 aa, Homo sapiens; identical to SEQ ID NO: 835533

SEQ ID NO: 835536 - protein, 398 aa, Homo sapiens
RPVGNRGAGGERGSRVLRSGARGSVAPSWTQSPRHRPRPAAVSCASQRREFEHPPRRPLLGARSGEAKCERPRTPALSLPAARTTMTHFNKGPSYGLSAEVKNKIASKYDHQAEEDFQLGLKDGIILCELINKLQPGSVKKVNESSLNWPQLENIGNFIKAIQAYGMKPHDIFEANDLFENGNMTQVQTTLVALAGLAKTKGFHTTIDIGVKYAEKQTRRFDEGKLKAGQSVIGLQMGTNKCASQAGMTAYGTRRHLYDPKMQTDKPFDQTTISLQMGTNKGASQAGMLAPGTRRDIYDQKLTLQPVDNSTISLQMGTNKVASQKGMSVYGLGRQVYDPKYCAAPTEPVIHNGSQGTGTNGSEISDSDYQAEYPDEYHGEYQDDYPRDYQYSDQGIDY

SEQ ID NO: 835537 - protein, 414 aa, Homo sapiens; identical to SEQ ID NO: 835533

SEQ ID NO: 835538 - protein, 368 aa, Homo sapiens
RPVGNRGAGGERGSRVLRSGARGSVAPSWTQSPRHRPRPAAVSCASQRREFEHPPRRPLLGARSGEAKCERPRTPALSLPAARTTMTHFNKGPSYGLSAEVKNKIASKYDHQAEEDLRNWIEEVTGMSIGPNFQLGLKDGIILCELINKLQPGSVKKVNESSLNWPQAKTKGFHTTIDIGVKYAEKQTRRFDEGKLKAGQSVIGLQMGTNKCASQAGMTAYGTRRHLYDPKMQTDKPFDQTTISLQMGTNKGASQAGMLAPGTRRDIYDQKLTLQPVDNSTISLQMGTNKVASQKGMSVYGLGRQVYDPKYCAAPTEPVIHNGSQGTGTNGSEISDSDYQAEYPDEYHGEYQDDYPRDYQYSDQGIDY

SEQ ID NO: 835539 - protein, 125 aa, Homo sapiens
NSRVGTNKGASQAGMLAPGTRRDIYDQKLTLQPVDNSTISLQMGTNKVASQKGMSVYGLGRQVYDPKYCAAPTEPVIHNGSQGTGTNGSEISDSDYQAEYPDEYHGEYQDDYPRDYQYSDQGIDY

SEQ ID NO: 835540 - protein, 415 aa, Homo sapiens
RPVGNRGAGGERGSRVLRSGARGSVAPSWTQSPRHRPRPAAVSCASQRREFEHPPRRPLLGARSGEAKCERPRTPALSLPAARTTMTHFNKGPSYGLSAEVKNKIASKYDHQAEEDLRNWIEEVTGMSIGPNFQLGLKDGIILCELINKLQPGSVKKVNESSLNWPQLENIGNFIKAIQAYGMKPHDIFEANDLFENGNMTQVQTTLVALAGLAKTKGFHTTIDIGVKYAEKQTRRFDEGKLKAGQSVIGLQMGTNKCASQAGMTAYGTRRHLYDPKMQTDKPFDQTTISLQMGTNKGASQAGMLAPGTRRDIYDQKLTLQPVDNSTISLQMGTNKVASQKGMSVYGLGRQVYDPKYCAAPTEPVIHNGSQGTGTNGSEISDSDYQAEYPDEYHGEYQDDYPRDYQSSSYQAYYT

SEQ ID NO: 835541 - protein, 305 aa, Homo sapiens
RPVGNRGAGGERGSRVLRSGARGSVAPSWTQSPRHRPRPAAVSCASQRREFEHPPRRPLLGARSGEAKCERPRTPALSLPAARTTMTHFNKGPSYGLSAEVKNKIASKYDHQAEEDLRNWIEEVTGMSIGPNFQLGLKDGIILCELINKLQPGSVKKVNESSLNWPQLENIGNFIKAIQAYGMKPHDIFEANDLFENGNMTQVQTTLVALAGLAKTKGFHTTIDIGVKYAEKQTRRFDEGKLKAGQSVIGLQMGTNKCASQAGMTAYGTRRHLYDPKMQTDKPFDQTTISLQMGTNKGASQVSNT

SEQ ID NO: 835542 - protein, 414 aa, Homo sapiens; identical to SEQ ID NO: 835533

SEQ ID NO: 835543 - protein, 288 aa, Homo sapiens
MSIGPNFQLGLKDGIILCELINKLQPGSVKKVNESSLNWPQLENIGNFIKAIQAYGMKPHDIFEANDLFENGNMTQVQTTLVALAGLAKTKGFHTTIDIGVKYAEKQTRRFDEGKLKAGQSVIGLQMGTNKCASQAGMTAYGTRRHLYDPKMQTDKPFDQTTISLQMGTNKGASQAGMLAPGTRRDIYDQKLTLQPVDNSTISLQMGTNKVASQKGMSVYGLGRQVYDPKYCAAPTEPVIHNGSQGTGTNGSEISDSDYQAEYPDEYHGEYQDDYPRDYQYSDQGIDY

SEQ ID NO: 835544 - protein, 414 aa, Homo sapiens; identical to SEQ ID NO: 835533

SEQ ID NO: 835545 - protein, 162 aa, Homo sapiens
MGTNKCASQAGMTAYGTRRHLYDPKMQTDKPFDQTTISLQMGTNKGASQAGMLAPGTRRDIYDQKLTLQPVDNSTISLQMGTNKVASQKGMSVYGLGRQVYDPKYCAAPTEPVIHNGSQGTGTNGSEISDSDYQAEYPDEYHGEYQDDYPRDYQYSDQGIDY

SEQ ID NO: 835546 - protein, 248 aa, Homo sapiens
RPVGNRGAGGERGSRVLRSGARGSVAPSWTQSPRHRPRPAAVSCASQRREFEHPPRRPLLGARSGEAKCERPRTPALSLPAARTTMTHFNKGPSYGLSAEVKNKIASKYDHQAEEDLRNWIEEVTGMSIGPNFQLGLKDGIILCELINKLQPGSVKKVNESSLNWPQLENIGNFIKAIQAYGMKPHDIFEANDLFENGNMTQVQTTLVALAGLAKTKGFHTTIDIGVKYAENGNQQMCQPGRYDSLRD

SEQ ID NO: 835547 - protein, 414 aa, Homo sapiens; identical to SEQ ID NO: 835533

SEQ ID NO: 835548 - protein, 274 aa, Homo sapiens
RPVGNRGAGGERGSRVLRSGARGSVAPSWTQSPRHRPRPAAVSCASQRREFEHPPRRPLLGARSGEAKCERPRTPALSLPAARTTMTHFNKGPSYGLSAEVKNKIASKYDHQAEEDLRNWIEEVTGMSIGPNFQLGLKDGIILCELINKLQPGSVKKVNESSLNWPQLENIGNFIKAIQAYGMKPHDIFEANDLFENGNMTQVQTTLVALAGLAKTKGFHTTIDIGVKYAEKQTRRFDEGKLKAGQSVIGLQMGTNKCASQAGMTAYGTRRHLY

SEQ ID NO: 835549 - protein, 126 aa, Homo sapiens
MTAGSVCVPQIIPLRVPQPGKANHEIDNNTLLEMKSDTPDVNIYYTLDGSKPEFLKRIGYGENNTFKYIKPITLPDGKIQVKAIAVSKDCRQSGIVTKVFHVDYEPPNIVSPEDNVENVLKDSSRQ

SEQ ID NO: 835550 - protein, 138 aa, Homo sapiens
MSGSSPSHPQHTQGLLPESAKHIAFLSVDGTQSSIFLFSSGEKIKSLYVNMIDIHCAKKISVFLKKYKGKGKLICPSVTLRHTLVTSVQAPFQDSECTVYMNAYTEKFTFKSVLYLFFYNIRNRFLLRCLHVGNYRTT

SEQ ID NO: 835551 - protein, 76 aa, Homo sapiens
SSDGNSENQTWNTERMWACRGWGQQHMHAGLTEQPLGVLFPEELYGDFEDLETGDVHKGKSGPDTQNEDVEKQGRN

SEQ ID NO: 835552 - protein, 246 aa, Homo sapiens
HGTGRATPTGASSEGGALGGGPGGSAQGALPRRRGRRGRAEARGLEAPGGGCGRHGGGGDRATGRAGGQGRAEGGSGLRQDLSRKNLAAGDSPPFKRSLHSPHPTQGRAFPNAGAHWPPRAAPSSSPAPFTLRQPHCPLGVRPPTRARPPARPPARAMNAKVVVVLVLVLTALCLSDGKPVSLSYRCPCRFFESHVARANVKHLKILNTPNCALQIVARLKNNNRQVCIDPKLKWIQEYLEKALNK

SEQ ID NO: 835553 - protein, 250 aa, Homo sapiens
HGTGRATPTGASSEGGALGGGPGGSAQGALPRRRGRRGRAEARGLEAPGGGCGRHGGGGDRATGRAGGQGRAEGGSGLRQDLSRKNLAAGDSPPFKRSLHSPHPTQGRAFPNAGAHWPPRAAPSSSPAPFTLRQPHCPLGVRPPTRARPPARPPARAMNAKVVVVLVLVLTALCLSDGKPVSLSYRCPCRFFESHVARANVKHLKILNTPNCALQIVARLKNNNRQVCIDPKLKWIQEYLEKALNKRFKM

SEQ ID NO: 835554 - protein, 250 aa, Homo sapiens; identical to SEQ ID NO: 835553

SEQ ID NO: 835555 - protein, 250 aa, Homo sapiens; identical to SEQ ID NO: 835553

SEQ ID NO: 835556 - protein, 250 aa, Homo sapiens; identical to SEQ ID NO: 835553

SEQ ID NO: 835557 - protein, 250 aa, Homo sapiens; identical to SEQ ID NO: 835553

SEQ ID NO: 835558 - protein, 250 aa, Homo sapiens; identical to SEQ ID NO: 835553

SEQ ID NO: 835559 - protein, 250 aa, Homo sapiens; identical to SEQ ID NO: 835553

SEQ ID NO: 835560 - protein, 250 aa, Homo sapiens; identical to SEQ ID NO: 835553

SEQ ID NO: 835561 - protein, 260 aa, Homo sapiens
HGTGRATPTGASSEGGALGGGPGGSAQGALPRRRGRRGRAEARGLEAPGGGCGRHGGGGDRATGRAGGQGRAEGGSGLRQDLSRKNLAAGDSPPFKRSLHSPHPTQGRAFPNAGAHWPPRAAPSSSPAPFTLRQPHCPLGVRPPTRARPPARPPARAMNAKVVVVLVLVLTALCLSDGKPVSLSYRCPCRFFESHYCTCLIRVSFHGATPLTQGSWVLYSLSCAGGETGLREPGPMVSPRVESHQEGRLGVPGPVNLGKA

SEQ ID NO: 835562 - protein, 240 aa, Homo sapiens
HGTGRATPTGASSEGGALGGGPGGSAQGALPRRRGRRGRAEARGLEAPGGGCGRHGGGGDRATGRAGGQGRAEGGSGLRQDLSRKNLAAGDSPPFKRSLHSPHPTQGRAFPNAGAHWPPRAAPSSSPAPFTLRQPHCPLGVRPPTRARPPARPPARAMNAKVVVVLVLVLTALCLSDGKPVSLSYRCPCRFFESHVARANVKHLKILNTPNCALQIVARLKNNNRQVCIDLGSGLRFASI

SEQ ID NO: 835563 - protein, 250 aa, Homo sapiens; identical to SEQ ID NO: 835553

SEQ ID NO: 835564 - protein, 185 aa, Homo sapiens
GGGVPGAGRGALCRGSELGPAGGHGCHTLGPDMMASMRVVKELEDLQKKPPPYLRNLSSDDANVLVWHALLLPDQPPYHLKAFNLRISFPPEYPFKPPMIKFTTKIYHPNVDENGQICLPIISSENWKPCTKTCQVLEALNVLVNRPNIREPLRMDLADLLTQNPELFRKNAEEFTLRFGVDRPS

SEQ ID NO: 835565 - protein, 185 aa, Homo sapiens; identical to SEQ ID NO: 835564

SEQ ID NO: 835566 - protein, 187 aa, Homo sapiens
DWNPYERPPAPLSARRRCTAHPAGGRDRKAVRPEARPRLRTKTELEDLQKKPPPYLRNLSSDDANVLVWHALLLPDQPPYHLKAFNLRISFPPEYPFKPPMIKFTTKIYHPNVDENGQICLPIISSENWKPCTKTCQVLEALNVLVNRPNIREPLRMDLADLLTQNPELFRKNAEEFTLRFGVDRPS

SEQ ID NO: 835567 - protein, 269 aa, Homo sapiens
GGGVPGAGRGALCRGSELGPAGGHGCHTLGPDMMASMRVVKELEDLQKKPPPYLRNLSSDDANVLVWHALLLPEAEVAVSRDHAIALQPGQQSETPSQKKKKKEAWHQHLLLMRPSGSFHSWWKAKGSHVYRSHAREEVKERESEQVPGSSKQPAFSDQPPYHLKAFNLRISFPPEYPFKPPMIKFTTKIYHPNVDENGQICLPIISSENWKPCTKTCQVLEALNVLVNRPNIREPLRMDLADLLTQNPELFRKNAEEFTLRFGVDRPS

SEQ ID NO: 835568 - protein, 95 aa, Homo sapiens
FDHLRRMNGLLRVRTADAPLKACRSSGGSSDQEKTVPHQDIGIIAGAGGREAGGRELVEREPLRMDLADLLTQNPELFRKNAEEFTLRFGVDRPS

SEQ ID NO: 835569 - protein, 87 aa, Homo sapiens
GGGVPGAGRGALCRGSELGPAGGHGCHTLGPDMMASMRVVKELEDLQKKPPPYLRNLSSDDANVLVWHALLLPVSIHGDHGFGLGPN

SEQ ID NO: 835570 - protein, 67 aa, Homo sapiens
AGETLQPAPNAGQHKGSPTAGERCSEGTGLRHPPRSFGDGALGPWREGGRLGGSGSLLGQGLKAAVR

SEQ ID NO: 835571 - protein, 156 aa, Homo sapiens
MRRWTWKASWSSELEDLQKKPPPYLRNLSSDDANVLVWHALLLPDQPPYHLKAFNLRISFPPEYPFKPPMIKFTTKIYHPNVDENGQICLPIISSENWKPCTKTCQVLEALNVLVNRPNIREPLRMDLADLLTQNPELFRKNAEEFTLRFGVDRPS

SEQ ID NO: 835572 - protein, 179 aa, Homo sapiens
AGETLQPAPNAGQHKGSPTAGERCSEGTGLRHPPRSFGDGALGPWREGGRLSSDDANVLVWHALLLPDQPPYHLKAFNLRISFPPEYPFKPPMIKFTTKIYHPNVDENGQICLPIISSENWKPCTKTCQVLEALNVLVNRPNIREPLRMDLADLLTQNPELFRKNAEEFTLRFGVDRPS

SEQ ID NO: 835573 - protein, 212 aa, Homo sapiens
GGGVPGAGRGALCRGSELGPAGGHGCHTLGPDMMASMRVVKELEDLQKKPPPYLRNLSSDDANVLVWHALLLPDQPPYHLKAFNLRISFPPEYPFKPPMIKFTTKIYHPNVDENGQICLPIISSENWKPCTKTCQVLEALNVLVNRPNIREPLRMDLADFNGLSKNMVSVAPPGLNAGGYILHSLRPGPRNWQSNRMASGFETYRFSGWKFD

SEQ ID NO: 835574 - protein, 398 aa, Homo sapiens
MPKCSKSEKIEDALLWECPVGDILPNSSDYKSSLIALTAHNWLLRISATTGKILEKIYLAPYCKFRYLSWDTPQEVIAVKSAQNRGSAVARQAGIQQHVLLYLAVFRVLPFSLVGILEINKKIFGNVTDATLSHGILIVMYSSGLVRLYSFQTIAEQTCHHCSLRCHPWRMLFRLEAILGIYIVTPNKKKQKGVFHICALKDNSLAKNGIQEMDCCSLESDWIYFHPDASGRIIHVGPNQVKVLKLTEIENNSSQHQISEDFVILANRENHKNENVLTVTASGRVVKKSFNLLDDDPEQETFKIVDYEDELDLLSVVAVTQIDAEGKAHLDFHCNEYGTLLKSIPLVESWDVTYSHEVYFDRDLVLHIEQKPNRVFSCYVYQMICDTGEEEETINRSC

SEQ ID NO: 835575 - protein, 456 aa, Homo sapiens
RTNLGILRALVCQESTKFKNVWTTHSRSPIAYERGRIYFDNYRRCVSSVASEPRKLYEMPKCSKSEKIEDALLWECPVGDILPNSSDYKSSLIALTAHNWLLRISATTGKILEKIYLAPYCKFRYLSWDTPQEVIAVKSAQNRGSAVARQAGIQQHVLLYLAVFRVLPFSLVGILEINKKIFGNVTDATLSHGILIVMYSSGLVRLYSFQTIAEQIMPPLLFEVSSLENAFQIGGHPWHYIVTPNKKKQKGVFHICALKDNSLAKNGIQEMDCCSLESDWIYFHPDASGRIIHVGPNQVKVLKLTEIENNSSQHQISEDFVILANRENHKNENVLTVTASGRVVKKSFNLLDDDPEQETFKIVDYEDELDLLSVVAVTQIDAEGKAHLDFHCNEYGTLLKSIPLVESWDVTYSHEVYFDRDLVLHIEQKPNRVFSCYVYQMICDTGEEEETINRSC

SEQ ID NO: 835576 - protein, 198 aa, Homo sapiens
MPKCSKSEKIEDALLWECPVGDILPNSSDYKSSLIALTAHNWLLRISATTGKILEKIYLAPYCKFRYLSWDTPQEVIAVKSAQNRGSAVARQAEAFINLVWWTLQGPKVLTFLTLCTGIPRKIEERAFLGATARGRHTDGPTGTTRPAKDHGRARGKTIIETKQGGNNDGPQGTVRAHTRETQKSARHDTVGKERHTS

SEQ ID NO: 835577 - protein, 220 aa, Homo sapiens
MPLTGVGPGSCRRQIIRALCLLLLLLHAGSAKNIWKRALPARLAEKSRAEEAGAPGGPRQPRADRCPPPPRTLPPGACQAARCQADSECPRHRRCCYNGCAYACLEAVPPPPVLDWLVQPKPRWLGGNGWLLDGPEEVLQAEACSTTEDGAEPLLCPSGYECHILSPGDVAEGIPNRGQCVKQRRQADGRILRHKLYKEYPEGDSKNVAEPGRGQQKHFQ

SEQ ID NO: 835578 - protein, 320 aa, Homo sapiens
RGCSHPAPKQGPARQGPVGPYSLSCSPKRDPAAEKLETVIRTDWTLASRCLHLTLDPPGDSTGSRQLRLLGWIRVPAGAVGGPRGLHCSPDGLLFLTAGAAPCVHVLDLEGRPICLLPCRTPGSGAFVPEDVAVTASGLVVVSDPIHGAVHALQHTARDPGGHWVTVGTFLSPRGLAVDALNRLLVTDYLPGAVHSFSLGPAWEPLAPASMLGLEGPCWVGPGPDGGLAVSEEFGDVRLFGSARQPLGSLGGWTGHTFGCPAGICSNSEGNVIVADEQRRQVTLFPRAGPPSAWCQRGLGSPWEWPVHPRASSWWLMPRT

SEQ ID NO: 835579 - protein, 311 aa, Homo sapiens
RLQPPSPEAGPSETGPSPKRDPAAEKLETVIRTDWTLASRCLHLTLDPPGDSTGSRQLRLLGWIRVPAGAVGGPRGLHCSPDGLLFLTAGAAPCVHVLDLEGRPICLLPCRTPGSGAFVPEDVAVTASGLVVVSDPIHGAVHALQHTARDPGGHWVTVGTFLSPRGLAVDALNRLLVTDYLPGAVHSFSLGPAWEPLAPASMLGLEGPCWVGPGPDGGLAVSEEFGDVRLFGSARQPLGSLGGWTGHTFGCPAGICSNSEGNVIVADEQRRQVTLFPRAGPPSAWCQRGLGSPWEWPVHPRASSWWLMPRT

SEQ ID NO: 835580 - protein, 250 aa, Homo sapiens
SPSVPQEPPSWTRGSQEGLPQLRMGNCVKYPLRNLSRKMCQEEQTSYMVVQTSEEGLAADAELPGPLLMLAQNCAVMHNLLGPACIFLRKGFAENRQPDRSLRPEEIEELREAFREFDKDKDGYINCRDLGNCMRTMGYMPTEMELIELSQQINMNLGGHVDFDDFVELMGPKLLAETADMIGVKELRDAFREFDTNGDGEISTSELREAMRKLLGHQVGHRDIEEIIRDVDLNGDGRVDFEEFVRMMSR

SEQ ID NO: 835581 - protein, 212 aa, Homo sapiens
MCQEEQTSYMVVQTSEEGLAADAELPGPLLMLAQNCAVMHNLLGPACIFLRKGFAENRQPDRSLRPEEIEELREAFREFDKDKDGYINCRDLGNCMRTMGYMPTEMELIELSQQINMNLGGHVDFDDFVELMGPKLLAETADMIGVKELRDAFREFDTNGDGEISTSELREAMRKLLGHQVGHRDIEEIIRDVDLNGDGRVDFEEFVRMMSR

SEQ ID NO: 835582 - protein, 110 aa, Homo sapiens
MYWRMGPACTPGRRPPRTPTPPHCERLTPATGKRGRPPTRRPPCQAGRGHARRQGPCAQLLLAGWAREPASRPHTACPPQGKASHLRSAPVPARLSPVISEPIKIFPRAR

SEQ ID NO: 835583 - protein, 125 aa, Homo sapiens
CSMFLRVSSPFMGYMPTEMELIELSQQINMNLGGHVDFDDFVELMGPKLLAETADMIGVKELRDAFREFDTNGDGEISTSELREAMRKLLGHQVGHRDIEEIIRDVDLNGDGRVDFEEFVRMMSR

SEQ ID NO: 835584 - protein, 74 aa, Homo sapiens
GDSTGSYRLAGRGHARRQGPCAQLLLAGWAREPASRPHTACPPQGKASHLRSAPVPARLSPVISEPIKIFPRAR

SEQ ID NO: 835585 - protein, 190 aa, Homo sapiens
SPSVPQEPPSWTRGSQEGLPQLRMGNCVKYPLRNLSRKDRSLRPEEIEELREAFREFDKDKDGYINCRDLGNCMRTMGYMPTEMELIELSQQINMNLGGHVDFDDFVELMGPKLLAETADMIGVKELRDAFREFDTNGDGEISTSELREAMRKLLGHQVGHRDIEEIIRDVDLNGDGRVDFEEFVRMMSR

SEQ ID NO: 835586 - protein, 263 aa, Homo sapiens
AERVLGLGSRREPRSLPAGGPAPRRTAPPPPGHASAGPAAMSSHIAKSESKSSPLPPARGRDGEERGLSPALGLRGSLRARGRGDSVPAAASEADPFLHRLRPMLSSAFGQDRSLRPEEIEELREAFREFDKDKDGYINCRDLGNCMRTMGYMPTEMELIELSQQINMNLGGHVDFDDFVELMGPKLLAETADMIGVKELRDAFREFDTNGDGEISTSELREAMRKLLGHQVGHRDIEEIIRDVDLNGDGRVDFEEFVRMMSR

SEQ ID NO: 835587 - protein, 114 aa, Homo sapiens [sequence omitted]

SEQ ID NO: 835588 - protein, 325 aa, Homo sapiens
MESKMGELPLDINIQEPRWDQSTFLGRARHFFTVTDPRNLLLSGAQLEASRNIVQNYRAGVVTPGITEDQLWRAKYVYDSAFHPDTGEKVVLIGRMSAQVPMNMTITGCMLTFYRKTPTVVFWQWVNQSFNAIVNYSNRSGDTPITVRQLGTAYVSATTGAVATALGLKSLTKHLPPLVGRFVPFAAVAAANCINIPLMRQRELQVGIPVADEAGQRLGYSVTAAKQGIFQVVISRICMAIPAMAIPPLIMDTLEKKDFLKRRPWLGAPLQVGLVGFCLVFATPLCCALFPQKSSIHISNLEPELRAQIHEQNPSVEVVYYNKGL

SEQ ID NO: 835589 - protein, 325 aa, Homo sapiens; identical to SEQ ID NO: 835588

SEQ ID NO: 835590 - protein, 166 aa, Homo sapiens
MESKMCELPLDINIPLMSAEELQVGIPVADEDQLWRAKYVYDSAFHPDTGEKVVLIGRMSAQVPMNMTITGCMLTFYRKTPTVVFWQWVNQSFNAIVNYSNRSGDTPITVRQLGTAYVSATTGAVATALGLKSLTKHLPPLVGRFVPFAAVAAANCINIPLMRQSR

SEQ ID NO: 835591 - protein, 374 aa, Homo sapiens
MESKMGELPLDINIQEPRWDQSTFLGRARHFFTVTDPRNLLLSGAQLEASRNIVQNYRAGVVTPGITEDQLWRAKYVYDSAFHPDTGEKVVLIGRMSAQVPMNMTITGCMLTFYRKTPTVVFWQWVNQSFNAIVNYSNRSGDTPITVRQLGTAYVSATTGAVATALGLKSLTKHLPPLVGRFVPFAAVAAANCINIPLMRQRELQVGIPVADEAGQRLGYSVTAAKQGIFQVVISRICMAIPAMAIPPLIMDTLEKKDFLKVGDCTSLVLEWAMAGRSDQAPTLSPASPDSLRLASPSPDPCTASSTFVHSARMNWAGVKELCRGRRRGQRKETNFISVTPVASDTQKGTVIVMLDLMLILLPPSASILRGTHG

SEQ ID NO: 835592 - protein, 122 aa, Homo sapiens
MESKMGELPLDINIQEPRWDQSTFLGRARHFFTVTDPRNLLLSGAQLEASRNIVQNYRAGVVTPGITEDQLWRAKYVYDSAFHPDTGEKVVLIGRMSAQVPMNMTIMASPNKIWAWGWNGWW

SEQ ID NO: 835593 - protein, 325 aa, Homo sapiens; identical to SEQ ID NO: 835588

SEQ ID NO: 835594 - protein, 344 aa, Homo sapiens
MESKMGELPLDINIQEPRWDQSTFLGRARHFFTVTDPRNLLLSGAQLEASRNIVQNYRAGVVTPGITEDQLWRAKYVYDSAFHPDTGEKVVLIGRMSAQVPMNMTITGCMLTFYRKTPTVVFWQWVNQSFNAIVNYSNRSGDTPITVRQLGTAYVSATTGAVATALGLKSLTKSPSPAHGPSGPLNNTLPPQHLPPLVGRFVPFAAVAAANCINIPLMRQRELQVGIPVADEAGQRLGYSVTAAKQGIFQVVISRICMAIPAMAIPPLIMDTLEKKDFLKRRPWLGAPLQVGLVGFCLVFATPLCCALFPQKSSIHISNLEPELRAQIHEQNPSVEVVYYNKGL

SEQ ID NO: 835595 - protein, 325 aa, Homo sapiens; identical to SEQ ID NO: 835588

SEQ ID NO: 835596 - protein, 266 aa, Homo sapiens [sequence omitted]

SEQ ID NO: 835597 - protein, 128 aa, Homo sapiens
LVRGFQSSSIRGNHGNVPFGAIQEIHAHLIPDSATYWLWGSLSSEPDVQVGFTIPKRSFQLLSISTPRAYLQGWGGVQGGNTLRPKLYKPFQHLSPPAWYLQPPCAVPYSPRRGKCCPWAGWGTLDWT

SEQ ID NO: 835598 - protein, 142 aa, Homo sapiens
KRSQAGKEGFLEEDWLPGLRKNIHIHSESEASRSPQSPHCCTSGPPVPLSVAVALPHPSSPSCAGSHPLGSLPSSTPRRQESLSQRCESTRVAPYIHLPSSRPFNASGPFNASGPFNASGPFNASGPFNASGHSTPPAIQRL

SEQ ID NO: 835599 - protein, 57 aa, Homo sapiens
WDDSSSVSSGISDTIDNLSTDDINTSSSISSYANTPASSRKNLDVQVRNTGPPRLLQ

SEQ ID NO: 835600 - protein, 110 aa, Homo sapiens
SSNRAGAGLISLPAQTLAADINRPCKSWLLRDCEKEVPHGPFRSESCGADLWPVLFLTGSQARHFWQQDEPPQSPWDRVKDLATVYVDVLKDSGRDYVSQFEGSALGENS

SEQ ID NO: 835601 - protein, 125 aa, Homo sapiens
SSNRAGAGLISLPAQTLAADINRPCKSWLLRDCEKEVVLLPAPVTLAPQLKVPHGPFRSESCGADLWPVLFLTGSQARHFWQQDEPPQSPWDRVKDLATVYVDVLKDSGRDYVSQFEGSALGENS

SEQ ID NO: 835602 - protein, 82 aa, Homo sapiens
SSNRAGAGLISLPAQTLAADINRPCKSWLLRDCEKEVRPAACPGHSGSPAQGSGLAPGRASGSPTALSGVKAAVLTFGRCSS

SEQ ID NO: 835603 - protein, 267 aa, Homo sapiens
MKAAVLTLAVLFLTGSQARHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 835604 - protein, 125 aa, Homo sapiens; identical to SEQ ID NO: 835601

SEQ ID NO: 835605 - protein, 125 aa, Homo sapiens; identical to SEQ ID NO: 835601

SEQ ID NO: 835606 - protein, 125 aa, Homo sapiens; identical to SEQ ID NO: 835601

SEQ ID NO: 835607 - protein, 115 aa, Homo sapiens
MCSKTAPFSKLRDNSFGPVDPGSSWGLTLKAKVAALPGTTFQKKWQEEMELYRQKVEPLRAELQEGARQKAARAAREAEPTGRGDARPRARPCGRAAHASGPLQRRAAPALGRAP

SEQ ID NO: 835608 - protein, 110 aa, Homo sapiens; identical to SEQ ID NO: 835600

SEQ ID NO: 835609 - protein, 110 aa, Homo sapiens; identical to SEQ ID NO: 835600

SEQ ID NO: 835610 - protein, 122 aa, Homo sapiens
SSNRAGAGLISLPAQTLAADINRPCKSWLLRDCEKEVRPAACPGHSGSPAQGSGLAPGRASGYLRSSPALCPSPHLAAMSGGARGFCMLKAPHSARPFFSSRSPTALSGVKAAVLTFGRCSS

SEQ ID NO: 835611 - protein, 125 aa, Homo sapiens; identical to SEQ ID NO: 835601

SEQ ID NO: 835612 - protein, 115 aa, Homo sapiens
SSNRAGAGLISLPAQTLAADINRPCKSWLLRDCEKEVVLLPAPVTLAPQLKVPHGPFRSESCGADLWPVLFLTGSQARHFWQQDEPPQSPWDRVKDLATVYVDVLKDSTFQQAAR

SEQ ID NO: 835613 - protein, 110 aa, Homo sapiens; identical to SEQ ID NO: 835600

SEQ ID NO: 835614 - protein, 267 aa, Homo sapiens; identical to SEQ ID NO: 835603

SEQ ID NO: 835615 - protein, 267 aa, Homo sapiens; identical to SEQ ID NO: 835603

SEQ ID NO: 835616 - protein, 267 aa, Homo sapiens; identical to SEQ ID NO: 835603

SEQ ID NO: 835617 - protein, 749 aa, Homo sapiens
MGRAGAAAVIPGLALLWAVGLGSAAPSPPRLRLSFQELQAWHGLQTFSLERTCCYQALLVDEERGRLFVGAENHVASLNLDNISKRAKKLAWPAPVEWREECNWAGKDIGTECMNFVKLLHAYNRTHLLACGTGAFHPTCAFVEVGHRAEEPVLRLDPGRIEDGKGKSPYDPRHRAASVLVGEELYSGVAADLMGRDFTIFRSLGQRPSLRTEPHDSRWLNEPKFVKVFWIPESENPDDDKIYFFFRETAVEAAPALGRLSVSRVGQICRNDVGGQRSLVNKWTTFLKARLVCSVPGVEGDTHFDQLQDVFLLSSRDHRTPLLYAVFSTSSSIFQGSAVCVYSMNDVRRAFLGPFAHKEGPMHQWVSYQGRVPYPRPGMCPSKTFGTFSSTKDFPDDVIQFARNHPLMYNSVLPTGGRPLFLQVGANYTFTQIAADRVAAADGHYDVLFIGTDVGTVLKVISVPKGSRPSAEGLLLEELHVFEDSAAVTSMQISSKRHQLYVASRSAVAQIALHRCAAHGRVCTECCLARDPYCAWDGVACTRFQPSAKRRFRRQDVRNGDPSTLCSGDSSRPALLEHKVFGVEGSSAFLECEPRSLQARVEWTFQRAGVTAHTQVLAEERTERTARGLLLRRLRRRDSGVYLCAAVEQGFTQPLRRLSLHVLSATQAERLARAEEAAPAAPPGPKLWYRDFLQLVEPGGGGSANSLRMCRPQPALQSLPLESRRKGRNRRTHAPEPRAERGPRSATHW

SEQ ID NO: 835618 - protein, 636 aa, Homo sapiens
MNFVKLLHAYNRTHLLACGTGAFHPTCAFVEVGHRAEEPVLRLDPGRIEDGKGKSPYDPRHRAASVLVGEELYSGVAADLMGRDFTIFRSLGQRPSLRTEPHDSRWLNEPKFVKVFWIPESENPDDDKIYFFFRETAVEAAPALGRLSVSRVGQICRNDVGGQRSLVNKWTTFLKARLVCSVPGVEGDTHFDQLQDVFLLSSRDHRTPLLYAVFSTSSSIFQGSAVCVYSMNDVRRAFLGPFAHKEGPMHQWVSYQGRVPYPRPGMCPSKTFGTFSSTKDFPDDVIQFARNHPLMYNSVLPTGGRPLFLQVGANYTFTQIAADRVAAADGHYDVLFIGTDVGTVLKVISVPKGSRPSAEGLLLEELHVFEDSAAVTSMQISSKRHQLYVASRSAVAQIALHRCAAHGRVCTECCLARDPYCAWDGVACTRFQPSAKRRFRRQDVRNGDPSTLCSGDSSRPALLEHKVFGVEGSSAFLECEPRSLQARVEWTFQRAGVTAHTQVLAEERTERTARGLLLRRLRRRDSGVYLCAAVEQGFTQPLRRLSLHVLSATQAERLARAEEAAPAAPPGPKLWYRDFLQLVEPGGGGSANSLRMCRPQPALQSLPLESRRKGRNRRTHAPEPRAERGPRSATHW

SEQ ID NO: 835619 - protein, 786 aa, Homo sapiens
MGRAGAAAVIPGLALLWAVGLGSAAPSPPRLRLSFQELQAWHGLQTFSLERTCCYQALLVDEERGRLFVGAENHVASLNLDNISKRAKKLAWPAPVEWREECNWAGKDIGTECMNFVKLLHAYNRTHLLACGTGAFHPTCAFVEVGHRAEEPVLRLDPGRIEDGKGKSPYDPRHRAASVLVGEELYSGVAADLMGRDFTIFRSLGQRPSLRTEPHDSRWLNEPKFVKVFWIPESENPDDDKIYFFFRETAVEAAPALGRLSVSRVGQICRNDVGGQRSLVNKWTTFLKARLVCSVPGVEGDTHFDQLRECGSGYGVGRGAAAQTPGAPAAAGLCALPQLGPFPAEDVFLLSSRDHRTPLLYAVFSTSSSIFQGSAVCVYSMNDVRRAFLGPFAHKEGPMHQWVSYQGRVPYPRPGMCPSKTFGTFSSTKDFPDDVIQFARNHPLMYNSVLPTGGRPLFLQVGANYTFTQIAADRVAAADGHYDVLFIGTDVGTVLKVISVPKGSRPSAEGLLLEELHVFEDSAAVTSMQISSKRHQLYVASRSAVAQIALHRCAAHGRVCTECCLARDPYCAWDGVACTRFQPSAKRRFRRQDVRNGDPSTLCSGDSSRPALLEHKVFGVEGSSAFLECEPRSLQARVEWTFQRAGVTAHTQVLAEERTERTARGLLLRRLRRRDSGVYLCAAVEQGFTQPLRRLSLHVLSATQAERLARAEEAAPAAPPGPKLWYRDFLQLVEPGGGGSANSLRMCRPQPALQSLPLESRRKGRNRRTHAPEPRAERGPRSATHW

SEQ ID NO: 835620 - protein, 576 aa, Homo sapiens
TGHGARGWVVRHCDPGCCARTTGRGSSAWVSHQEARPGPADPCLLPRSEPKFVKVFWIPESENPDDDKIYFFFRETAVEAAPALGRLSVSRVGQICRNDVGGQRSLVNKWTTFLKARLVCSVPGVEGDTHFDQLQDVFLLSSRDHRTPLLYAVFSTSSSIFQGSAVCVYSMNDVRRAFLGPFAHKEGPMHQWVSYQGRVPYPRPGMCPSKTFGTFSSTKDFPDDVIQFARNHPLMYNSVLPTGGRPLFLQVGANYTFTQIAADRVAAADGHYDVLFIGTDVGTVLKVISVPKGSRPSAEGLLLEELHVFEDSAAVTSMQISSKRHQLYVASRSAVAQIALHRCAAHGRVCTECCLARDPYCAWDGVACTRFQPSAKRRFRRQDVRNGDPSTLCSGDSSRPALLEHKVFGVEGSSAFLECEPRSLQARVEWTFQRAGVTAHTQVLAEERTERTARGLLLRRLRRRDSGVYLCAAVEQGFTQPLRRLSLHVLSATQAERLARAEEAAPAAPPGPKLWYRDFLQLVEPGGGGSANSLRMCRPQPALQSLPLESRRKGRNRRTHAPEPRAERGPRSATHW

SEQ ID NO: 835621 - protein, 342 aa, Homo sapiens [sequence omitted]

SEQ ID NO: 835622 - protein, 447 aa, Homo sapiens
ALRIPVGSAEDGRVLRDADPLLYAVFSTSSIFQGSAVCVYSMNDVRRAFLGPFAHKEGPMHQWVSYQGRVPYPRPGMCPSKTFGTFSSTKDFPDDVIQFARNHPLMYNSVLPTGGRPLFLQVGANYTFTQIAADRVAAADGHYDVLFIGTDVGTVLKVISVPKGSRPSAEGLLLEELHVFEDSAAVTSMQISSKRHQLYVASRSAVAQIALHRCAAHGRVCTECCLARDPYCAWDGVACTRFQPSAKRRFRRQDVRNGDPSTLCSGDSSRPALLEHKVFGVEGSSAFLECEPRSLQARVEWTFQRAGVTAHTQVLAEERTERTARGLLLRRLRRRDSGVYLCAAVEQGFTQPLRRLSLHVLSATQAERLARAEEAAPAAPPGPKLWYRDFLQLVEPGGGGSANSLRMCRPQPALQSLPLESRRKGRNRRTHAPEPRAERGPRSATHW

SEQ ID NO: 835623 - protein, 749 aa, Homo sapiens; identical to SEQ ID NO: 835617

SEQ ID NO: 835624 - protein, 749 aa, Homo sapiens; identical to SEQ ID NO: 835617

SEQ ID NO: 835625 - protein, 497 aa, Homo sapiens
MGRAGAAAVIPGLALLWAVGLGSAAPSPPRLRLSFQELQAWHGLQTFSLERTCCYQALLVDEERGRLFVGAENHVASLNLDNISKRAKKLAWPAPVEWREECNWAGKDIGTECMNFVKLLHAYNRTHLLACGTGAFHPTCAFVEVGHRAEEPVLRLDPGRIEDGKGKSPYDPRHRAASVLVGEELYSGVAADLMGRDFTIFRSLGQRPSLRTEPHDSRWLNEPKFVKVFWIPESENPDDDKIYFFFRETAVEAAPALGRLSVSRVGQICRNDVGGQRSLVNKWTTFLKARLVCSVPGVEGDTHFDQLQDVFLLSSRDHRTPLLYAVFSTSSSIFQGSAVCVYSMNDVRRAFLGPFAHKEGPMHQWVSYQGRVPYPRPGMCPSKTFGTFSSTKDFPDDVIQFARNHPLMYNSVLPTGGRPLFLQVGANYTFTQIAADRVAAADGHYDVLFIGTDVGTVLKVISVPKGSRPSAEGLLLEELHVFEVRPHPQSPGTPPPH

SEQ ID NO: 835626 - protein, 396 aa, Homo sapiens [sequence omitted]

SEQ ID NO: 835627 - protein, 261 aa, Homo sapiens [sequence omitted]

SEQ ID NO: 835628 - protein, 749 aa, Homo sapiens; identical to SEQ ID NO: 835617

SEQ ID NO: 835629 - protein, 851 aa, Homo sapiens
MGRAGAAAVIPGLALLWAVGLGSAAPSPPRLRLSFQELQAWHGLQTFSLERTCCYQALLVDEERGRLFVGAENHVASLNLDNISKRAKKLAWPAPVEWREECNWAGKDIGTECMNFVKLLHAYNRTHLLACGTGAFHPTCAFVEVGHRAEEPVLRLDPGRIEDGKGKSPYDPRHRAASVLVGEELYSGVAADLMGRDFTIFRSLGQRPSLRTEPHDSRWLNEPKFVKVFWIPESENPDDDKIYFFFRETAVEAAPALGRLSVSRVGQICRNDVGGQRSLVNKWTTFLKARLVCSVPGVEGDTHFDQLQDVFLLSSRDHRTPLLYAVFSTSSSIFQGSAVCVYSMNDVRRAFLGPFAHKEGPMHQWVSYQGRVPYPRPGMVRSPGTSATTHFKSLKGLRTWPGVFLVNVVSSFSYGWENVSIIRQGLFPASDFLGKADLLSNSQGRVLSPSPSMFPEAGHGGLPIKPPYLYSLLCLPFPHPQCPSKTFGTFSSTKDFPDDVIQFARNHPLMYNSVLPTGGRPLFLQVGANYTFTQIAADRVAAADGHYDVLFIGTDVGTVLKVISVPKGSRPSAEGLLLEELHVFEDSAAVTSMQISSKRHQLYVASRSAVAQIALHRCAAHGRVCTECCLARDPYCAWDGVACTRFQPSAKRRFRRQDVRNGDPSTLCSGDSSRPALLEHKVFGVEGSSAFLECEPRSLQARVEWTFQRAGVTAHTQVLAEERTERTARGLLLRRLRRRDSGVYLCAAVEQGFTQPLRRLSLHVLSATQAERLARAEEAAPAAPPGPKLWYRDFLQLVEPGGGGSANSLRMCRPQPALQSLPLESRRKGRNRRTHAPEPRAERGPRSATHW

SEQ ID NO: 835630 - protein, 592 aa, Homo sapiens
ELHFASRHTRGSPTQGELQASVITLLHHVCHLVSPIQYTLNRNEPPFANPAGQRDSCGRPRWLNEPKFVKVFWIPESENPDDDKIYFFFRETAVEAAPALGRLSVSRVGQICRNDVGGQRSLVNKWTTFLKARLVCSVPGVEGDTHFDQLQDVFLLSSRDHRTPLLYAVFSTSSSIFQGSAVCVYSMNDVRRAFLGPFAHKEGPMHQWVSYQGRVPYPRPGMCPSKTFGTFSSTKDFPDDVIQFARNHPLMYNSVLPTGGRPLFLQVGANYTFTQIAADRVAAADGHYDVLFIGTDVGTVLKVISVPKGSRPSAEGLLLEELHVFEDSAAVTSMQISSKRHQLYVASRSAVAQIALHRCAAHGRVCTECCLARDPYCAWDGVACTRFQPSAKRRFRRQDVRNGDPSTLCSGDSSRPALLEHKVFGVEGSSAFLECEPRSLQARVEWTFQRAGVTAHTQVLAEERTERTARGLLLRRLRRRDSGVYLCAAVEQGFTQPLRRLSLHVLSATQAERLARAEEAAPAAPPGPKLWYRDFLQLVEPGGGGSANSLRMCRPQPALQSLPLESRRKGRNRRTHAPEPRAERGPRSATHW

SEQ ID NO: 835631 - protein, 613 aa, Homo sapiens
TGHGARGWVVRHCDPGCCARTTGRGSSAWVSHQEARPGPADPCLLPRSEPKFVKVFWIPESENPDDDKIYFFFRETAVEAAPALGRLSVSRVGQICRNDVGGQRSLVNKWTTFLKARLVCSVPGVEGDTHFDQLRECGSGYGVGRGAAAQTPGAPAAAGLCALPQLGPFPAEDVFLLSSRDHRTPLLYAVFSTSSSIFQGSAVCVYSMNDVRRAFLGPFAHKEGPMHQWVSYQGRVPYPRPGMCPSKTFGTFSSTKDFPDDVIQFARNHPLMYNSVLPTGGRPLFLQVGANYTFTQIAADRVAAADGHYDVLFIGTDVGTVLKVISVPKGSRPSAEGLLLEELHVFEDSAAVTSMQISSKRHQLYVASRSAVAQIALHRCAAHGRVCTECCLARDPYCAWDGVACTRFQPSAKRRFRRQDVRNGDPSTLCSGDSSRPALLEHKVFGVEGSSAFLECEPRSLQARVEWTFQRAGVTAHTQVLAEERTERTARGLLLRRLRRRDSGVYLCAAVEQGFTQPLRRLSLHVLSATQAERLARAEEAAPAAPPGPKLWYRDFLQLVEPGGGGSANSLRMCRPQPALQSLPLESRRKGRNRRTHAPEPRAERGPRSATHW

SEQ ID NO: 835632 - protein, 382 aa, Homo sapiens
VTILMLERPHIYIPAVPPVSPTSTKDFPDDVIQFARNHPLMYNSVLPTGGRPLFLQVGANYTFTQIAADRVAAADGHYDVLFIGTDVGTVLKVISVPKGSRPSAEGLLLEELHVFEDSAAVTSMQISSKRHQLYVASRSAVAQIALHRCAAHGRVCTECCLARDPYCAWDGVACTRFQPSAKRRFRRQDVRNGDPSTLCSGDSSRPALLEHKVFGVEGSSAFLECEPRSLQARVEWTFQRAGVTAHTQVLAEERTERTARGLLLRRLRRRDSGVYLCAAVEQGFTQPLRRLSLHVLSATQAERLARAEEAAPAAPPGPKLWYRDFLQLVEPGGGGSANSLRMCRPQPALQSLPLESRRKGRNRRTHAPEPRAERGPRSATHW

SEQ ID NO: 835633 - protein, 449 aa, Homo sapiens
ADGSSPCSVPSPHPFLGCVSTLWMLPNPHSSSPHSSQPKHAEGRRLKGEETLAPAVREHQWSLPLLIPADVGTVLKVISVPKGSRPSAEGLLLEELHVFEDSAAVTSMQISSKRVSDQDGGRGGMELSLCLARPKPLAPFGSLQSRALSTGSGFVRLCDLRRKTSVFPSVEWKKGSLTDGRQAWGRPRSAQSPSCPQHQLYVASRSAVAQIALHRCAAHGRVCTECCLARDPYCAWDGVACTRFQPSAKRRFRRQDVRNGDPSTLCSGDSSRPALLEHKVFGVEGSSAFLECEPRSLQARVEWTFQRAGVTAHTQVLAEERTERTARGLLLRRLRRRDSGVYLCAAVEQGFTQPLRRLSLHVLSATQAERLARAEEAAPAAPPGPKLWYRDFLQLVEPGGGGSANSLRMCRPQPALQSLPLESRRKGRNRRTHAPEPRAERGPRSATHW

SEQ ID NO: 835634 - protein, 443 aa, Homo sapiens
MGRAGAAAVIPGLALLWAVGLGSAAPSPPRLRLSFQELQAWHGLQTFSLERTCCYQALLVDEERGRLFVGAENHVASLNLDNISKRAKKLAWPAPVEWREECNWAGKDIGTECMNFVKLLHAYNRTHLLACGTGAFHPTCAFVEVGHRAEEPVLRLDPGRIEDGKGKSPYDPRHRAASVLVGEELYSGVAADLMGRDFTIFRSLGQRPSLRTEPHDSRWLNEPKFVKVFWIPESENPDDDKIYFFFRETAVEAAPALGRLSVSRVGQICRNDVGGQRSLVNKWTTFLKARLVCSVPGVEGDTHFDQLQDVFLLSSRDHRTPLLYAVFSTSSSIFQGSAVCVYSMNDVRRAFLGPFAHKEGPMHQWVSYQGRVPYPRPGMCPSKTFGTFSSTKDFPDDVIQFARNHPLMYNSVLPTGGGAAPPFSLTKLGGPKFYNPFNQKFPA

SEQ ID NO: 835635 - protein, 277 aa, Homo sapiens
MGRAGAAAVIPGLALLWAVGLGSAAPSPPRLRLSFQELQAWHGLQTFSLERTCCYQALLVDEERGRLFVGAENHVASLNLDNISKRAKKLAWPAPVEWREECNWAGKDIGTECMNFVKLLHAYNRTHLLACGTGAFHPTCAFVEVGHRAEEPVLRLDPGRIEDGKGKSPYDPRHRAASVLVGEELYSGVAADLMGRDFTIFRSLGQRPSLRTEPHDSRWLNEPKFVKVFWIPESENPDDDKIYFFFRETAVEAAPALGRLSVSRVGQICRVRSPWAT

SEQ ID NO: 835636 - protein, 261 aa, Homo sapiens [sequence omitted]

SEQ ID NO: 835637 - protein, 1260 aa, Homo sapiens
QNHSGSSARGNLSGKPDDWPQDMKEYVERCFTACESEEDKDRTEKLLKEVLQARLQDGSAYTIDWSREPLPGLTREPVAESPKKKRWEAASSLHPPRGAGSATRGGGAPSQRGTPGAGGAGRARGNSFTKFGNRNVFMKDNSSSSSTDSRSRSSSRSPTRHFRRSDSHSDSDSSYSGNECHPVGRRNPPPKGRGGRGAHMDRGRGRAQRGKRHDLAPTKRSRKKMAALECEDPERELKKQKRAARFQHGHSRRLRLEPLVLQMSSLESSGADPDWQELQIVGTCPDITKHYLRLTCAPDPSTVRPVAVLKKSLCMVKCHWKEKQDYAFACEQMKSIRQDLTVQGIRTEFTVEVYETHARIALEKGDHEEFNQCQTQLKSLYAENLPGNVGEFTAYRILYYIFTKNSGDITTELAYLTRELKADPCVAHALALREPAGWHSGVVAVLLIAWVVVGVSLQRRIRDSEKAVWLPRSTPYTPRSRWRPTWVINVAQIGLLSTAWWLGQAERMAWRRRCTRTRSGRRPVRPWPASASQELPAALPSPAAMGLWPVHSTCPRQKPQLCSSSSTTSGTSSTTMPTPTATTIPCPQSPAWMRACPTRLPLSSCRRLSPLSPQIPHMGLTTLNSGPQPGTAPATQHSQAGPATGQAYGPHTYTEPAKPKKGQQLWNRMKPAPGTGGLKFNIQKRPFAVTTQSFGSNAEGQHSGFGPQPNPEKVQNHSGSSARGNLSGKPDDWPQDMKEYVERCFTACESEEDKDRTEKLLKEVLQARLQDGSAYTIDWSREPLPGLTREPVAESPKKKRWEAASSLHPPRGAGSATRGGGAPSQRGTPGAGGAGRARGNSFTKFGNRNVFMKDNSSSSSTDSRSRSSSRSPTRHFRRSDSHSDSDSSYSGNECHPVGRRNPPPKGRGGRGAHMDRGRGRAQRGKRHDLAPTKRSRKKMAALECEDPERELKKQKRAARFQHGHSRRLRLEPLVLQMSSLESSGADPDWQELQIVGTCPDITKHYLRLTCAPDPSTVRPVAVLKKSLCMVKCHWKEKQDYAFACEQMKSIRQDLTVQGIRTEFTVEVYETHARIALEKGDHEEFNQCQTQLKSLYAENLPGNVGEFTAYRILYYIFTKNSGDITTELAYLTRELKADPCVAHALALRTAWALGNYHRFFRLYCHAPCMSGYLVDKFADRERKVALKAMIKTYVVPSSLLPLLFPSFRLVSSCIKLSPCPLLPLPPVFLLIFFSPFPPSLSAFFPWFSTGKTVPLPPSSAM

SEQ ID NO: 835638 - protein, 874 aa, Homo sapiens
MAANVGDQRSTDWSSQYSMVAGAGRENGMETPMHENPEWEKARQALASISKSGAAGGSAKSSSNGPVASAQYVSQAEASALQQQQYYQWYQQYNYAYPYSYYYPMSMYQSYGSPSQYGMAGSYGSATPQQPSAPQHQGTLNQPPVPGMDESMSYQAPPQQLPSAQPPQPSNPPHGAHTLNSGPQPGTAPATQHSQAGPATGQAYGPHTYTEPAKPKKGQQLWNRMKPAPGTGGLKFNIQKRPFAVTTQSFGSNAEGQHSGFGPQPNPEKVQNHSGSSARGNLSGKPDDWPQDMKEYVERCFTACESEEDKDRTEKLLKEVLQARLQDGSAYTIDWSREPLPGLTREPVAESPKKKRWEAASSLHPPRGAGSATRGGGAPSQRGTPGAGGAGRARGNSFTKFGNRNVFMKDNSSSSSTDSRSRSSSRSPTRHFRRSDSHSDSDSSYSGNECHPVGRRNPPPKGRGGRGAHMDRGRGRAQRGKRHDLAPTKRSRKKMAALECEDPERELKKQKRAARFQHGHSRRLRLEPLVLQMSSLESSGADPDWQELQIVGTCPDITKHYLRLTCAPDPSTVRPVAVLKKSLCMVKCHWKEKQDYAFACEQMKSIRQDLTVQGIRTEFTVEVYETHARIALEKGDHEEFNQCQTQLKSLYAENLPGNVGEFTAYRILYYIFTKNSGDITTELAYLTRELKADPCVAHALALRTAWALGNYHRFFRLYCHAPCMSGYLVDKFADRERKVALKAMIKTYVVPSSLLPLLFPSFRLAPPLRPAPGRRPPPAPNPCPGPCFPIIFLHSALPSPVPLALLVGHLCVPGHSSPSPHCSQLTASGASSPPHLCVSSSCSLLPGPPSSLLALGFLRTLRSLLSQLVAVLPP

SEQ ID NO: 835639 - protein, 874 aa, Homo sapiens; identical to SEQ ID NO: 835638

SEQ ID NO: 835640 - protein, 874 aa, Homo sapiens; identical to SEQ ID NO: 835638

SEQ ID NO: 835641 - protein, 856 aa, Homo sapiens
MVAGAGRENGMETPMHENPEWEKARQALASISKSGAAGGSAKSSSNGPVASAQYVSQAEASALQQQQYYQWYQQYNYAYPYSYYYPMSMYQSYGSPSQYGMAGSYGSATPQQPSAPQHQGTLNQPPVPGMDESMSYQAPPQQLPSAQPPQPSNPPHGAHTLNSGPQPGTAPATQHSQAGPATGQAYGPHTYTEPAKPKKGQQLWNRMKPAPGTGGLKFNIQKRPFAVTTQSFGSNAEGQHSGFGPQPNPEKVQNHSGSSARGNLSGKPDDWPQDMKEYVERCFTACESEEDKDRTEKLLKEVLQARLQDGSAYTIDWSREPLPGLTREPVAESPKKKRWEAASSLHPPRGAGSATRGGGAPSQRGTPGAGGAGRARGNSFTKFGNRNVFMKDNSSSSSTDSRSRSSSRSPTRHFRRSDSHSDSDSSYSGNECHPVGRRNPPPKGRGGRGAHMDRGRGRAQRGKRHDLAPTKRSRKKMAALECEDPERELKKQKRAARFQHGHSRRLRLEPLVLQMSSLESSGADPDWQELQIVGTCPDITKHYLRLTCAPDPSTVRPVAVLKKSLCMVKCHWKEKQDYAFACEQMKSIRQDLTVQGIRTEFTVEVYETHARIALEKGDHEEFNQCQTQLKSLYAENLPGNVGEFTAYRILYYIFTKNSGDITTELAYLTRELKADPCVAHALALRTAWALGNYHRFFRLYCHAPCMSGYLVDKFADRERKVALKAMIKTYVVPSSLLPLLFPSFRLAPPLRPAPGRRPPPAPNPCPGPCFPIIFLHSALPSPVPLALLVGHLCVPGHSSPSPHCSQLTASGASSPPHLCVSSSCSLLPGPPSSLLALGFLRTLRSLLSQLVAVLPP

SEQ ID NO: 835642 - protein, 837 aa, Homo sapiens
MAANVGDQRSTDWSSQYSMVAGAGRENGMETPMHENPEWEKARQALASISKSGAAGGSAKSSSNGPVASAQYVSQAEASALQQQQYYQWYQQYNYAYPYSYYYPMPPVPGMDESMSYQAPPQQLPSAQPPQPSNPPHGAHTLNSGPQPGTAPATQHSQAGPATGQAYGPHTYTEPAKPKKGQQLWNRMKPAPGTGGLKFNIQKRPFAVTTQSFGSNAEGQHSGFGPQPNPEKVQNHSGSSARGNLSGKPDDWPQDMKEYVERCFTACESEEDKDRTEKLLKEVLQARLQDGSAYTIDWSREPLPGLTREPVAESPKKKRWEAASSLHPPRGAGSATRGGGAPSQRGTPGAGGAGRARGNSFTKFGNRNVFMKDNSSSSSTDSRSRSSSRSPTRHFRRSDSHSDSDSSYSGNECHPVGRRNPPPKGRGGRGAHMDRGRGRAQRGKRHDLAPTKRSRKKMAALECEDPERELKKQKRAARFQHGHSRRLRLEPLVLQMSSLESSGADPDWQELQIVGTCPDITKHYLRLTCAPDPSTVRPVAVLKKSLCMVKCHWKEKQDYAFACEQMKSIRQDLTVQGIRTEFTVEVYETHARIALEKGDHEEFNQCQTQLKSLYAENLPGNVGEFTAYRILYYIFTKNSGDITTELAYLTRELKADPCVAHALALRTAWALGNYHRFFRLYCHAPCMSGYLVDKFADRERKVALKAMIKTYVVPSSLLPLLFPSFRLAPPLRPAPGRRPPPAPNPCPGPCFPIIFLHSALPSPVPLALLVGHLCVPGHSSPSPHCSQLTASGASSPPHLCVSSSCSLLPGPPSSLLALGFLRTLRSLLSQLVAVLPP

SEQ ID NO: 835643 - protein, 874 aa, Homo sapiens; identical to SEQ ID NO: 835638

SEQ ID NO: 835644 - protein, 467 aa, Homo sapiens [sequence omitted]

SEQ ID NO: 835645 - protein, 604 aa, Homo sapiens
QNHSGSSARGNLSGKPDDWPQDMKEYVERCFTACESEEDKDRTEKLLKEVLQARLQDGSAYTIDWSREPLPGLTREPVAESPKKKRWEAASSLHPPRGAGSATRGGGAPSQRGTPGAGGAGRARGNSFTKFGNRNVFMKDNSSSSSTDSRSRSSSRSPTRHFRRSDSHSDSDSSYSGNECHPVGRRNPPPKGRGGRGAHMDRGRGRAQRGKRHDLAPTKRSRKKMAALECEDPERELKKQKRAARFQHGHSRRLRLEPLVLQMSSLESSGADPDWQELQIVGTCPDITKHYLRLTCAPDPSTVRPVAVLKKSLCMVKCHWKEKQDYAFACEQMKSIRQDLTVQGIRTEFTVEVYETHARIALEKGDHEEFNQCQTQLKSLYAENLPGNVGEFTAYRILYYIFTKNSGDITTELAYLTRELKADPCVAHALALRTAWALGNYHRFFRLYCHAPCMSGYLVDKFADRERKVALKAMIKTYVVPSSLLPLLFPSFRLAPPLRPAPGRRPPPAPNPCPGPCFPIIFLHSALPSPVPLALLVGHLCVPGHSSPSPHCSQLTASGASSPPHLCVSSSCSLLPGPPSSLLALGFLRTLRSLLSQLVAVLPP

SEQ ID NO: 835646 - protein, 874 aa, Homo sapiens; identical to SEQ ID NO: 835638

SEQ ID NO: 835647 - protein, 874 aa, Homo sapiens; identical to SEQ ID NO: 835638

SEQ ID NO: 835648 - protein, 800 aa, Homo sapiens
MAANVGDQRSTDWSSQYSMVAGAGRENGMETPMHENPEWEKARQALASISKSGAAGGSAKSSSNGPVASAQYVSQAEASALQQQQYYQWYQQYNYAYPYSYYYPMSMYQSYGSPSQYGMAGSYGSATPQQPSAPQHQGTLNQPPVPGMDESMSYQAPPQQLPSAQPPQPSNPPHGAHTLNSGPQPGTAPATQHSQAGPATGQAYGPHTYTEPAKPKKGQQLWNRMKPAPGTGGLKFNIQKRPFAVTTQSFGSNAEGQHSGFGPQPNPEKVQNHSGSSARGNLSGKPDDWPQDMKEYVERCFTACESEEDKDRTEKLLKEVLQARLQDGSAYTIDWSREPLPGLTREPVAESPKKKRWEAASSLHPPRGAGSATRGGGAPSQRGTPGAGGAGRARGNSFTKFGNRNVFMKDNSSSSSTDSRSRSSSRSPTRHFRRSDSHSDSDSSYSGNECHPVGRRNPPPKGRGGRGAHMDRGRGRAQRGKRHDLAPTKRSRKKMAALECEDPERELKKQKRAARFQHGHSRRLRLEPLVLQMSSLESSGADPDWQELQIVGTCPDITKHYLRLTCAPDPSTVRPVAVLKKSLCMVKCHWKEKQDYAFACEQMKSIRQDLTVQGIRTEFTVEVYETHARIALEKGDHEEFNQCQTQLKSLYAENLPGNVGEFTAYRILYYIFTKNSGDITTELAYLTRELKADPCVAHALALRTAWALGNYHRFFRLYCHAPCMSGYLVDKFADRERKVALKAMIKTFRPALPVSYLQAELAFEGEAACRAFLEPLGLAYTGPDNSSIDCRLSLAQLSAF

SEQ ID NO: 835649 - protein, 833 aa, Homo sapiens
MAANVGDQRSTDWSSQYSMVAGAGRENGMETPMHENPEWEKARQALASISKSGAAGGSAKSSSNGPVASAQYVSQAEASALQQQQYYQWYQQYNYAYPYSYYYPMSMYQSYGSPSQYGMAGSYGSATPQQPSAPQHQGTLNQPPVPGMDESMSYQAPPQQLPSAQPPQPSNPPHGAHTLNSGPQPGTAPATQHSQAGPATGQAYGPHTYTEPAKPKKGQQLWNRMKPAPGTGGLKFNIQKRPFAVTTQSFGSNAEGQHSGFGPQPNPEKVQNHSGSSARGNLSGKPDDWPQDMKEYVERCFTACESEEDKDRTEKLLKEVLQARLQDGSAYTIDWSREPLPGLTREPVAESPKKKRWEAASSLHPPRGAGSATRGGGAPSQRGTPGAGGAGRARGNSFTKFGNRNVFMKDNSSSSSTDSRSRSSSRSPTRHFRRSDSHSDSDSSYSGNECHPVGRRNPPPKGRGGRGAHMDRGRGRAQRGKRHDLAPTKRSRKKMAALECEDPERELKKQKRAARFQHGHSRRLRLEPLVLQMSSLESSGADPDWQELQIVGTCPDITKHYLRLTCAPDPSTVRPVAVLKKSLCMVKCHWKEKQDYAFACEQMKSIRQDLTVQGIRTEFTVEVYETHARIALEKGDHEEFNQCQTQLKSLYAENLPGNVGEFTAYRILYYIFTKNSGDITTELAYLTRELKADPCVAHALALRTAWALGNYHRFFRLYCHAPCMSGYLVDKFADRERKVALKAMIKTYVVPSSLLPLLFPSFRLVSSCIKLSPCPLLPLPPVFLLIFFSPFPPSLSAFFPWFSTGKTVPLPPCLHGSPAHVMLPSLFFVCVFI

SEQ ID NO: 835650 - protein, 874 aa, Homo sapiens; identical to SEQ ID NO: 835638

SEQ ID NO: 835651 - protein, 874 aa, Homo sapiens; identical to SEQ ID NO: 835638

SEQ ID NO: 835652 - protein, 361 aa, Homo sapiens
MCGARLARGCNTKAGPFVLGPGRRTPLGFCRLSGAPRDSQGLCFLAPQQCGPGGCCWLQCLLSHSGEASSWGQCSQISSCAQRPLLGRLQLSGFLHAWFLVPCAERPCAPSLGGSLGLLTCPRQCPLGTLCPVGALGVRCVQDGGPASRRRARAKDEVGARGAVPHKAAMEAEEAHAVLGHCQHARPERRQRLVPAKGAEGLLAHTQKAVDVAHREVGGVEARVPADALDDVRGCAQRRLLGPGLRCASRPGGAGAPGWGWRQRAPKRQRPSRKKRQAGGGAGSVAGASCGNSGSLAAAMGAGNWHARRADEVAPHGGRLPMDAPSLTRQWRQRPALRPSSGDHAACPREDSGPVPPWWRA

SEQ ID NO: 835653 - protein, 180 aa, Homo sapiens
MAANVGDQRSTDWSSQYSMVAGAGRENGMETPMHENPEWEKARQALASISKSGAAGGSAKSSSNGPVASAQYVSQAEASALQQQQYYQWYQQYNYAYPYSYYYPMSMYQSYGSPSQYGMAGSYGSATPQQPSAPQHQGTLNQPPVPGMDESMSYQAPPQQLPSAQPPQPWSPWDPLDHMQ

SEQ ID NO: 835654 - protein, 134 aa, Homo sapiens
MAANVGDQRSTDWSSQYSMVAGAGRENGMETPMHENPEWEKARQALASISKSGAAGGSAKSSSNGPVASAQYVSQAEASALQQQQYYQWYQQYNYAYPYSYYYPMVSAQPVGPPLPSFSFLPSFPWSTEHHLEA

SEQ ID NO: 835655 - protein, 874 aa, Homo sapiens; identical to SEQ ID NO: 835638

SEQ ID NO: 835656 - protein, 856 aa, Homo sapiens; identical to SEQ ID NO: 835641

SEQ ID NO: 835657 - protein, 874 aa, Homo sapiens; identical to SEQ ID NO: 835638

SEQ ID NO: 835658 - protein, 893 aa, Homo sapiens
WSPDPDVTLLAEALVTVTNIEVINCSITEIETTTSSIPGASDTGLIPMEGVKASSTSDPPALPDSTNTKPHITEVTASAETLSTAGTTESAAPHATVGTPLPTEESVTLSLWGYAYPYSYYYPMSMYQSYGSPSQYGMAGSYGSATPQQPSAPQHQGTLNQPPVPGMDESMSYQAPPQQLPSAQPPQPSNPPHGAHTLNSGPQPGTAPATQHSQAGPATGQAYGPHTYTEPAKPKKGQQLWNRMKPAPGTGGLKFNIQKRPFAVTTQSFGSNAEGQHSGFGPQPNPEKVQNHSGSSARGNLSGKPDDWPQDMKEYVERCFTACESEEDKDRTEKLLKEVLQARLQDGSAYTIDWSREPLPGLTREPVAESPKKKRWEAASSLHPPRGAGSATRGGGAPSQRGTPGAGGAGRARGNSFTKFGNRNVFMKDNSSSSSTDSRSRSSSRSPTRHFRRSDSHSDSDSSYSGNECHPVGRRNPPPKGRGGRGAHMDRGRGRAQRGKRHDLAPTKRSRKKMAALECEDPERELKKQKRAARFQHGHSRRLRLEPLVLQMSSLESSGADPDWQELQIVGTCPDITKHYLRLTCAPDPSTVRPVAVLKKSLCMVKCHWKEKQDYAFACEQMKSIRQDLTVQGIRTEFTVEVYETHARIALEKGDHEEFNQCQTQLKSLYAENLPGNVGEFTAYRILYYIFTKNSGDITTELAYLTRELKADPCVAHALALRTAWALGNYHRFFRLYCHAPCMSGYLVDKFADRERKVALKAMIKTYVVPSSLLPLLFPSFRLAPPLRPAPGRRPPPAPNPCPGPCFPIIFLHSALPSPVPLALLVGHLCVPGHSSPSPHCSQLTASGASSPPHLCVSSSCSLLPGPPSSLLALGFLRTLRSLLSQLVAVLPP

SEQ ID NO: 835659 - protein, 874 aa, Homo sapiens; identical to SEQ ID NO: 835638

SEQ ID NO: 835660 - protein, 874 aa, Homo sapiens; identical to SEQ ID NO: 835638

SEQ ID NO: 835661 - protein, 874 aa, Homo sapiens; identical to SEQ ID NO: 835638

SEQ ID NO: 835662 - protein, 874 aa, Homo sapiens; identical to SEQ ID NO: 835638

SEQ ID NO: 835663 - protein, 874 aa, Homo sapiens; identical to SEQ ID NO: 835638

SEQ ID NO: 835664 - protein, 874 aa, Homo sapiens; identical to SEQ ID NO: 835638

SEQ ID NO: 835665 - protein, 623 aa, Homo sapiens
MAANVGDQRSTDWSSQYSMVAGAGRENGMETPMHENPEWEKARQALASISKSGAAGGSAKSSSNGPVASAQYVSQAEASALQQQQYYQWYQQYNYAYPYSYYYPMSMYQSYGSPSQYGMAGSYGSATPQQPSAPQHQGTLNQPPVPGMDESMSYQAPPQQLPSAQPPQPSNPPHGAHTLNSGPQPGTAPATQHSQAGPATGQAYGPHTYTEPAKPKKGQQLWNRMKPAPGTGGLKFNIQKRPFAVTTQSFGSNAEGQHSGFGPQPNPEKVQNHSGSSARGNLSGKPDDWPQDMKEYVERCFTACESEEDKDRTEKLLKEVLQARLQDGSAYTIDWSREPLPGLTREPVAESPKKKRWEAASSLHPPRGAGSATRGGGAPSQRGTPGAGGAGRARGNSFTKFGNRNVFMKDNSSSSSTDSRSRSSSRSPTRHFRRSDSHSDSDSSYSGNECHPVGRRNPPPKGRGGRGAHMDRGRGRAQRGKRHDLAPTKRSRKKMAALECEDPERELKKQKRAARFQHGHSRRLRLEPLVLQMSSLESSGADPDWQELQIVGTCPDITKHYLRLTCAPDPSTVRPVAVLKKSLCMVKCHWKEKQDYAFACEQMKSIRQDLTVQGIRTEFLVKM

SEQ ID NO: 835666 - protein, 189 aa, Homo sapiens
MAANVGDQRSTDWSSQYSMVAGAGRENGMETPMHENPEWEKARQALASISKSGAAGGSAKSSSNGPVASAQYVSQAEASALQQQQYYQWYQQYNYAYPYSYYYPMSMYQSYGSPSQYGMAGSYGSATPQQPSAPQHQGTLNQPPVPGMDESMSYQAPPQQLPSAQPPQPLKSLAFKCTHTPRELLTANK

SEQ ID NO: 835667 - protein, 148 aa, Homo sapiens
MAANVGDQRSTDWSSQYSMVAGAGRENGMETPMHENPEWEKARQALASISKSGAAGGSAKSSSNGPVASAQYVSQAEASALQQQQYYQWYQQYNYAYPLASGGCGQNVNHWTGYSCSSLGSPLGQSDWSYFEAVSAAAHPIAAPQHCW

SEQ ID NO: 835668 - protein, 670 aa, Homo sapiens
KTQTQRIKGKQRKNAQLKKKIMFLFFPLDHFHELYKVILLPNQTHYIIPKGECLPYFSFAEVAKRGVEGAYSDNPIIRHASIANKWKTIHLIMHSGMNATTIHFNLTFQNTNDEEFKMQITVEVDTREGPKLNSTAQKGYENLVSPITLLPEAEILFEDIPKEKRFPKFKRHDVNSTRRAQEEVKIPLVNISLLPKDAQLSLNTLDLQLEHGDITLKGYNLSKSALLRSFLMNSQHAKIKNQAIITDETNDSLVAPQEKQVHKSILPNSLGVSERLQRLTFPAVSVKVNGHDQGQNPPLDLETTARFRVETHTQKTIGGNVTKEKPPSLIVPLESQMTKEKKITGKEKENSRMEENAENHIGVTEVLLGRKLQHYTDSYLGFLPWEKKKYFQDLLDEEESLKTQLAYFTDSKNTGRQLKDTFADSLRYVNKILNSKFGFTSRKVPAHMPHMIDRIVMQELQDMFPEEFDKTSFHKVRHSEDMQFAFSYFYYLMSAVQPLNISQVFDEVDTDQSGVLSDREIRTLATRIHELPLSLQDLTGLEHMLINCSKMLPADITQLNNIPPTQESYYDPNLPPVTKSLVTNCKPVTDKIHKAYKDKNKYRFEIMGEEEIAFKMIRTNVSHVVGQLDDIRKNPRISLCCPSWNAVMQTWLTVASTSWAQAILPPQPPD

SEQ ID NO: 835669 - protein, 907 aa, Homo sapiens
LKFRKTSWCVTIVTRGLSRFSQDGICPLVTMKIFRTHGACLSIHRIEGLSQKFIYLNDDVMFGKDVWPDDFYSHSKGQKVYLTWPVPNCAEGCPGSWIKDGYCDKACNNSACDWDGGDCSGNSGGSRYIAGGGGTGSIGVGQPWQFGGGINSVSYCNQGCANSWLADKFCDQACNVLSCGFDAGDCGQDHFHELYKVILLPNQTHYIIPKGECLPYFSFAEVAKRGVEGAYSDNPIIRHASIANKWKTIHLIMHSGMNATTIHFNLTFQNTNDEEFKMQITVEVDTREGPKLNSTAQKGYENLVSPITLLPEAEILFEDIPKEKRFPKFKRHDVNSTRRAQEEVKIPLVNISLLPKDAQLSLNTLDLQLEHGDITLKGYNLSKSALLRSFLMNSQHAKIKNQAIITDETNDSLVAPQEKQVHKSILPNSLGVSERLQRLTFPAVSVKVNGHDQGQNPPLDLETTARFRVETHTQKTIGGNVTKEKPPSLIVPLESQMTKEKKITGKEKENSRMEENAENHIGVTEVLLGRKLQHYTDSYLGFLPWEKKKYFQDLLDEEESLKTQLAYFTDSKNTGRQLKDTFADSLRYVNKILNSKFGFTSRKVPAHMPHMIDRIVMQELQDMFPEEFDKTSFHKVRHSEDMQFAFSYFYYLMSAVQPLNISQVFDEVDTDQSGVLSDREIRTLATRIHELPLSLQDLTGLEHMLINCSKMLPADITQLNNIPPTQESYYDPNLPPVTKSLVTNCKPVTDKIHKAYKDKNKYRFEIMGEEEIAFKMIRTNVSHVVGQLDDIRKNPRKFVCLNDNIDHNHKDAQTVKAVLRDFYESMFPIPSQFELPREYRNRFLHMHELQEWRAYRDKLKFWTHCVLATLIMFTIFSFFAEQLIALKRKIFPRRRIHKEASPNRIRV

SEQ ID NO: 835670 - protein, 655 aa, Homo sapiens
MHSGMNATTIHFNLTFQNTNDEEFKMQITVEVDTREGPKLNSTAQKGYENLVSPITLLPEAEILFEDIPKEKRFPKFKRHDVNSTRRAQEEVKIPLVNISLLPKDAQLSLNTLDLQLEHGDITLKGYNLSKSALLRSFLMNSQHAKIKNQAIITDETNDSLVAPQEKQVHKSILPNSLGVSERLQRLTFPAVSVKVNGHDQGQNPPLDLETTARFRVETHTQKTIGGNVTKEKPPSLIVPLESQMTKEKKITGKEKENSRMEENAENHIGVTEVLLGRKLQHYTDSYLGFLPWEKKKYFQDLLDEEESLKTQLAYFTDSKNTGRQLKDTFADSLRYVNKILNSKFGFTSRKVPAHMPHMIDRIVMQELQDMFPEEFDKTSFHKVRHSEDMQFAFSYFYYLMSAVQPLNISQVFDEVDTDQSGVLSDREIRTLATRIHELPLSLQDLTGLEHMLINCSKMLPADITQLNNIPPTQESYYDPNLPPVTKSLVTNCKPVTDKIHKAYKDKNKYRFEIMGEEEIAFKMIRTNVSHVVGQLDDIRKNPRKFVCLNDNIDHNHKDAQTVKAVLRDFYESMFPIPSQFELPREYRNRFLHMHELQEWRAYRDKLKFWTHCVLATLIMFTIFSFFAEQLIALKRKIFPRRRIHKEASPNRIRV

SEQ ID NO: 835671 - protein, 347 aa, Homo sapiens
RSRGSHFWTDSKNTGRQLKDTFADSLRYVNKILNSKFGFTSRKVPAHMPHMIDRIVMQELQDMFPEEFDKTSFHKVRHSEDMQFAFSYFYYLMSAVQPLNISQVFDEVDTDQSGVLSDREIRTLATRIHELPLSLQDLTGLEHMLINCSKMLPADITQLNNIPPTQESYYDPNLPPVTKSLVTNCKPVTDKIHKAYKDKNKYRFEIMGEEEIAFKMIRTNVSHVVGQLDDIRKNPRKFVCLNDNIDHNHKDAQTVKAVLRDFYESMFPIPSQFELPREYRNRFLHMHELQEWRAYRDKLKFWTHCVLATLIMFTIFSFFAEQLIALKRKIFPRRRIHKEASPNRIRV

SEQ ID NO: 835672 - protein, 1059 aa, Homo sapiens
LLKGNSRQTVWRGYLTTDKEVPGLVLMQDLAFLSGFPPTFKETNQLKTKLPENLSSKVKLLQLYSEASVALLKLNNPKDFQELNKQTKKNMTIDGKELTISPAYLLWDLSAISQSKQDEDISASRFEDNEELRYSLRSIERHAPWVRNIFIVTNGQIPSWLNLDNPRVTIVTHQDVFRNLSHLPTFSSPAIESHIHRIEGLSQKFIYLNDDVMFGKDVWPDDFYSHSKGQKVYLTWPVPNCAEGCPGSWIKDGYCDKACNNSACDWDGGDCSGNSGGSRYIAGGGGTGSIGVGQPWQFGGGINSVSYCNQGCANSWLADKFCDQACNVLSCGFDAGDCGQDHFHELYKVILLPNQTHYIIPKGECLPYFSFAEVAKRGVEGAYSDNPIIRHASIANKWKTIHLIMHSGMNATTIHFNLTFQNTNDEEFKMQITVEVDTREGPKLNSTAQKGYENLVSPITLLPEAEILFEDIPKEKRFPKFKRHDVNSTRRAQEEVKIPLVNISLLPKDAQLSLNTLDLQLEHGDITLKGYNLSKSALLRSFLMNSQHAKIKNQAIITDETNDSLVAPQEKQVHKSILPNSLGVSERLQRLTFPAVSVKVNGHDQGQNPPLDLETTARFRVETHTQKTIGGNVTKEKPPSLIVPLESQMTKEKKITGKEKENSRMEENAENHIGVTEVLLGRKLQHYTDSYLGFLPWEKKKYFQDLLDEEESLKTQLAYFTDSKNTGRQLKDTFADSLRYVNKILNSKFGFTSRKVPAHMPHMIDRIVMQELQDMFPEEFDKTSFHKVRHSEDMQFAFSYFYYLMSAVQPLNISQVFDEVDTDQSGVLSDREIRTLATRIHELPLSLQDLTGLEHMLINCSKMLPADITQLNNIPPTQESYYDPNLPPVTKSLVTNCKPVTDKIHKAYKDKNKYRFEIMGEEEIAFKMIRTNVSHVVGQLDDIRKNPRKFVCLNDNIDHNHKDAQTVKAVLRDFYESMFPIPSQFELPREYRNRFLHMHELQEWRAYRDKLKFWTHCVLATLIMFTIFSFFAEQLIALKRKIFPRRRIHKEASPNRIRV

SEQ ID NO: 835673 - protein, 1059 aa, Homo sapiens; identical to SEQ ID NO: 835672

SEQ ID NO: 835674 - protein, 845 aa, Homo sapiens
MGFYHVGQAGLKLLTSGDPASSASQSVEITGVSHHTQSRTVFQNCNYSKKSLFFLRSTGNSGGSRYIAGGGGTGSIGVGQPWQFGGGINSVSYCNQGCANSWLADKFCDQACNVLSCGFDAGDCGQDHFHELYKVILLPNQTHYIIPKGECLPYFSFAEVAKRGVEGAYSDNPIIRHASIANKWKTIHLIMHSGMNATTIHFNLTFQNTNDEEFKMQITVEVDTREGPKLNSTAQKGYENLVSPITLLPEAEILFEDIPKEKRFPKFKRHDVNSTRRAQEEVKIPLVNISLLPKDAQLSLNTLDLQLEHGDITLKGYNLSKSALLRSFLMNSQHAKIKNQAIITDETNDSLVAPQEKQVHKSILPNSLGVSERLQRLTFPAVSVKVNGHDQGQNPPLDLETTARFRVETHTQKTIGGNVTKEKPPSLIVPLESQMTKEKKITGKEKENSRMEENAENHIGVTEVLLGRKLQHYTDSYLGFLPWEKKKYFQDLLDEEESLKTQLAYFTDSKNTGRQLKDTFADSLRYVNKILNSKFGFTSRKVPAHMPHMIDRIVMQELQDMFPEEFDKTSFHKVRHSEDMQFAFSYFYYLMSAVQPLNISQVFDEVDTDQSGVLSDREIRTLATRIHELPLSLQDLTGLEHMLINCSKMLPADITQLNNIPPTQESYYDPNLPPVTKSLVTNCKPVTDKIHKAYKDKNKYRFEIMGEEEIAFKMIRTNVSHVVGQLDDIRKNPRKFVCLNDNIDHNHKDAQTVKAVLRDFYESMFPIPSQFELPREYRNRFLHMHELQEWRAYRDKLKFWTHCVLATLIMFTIFSFFAEQLIALKRKIFPRRRIHKEASPNRIRV

SEQ ID NO: 835675 - protein, 1059 aa, Homo sapiens; identical to SEQ ID NO: 835672

SEQ ID NO: 835676 - protein, 197 aa, Homo sapiens
KSALLRSFLMNSQHAKIKNQAIITDETNDSLVAPQEKQVHKSILPNSLGVSERLQRLTFPAVSVKVNGHDQGQNPPLDLETTARFRVETHTQKTIGGNVTKEKPPSLIVPLESQMTKEKKITGKEKENSRMEENAENHIGVTEVLLGRKLQHYTDSYLGFLPWEKKKYFQDLLDVSNIQPHSFSCSGRVNNLMIISL

SEQ ID NO: 835677 - protein, 798 aa, Homo sapiens
MEIRGALDLRKRQVLIFLVLLGLSRAGTESAHYSVAEETEIGSFVANLARDLGLGVEELSSREARVVSDDNKKYLHLDLLTGNLLLNEKLDRDELCGSTEPCVLHFQVVLENPLQFFRFELCVKDINDHSPTFLDKEILIKISEGTTVGATFLMESAQDLDVGSNSLQNYTISPNSHFYIKIPDSSDRKIYPELVLDRALDYEQEAELRLTLTAVDGGSPPKSGTTLVLIKVLDINDNAPEFPQSLYEVQVPEDRPLGSWIATISAKDLDAGNYGKISYTFFHASEDIRKTFEINPISGEVNLRSPLDFEVIQSYTINIQATDGGGLSGKCTLLVKVMDINDNPPEVTISSITKRIPENASETLVALFSILDQDSGDNGRMICSIQDNLPFFLKPTFKNFFTLVSEKALDRESQAEYNITITVTDLGTPRLKTEYNITVLLSDVNDNAPTFTQTSYTLFVRENNSPALHIGSVSATDRDSGTNAQVNYSLLPPQDRHLPLASLVSINADNGHLFALRSLDYEALQEFEFRVGATDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAASVGRCSVPEGPFPGHLVDVSGTGTLSQSYQYEVCLTGGSGTNEFKFLKPIIPNFQVHDTGRNMGEIENFRNSFGLNIQ

SEQ ID NO: 835678 - protein, 437 aa, Homo sapiens
MSVSARSAAAEERSVNSSTMVAQQKNLEGYVGFANLPNQVYRKSVKRGFEFTLMVVGESGLGKSTLINSLFLTDLYSPEYPGPSHRIKKTVQVEQSKVLIKEGGVQLLLTIVDTPGFGDAVDNSNCWQPVIDYIDSKFEDYLNAESRVNRRQMPDNRVQCCLYFIAPSGHGLKPLDIEFMKRLHEKVNIIPLIAKADTLTPEECQQFKKQIMKEIQEHKIKIYEFPETDDEEENKLVKKIKDRLPLAVVGSNTIIEVNGKRVRGRQYPWGVAEVENGEHCDFTILRNMLIRTHMQDLKDVTNNVHYENYRSRKLAAVTYNGVDNNKNKGQLTKSPLAQMEEERREHVAKMKKMEMEMEQVFEMKVKEKVQKLKDSEAELQRRHEQMKKNLEAQHKELEEKRRQFEDEKANWEAQQRILEQQNSSRTLEKNKKKGKIF

SEQ ID NO: 835679 - protein, 448 aa, Homo sapiens
MSVSARSAAAEERSVNSSTMVAQQKNLEGYVGFANLPNQVYRKSVKRGFEFTLMVVGESGLGKSTLINSLFLTDLYSPEYPGPSHRIKKTVQVEQSKVLIKEGGVQLLLTIVDTPGFGDAVDNSNCWQPVIDYIDSKFEDYLNAESRVNRRQMPDNRVQCCLYFIAPSGHGLKPLDIEFMKRLHEKVNIIPLIAKADTLTPEECQQFKKQIMKEIQEHKIKIYEFPETDDEEENKLVKKIKDRLPLAVVGSNTIIEVNGKRVRGRQYPWGVAEVENGEHCDFTILRNMLIRTHMQDLKDVTNNVHYENYRSRKLAAVTYNGVDNNKNKGQLTKHLMITLNIRDRSPLAQMEEERREHVAKMKKMEMEMEQVFEMKVKEKVQKLKDSEAELQRRHEQMKKNLEAQHKELEEKRRQFEDEKANWEAQQRILEQQNSSRTLEKNKKKGKIF

SEQ ID NO: 835680 - protein, 437 aa, Homo sapiens; identical to SEQ ID NO: 835678

SEQ ID NO: 835681 - protein, 384 aa, Homo sapiens
MVVGESGLGKSTLINSLFLTDLYSPEYPGPSHRIKKTVQVEQSKVLIKEGGVQLLLTIVDTPGFGDAVDNSNCWQPVIDYIDSKFEDYLNAESRVNRRQMPDNRVQCCLYFIAPSGHGLKPLDIEFMKRLHEKVNIIPLIAKADTLTPEECQQFKKQIMKEIQEHKIKIYEFPETDDEEENKLVKKIKDRLPLAVVGSNTIIEVNGKRVRGRQYPWGVAEVENGEHCDFTILRNMLIRTHMQDLKDVTNNVHYENYRSRKLAAVTYNGVDNNKNKGQLTKSPLAQMEEERREHVAKMKKMEMEMEQVFEMKVKEKVQKLKDSEAELQRRHEQMKKNLEAQHKELEEKRRQFEDEKANWEAQQRILEQQNSSRTLEKNKKKGKIF

SEQ ID NO: 835682 - protein, 437 aa, Homo sapiens; identical to SEQ ID NO: 835678

SEQ ID NO: 835683 - protein, 437 aa, Homo sapiens; identical to SEQ ID NO: 835678

SEQ ID NO: 835684 - protein, 384 aa, Homo sapiens; identical to SEQ ID NO: 835681

SEQ ID NO: 835685 - protein, 520 aa, Homo sapiens
MLFLSDPLRRCLRTERVKNGEGKRVAHGVEQRRKSERWLGESAGAGRGGGEGMSVSARSAAAEERSVNSSTMVAQQKNLEGYVGFANLPNQVYRKSVKRGFEFTLMVVEVMFHHVAVANLELLGSSDPSALASQSARITGESGLGKSTLINSLFLTDLYSPEYPGPSHRIKKTVQVEQSKVLIKEGGVQLLLTIVDTPGFGDAVDNSNCWQPVIDYIDSKFEDYLNAESRVNRRQMPDNRVQCCLYFIAPSGHGLKPLDIEFMKRLHEKVNIIPLIAKADTLTPEECQQFKKQIMKEIQEHKIKIYEFPETDDEEENKLVKKIKDRLPLAVVGSNTIIEVNGKRVRGRQYPWGVAEVENGEHCDFTILRNMLIRTHMQDLKDVTNNVHYENYRSRKLAAVTYNGVDNNKNKGQLTKSPLAQMEEERREHVAKMKKMEMEMEQVFEMKVKEKVQKLKDSEAELQRRHEQMKKNLEAQHKELEEKRRQFEDEKANWEAQQRILEQQNSSRTLEKNKKKGKIF

SEQ ID NO: 835686 - protein, 285 aa, Homo sapiens
MPDNRVQCCLYFIAPSGHGLKPLDIEFMKRLHEKVNIIPLIAKADTLTPEECQQFKKQIMKEIQEHKIKIYEFPETDDEEENKLVKKIKDRLPLAVVGSNTIIEVNGKRVRGRQYPWGVAEVENGEHCDFTILRNMLIRTHMQDLKDVTNNVHYENYRSRKLAAVTYNGVDNNKNKGQLTKSPLAQMEEERREHVAKMKKMEMEMEQVFEMKVKEKVQKLKDSEAELQRRHEQMKKNLEAQHKELEEKRRQFEDEKANWEAQQRILEQQNSSRTLEKNKKKGKIF

SEQ ID NO: 835687 - protein, 241 aa, Homo sapiens
MSVSARSAAAEERSVNSSTMVAQQKNLEGYVGFANLPNQVYRKSVKRGFEFTLMVVGESGLGKSTLINSLFLTDLYSPEYPGPSHRIKKTVQVEQSKVLIKEGGVQLLLTIVDTPGFGDAVDNSNCWQPVIDYIDSKFEDYLNAESRVNRRQMPDNRVQCCLYFIAPSGHGLKPLDIEFMKRLHEKVNIIPLIAKADTLTPEECQQFKKQIMKEIQEHKIKIYEFPETDDEEDGDGDGAGV

SEQ ID NO: 835688 - protein, 284 aa, Homo sapiens
CEVLVEGVWLRVEVERIKLKPLDIEFMKRLHEKVNIIPLIAKADTLTPEECQQFKKQIMKEIQEHKIKIYEFPETDDEEENKLVKKIKDRLPLAVVGSNTIIEVNGKRVRGRQYPWGVAEVENGEHCDFTILRNMLIRTHMQDLKDVTNNVHYENYRSRKLAAVTYNGVDNNKNKGQLTKSPLAQMEEERREHVAKMKKMEMEMEQVFEMKVKEKVQKLKDSEAELQRRHEQMKKNLEAQHKELEEKRRQFEDEKANWEAQQRILEQQNSSRTLEKNKKKGKIF

SEQ ID NO: 835689 - protein, 437 aa, Homo sapiens; identical to SEQ ID NO: 835678

SEQ ID NO: 835690 - protein, 73 aa, Homo sapiens
AGVEREPVEESACCSVRKQGSYAGRLRCGIGVGAFGESAGCAPLGLVAEGGRGCRSVRDPLLLRRGASTAAPW

SEQ ID NO: 835691 - protein, 354 aa, Homo sapiens
MSVSARSAAAEERSVNSSTMVAQQKNLEGYVGFANLPNQVYRKSVKRGFEFTLMVVGESGLGKSTLINSLFLTDLYSPEYPGPSHRIKKTVQVEQSKVLIKEGGVQLLLTIVDTPGFGDAVDNSNCWQPVIDYIDSKFEDYLNAESRVNRRQMPDNRVQCCLYFIAPSGHGLKPLDIEFMKRLHEKVNIIPLIAKADTLTPEECQQFKKQIMKEIQEHKIKIYEFPETDDEEENKLVKKIKDRLPLAVVGSNTIIEVNGKRVRGRQYPWGVAEVENGEHCDFTILRNMLIRTHMQDLKDVTNNVHYENYRSRKLAQGGKCIYRSFLGKIVKLMTNLFLPICSLFILLEMGIMAS

SEQ ID NO: 835692 - protein, 225 aa, Homo sapiens
MSVSARSAAAEERSVNSSTMVAQQKNLEGYVGFANLPNQVYRKSVKRGFEFTLMVVGESGLGKSTLINSLFLTDLYSPEYPGPSHRIKKTVQVEQSKVLIKEGGVQLLLTIVDTPGFGDAVDNSNCWQPVIDYIDSKFEDYLNAESRVNRRQMPDNRVQCCLYFIAPSGHGLKPLDIEFMKRLHEKVNIIPLIAKADTLTPEECQQFKKQIMKEIQEQRSSGMKR

SEQ ID NO: 835693 - protein, 489 aa, Homo sapiens
MLFLSDPLRRCLRTERVKNGEGKRVAHGVEQRRKSERWLGESAGAGRGGGEGMSVSARSAAAEERSVNSSTMVAQQKNLEGYVGFANLPNQVYRKSVKRGFEFTLMVVGESGLGKSTLINSLFLTDLYSPEYPGPSHRIKKTVQVEQSKVLIKEGGVQLLLTIVDTPGFGDAVDNSNCWQPVIDYIDSKFEDYLNAESRVNRRQMPDNRVQCCLYFIAPSGHGLKPLDIEFMKRLHEKVNIIPLIAKADTLTPEECQQFKKQIMKEIQEHKIKIYEFPETDDEEENKLVKKIKDRLPLAVVGSNTIIEVNGKRVRGRQYPWGVAEVENGEHCDFTILRNMLIRTHMQDLKDVTNNVHYENYRSRKLAAVTYNGVDNNKNKGQLTKSPLAQMEEERREHVAKMKKMEMEMEQVFEMKVKEKVQKLKDSEAELQRRHEQMKKNLEAQHKELEEKRRQFEDEKANWEAQQRILEQQNSSRTLEKNKKKGKIF

SEQ ID NO: 835694 - protein, 437 aa, Homo sapiens; identical to SEQ ID NO: 835678

SEQ ID NO: 835695 - protein, 437 aa, Homo sapiens; identical to SEQ ID NO: 835678

SEQ ID NO: 835696 - protein, 437 aa, Homo sapiens; identical to SEQ ID NO: 835678

SEQ ID NO: 835697 - protein, 437 aa, Homo sapiens; identical to SEQ ID NO: 835678

SEQ ID NO: 835698 - protein, 384 aa, Homo sapiens; identical to SEQ ID NO: 835681

SEQ ID NO: 835699 - protein, 475 aa, Homo sapiens
MLFLSDPLRRCLRTERVKNGEGKRVAHGVEQRRKSERWLGESAGAGRGGGEGMSVSARSAAAEERSVNSSTMVAQQKNLEGYVGFANLPNQVYRKSVKRGFEFTLMVVGESGLGKSTLINSLFLTDLYSPEYPGPSHRIKKTVQLLLTIVDTPGFGDAVDNSNCWQPVIDYIDSKFEDYLNAESRVNRRQMPDNRVQCCLYFIAPSGHGLKPLDIEFMKRLHEKVNIIPLIAKADTLTPEECQQFKKQIMKEIQEHKIKIYEFPETDDEEENKLVKKIKDRLPLAVVGSNTIIEVNGKRVRGRQYPWGVAEVENGEHCDFTILRNMLIRTHMQDLKDVTNNVHYENYRSRKLAAVTYNGVDNNKNKGQLTKSPLAQMEEERREHVAKMKKMEMEMEQVFEMKVKEKVQKLKDSEAELQRRHEQMKKNLEAQHKELEEKRRQFEDEKANWEAQQRILEQQNSSRTLEKNKKKGKIF

SEQ ID NO: 835700 - protein, 289 aa, Homo sapiens
MKIFYTLIRLGLSFFVYPPSGHGLKPLDIEFMKRLHEKVNIIPLIAKADTLTPEECQQFKKQIMKEIQEHKIKIYEFPETDDEEENKLVKKIKDRLPLAVVGSNTIIEVNGKRVRGRQYPWGVAEVENGEHCDFTILRNMLIRTHMQDLKDVTNNVHYENYRSRKLAAVTYNGVDNNKNKGQLTKSPLAQMEEERREHVAKMKKMEMEMEQVFEMKVKEKVQKLKDSEAELQRRHEQMKKNLEAQHKELEEKRRQFEDEKANWEAQQRILEQQNSSRTLEKNKKKGKIF

SEQ ID NO: 835701 - protein, 437 aa, Homo sapiens; identical to SEQ ID NO: 835678

SEQ ID NO: 835702 - protein, 437 aa, Homo sapiens; identical to SEQ ID NO: 835678

SEQ ID NO: 835703 - protein, 241 aa, Homo sapiens; identical to SEQ ID NO: 835687

SEQ ID NO: 835704 - protein, 106 aa, Homo sapiens
MYYNNKFVRHSLFYHPNENFQKSFFIHGMPRVLPESDDRIYITLLGLLIVDSRLRYIRRFFLPFGLWMSEKIIHNTCKIQVGLRKGQPVESKMAVSVLHCWRHYVI

SEQ ID NO: 835705 - protein, 448 aa, Homo sapiens; identical to SEQ ID NO: 835679

SEQ ID NO: 835706 - protein, 236 aa, Homo sapiens
MSVSARSAAAEERSVNSSTMVAQQKNLEGYVGFANLPNQVYRKSVKRGFEFTLMVVGESGLGKSTLINSLFLTDLYSPEYPGPSHRIKKTVQVEQSKVLIKEGGVQLLLTIVDTPGFGDAVDNSNCWQPVIDYIDSKFEDYLNAESRVNRRQMPDNRVQCCLYFIAPSGHGLKPLDIEFMKRLHEKVNIIPLIAKADTLTPEECQQFKKQIMKEIQEHKIEYSIFHMVGTNKETFL

SEQ ID NO: 835707 - protein, 226 aa, Homo sapiens
MLFLSDPLRRCLRTERVKNGEGKRVAHGVEQRRKSERWLGESAGAGRGGGEGMSVSARSAAAEERSVNSSTMVAQQKNLEGYVGFANLPNQVYRKSVKRGFEFTLMVVGESGLGKSTLINSLFLTDLYSPEYPGPSHRIKKTVQVEQSKVLIKEGGVQLLLTIVDTPGFGDAVDNSNCWQPVIDYIDSKFEDYLNAESRVNRRQMPDNRVQCCLYFIAPSGHGSVP

SEQ ID NO: 835708 - protein, 941 aa, Homo sapiens
MGQACGHSILCRSQQYPAARPAEPRGQQVFLKPDEPPPPPQPCADSLQDALLSLGSVIDISGLQRAVKEALSAVLPRVETVYTYLLDGESQLVCEDPPHELPQEGKVREAIISQKRLGCNGLGFSDLPGKPLARLVAPLAPDTQVLVMPLADKEAGAVAAVILVHCGQLSDNEEWSLQAVEKHTLVALRRVQVLQQRGPREAPRAVQNPPEGTAEDQKGGAAYTDRDRKILQLCGELYDLDASSLQLKVLQYLQQETRASRCCLLLVSEDNLQLSCKVIGDKVLGEEVSFPLTGCLGQVVEDKKSIQLKDLTSEDVQQLQSMLGCELQAMLCVPVISRATDQVVALACAFNKLEGDLFTDEDEHVIQHCFHYTSTVLTSTLAFQKEQKLKCECQALLQVAKNLFTHLDDVSVLLQEIITEARNLSNAEICSVFLLDQNELVAKVFDGGVVDDESYEIRIPADQGIAGHVATTGQILNIPDAYAHPLFYRGVDDSTGFRTRNILCFPIKNENQEVIGVAELVNKINGPWFSKFDEDLATAFSIYCGISIAHSLLYKKVNEAQYRSHLANEMMMYHMKVSDDEYTKLLHDGIQPVAAIDSNFASFTYTPRSLPEDDTSMAILSMLQDMNFINNYKIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFDHFSRKDYQRMLDLMRDIILATDLAHHLRIFKDLQKMAEVGYDRNNKQHHRLLLCLLMTSCDLSDQTKGWKTTRKIAELIYKEFFSQGDLEKAMGNRPMEMMDREKAYIPELQISFMEHIAMPIYKLLQDLFPKAAELYERVASNREHWTKVSHKFTIRGLPSNNSLDFLDEEYEVPDLDGTRAPINGCCSLDAE

SEQ ID NO: 835709 - protein, 1021 aa, Homo sapiens
LPERGSHRGTADRVALGPAPSPAPGTATETCPPRPGGPSQWRPPCVRSVSAGPAGLPQAGRAAAAAAAMRRQPAAASLDPLAKEPGPPGSRDDRLEDALLSLGSVIDISGLQRAVKEALSAVLPRVETVYTYLLDGESQLVCEDPPHELPQEGKVRQFLQAQLSGGSMRDEEPRTINHQGVTFGAELREAIISQKRLGCNGLGFSDLPGKPLARLVAPLAPDTQVLVMPLADKEAGAVAAVILVHCGQLSDNEEWSLQAVEKHTLVALRRVQVLQQRGPREAPRAVQNPPEGTAEDQKGGAAYTDRDRKILQLCGELYDLDASSLQLKVLQYLQQETRASRCCLLLVSEDNLQLSCKVIGDKVLGEEVSFPLTGCLGQVVEDKKSIQLKDLTSEDVQQLQSMLGCELQAMLCVPVISRATDQVVALACAFNKLEGDLFTDEDEHVIQHCFHYTSTVLTSTLAFQKEQKLKCECQALLQVAKNLFTHLDDVSVLLQEIITEARNLSNAEICSVFLLDQNELVAKVFDGGVVDDESYEIRIPADQGIAGHVATTGQILNIPDAYAHPLFYRGVDDSTGFRTRNILCFPIKNENQEVIGVAELVNKINGPWFSKFDEDLATAFSIYCGISIAHSLLYKKVNEAQYRSHLANEMMMYHMKVSDDEYTKLLHDGIQPVAAIDSNFASFTYTPRSLPEDDTSMAILSMLQDMNFINNYKIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFDHFSRKDYQRMLDLMRDIILATDLAHHLRIFKDLQKMAEVGYDRNNKQHHRLLLCLLMTSCDLSDQTKGWKTTRKIAELIYKEFFSQGDLEKAMGNRPMEMMDREKAYIPELQISFMEHIAMPIYKLLQDLFPKAAELYERVASNREHWTKVSHKFTIRGLPSNNSLDFLDEEYEVPDLDGTRAPINGCCSLDAE

SEQ ID NO: 835710 - protein, 399 aa, Homo sapiens
LEDPLHCRSLLYKKVNEAQYRSHLANEMMMYHMKVSDDEYTKLLHDGIQPVAAIDSNFASFTYTPRSLPEDDTSMAILSMLQDMNFINNYKIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFDHFSRKDYQRMLDLMRDIILATDLAHHLRIFKDLQKMAEVGYDRNNKQHHRLLLCLLMTSCDLSDQTKGWKTTRKIAELIYKEFFSQGDLEKAMGNRPMEMMDREKAYIPELQISFMEHIAMPIYKLLQDLFPKAAELYERVASNREHWTKVSHKFTIRGLPSNNSLDFLDEEYEVPDLDGTRAPINGCCSLDAE

SEQ ID NO: 835711 - protein, 941 aa, Homo sapiens; identical to SEQ ID NO: 835708

SEQ ID NO: 835712 - protein, 941 aa, Homo sapiens; identical to SEQ ID NO: 835708

SEQ ID NO: 835713 - protein, 302 aa, Homo sapiens
LPERGSHRGTADRVALGPAPSPAPGTATETCPPRPGGPSQWRPPCVRSVSAGPAGLPQAGRAAAAAAAMRRQPAAASLDPLAKEPGPPGSRDDRLEDALLSLGSVIDISGLQRAVKEALSAVLPRVETVYTYLLDGESQLVCEDPPHELPQEGKVRQFLQAQLSGGSMRDEEPRTINHQGVTFGAELREAIISQKRLGCNGLGFSDLPGKPLARLVAPLAPDTQVLVMPLADKEAGAVAAVILVHCGQLSDNEEWSLQAVEKHVSGSGAMCNEAEDPYHSWWEDGLARELDRPGFQLRLCCF

SEQ ID NO: 835714 - protein, 107 aa, Homo sapiens
SRSAEKRAPGARVPPRNCGPCGPGACTLSGSGDGDRDLPTQAWGPQSVAAAVCALGVCAHVSPSQMGDCSRACPSHSDLQHSPDFPLPPRLRERSKPEAPAVSAAPA

SEQ ID NO: 835715 - protein, 938 aa, Homo sapiens
ELRTPPTSPTAPRLARQPRLARQPASLDPLAKEPGPPGSRDDRLEDALLSLGSVIDISGLQRAVKEALSAVLPRVETVYTYLLDGESQLVCEDPPHELPQEGKVREAIISQKRLGCNGLGFSDLPGKPLARLVAPLAPDTQVLVMPLADKEAGAVAAVILVHCGQLSDNEEWSLQAVEKHTLVALRRVQVLQQRGPREAPRAVQNPPEGTAEDQKGGAAYTDRDRKILQLCGELYDLDASSLQLKVLQYLQQETRASRCCLLLVSEDNLQLSCKVIGDKVLGEEVSFPLTGCLGQVVEDKKSIQLKDLTSEDVQQLQSMLGCELQAMLCVPVISRATDQVVALACAFNKLEGDLFTDEDEHVIQHCFHYTSTVLTSTLAFQKEQKLKCECQALLQVAKNLFTHLDDVSVLLQEIITEARNLSNAEICSVFLLDQNELVAKVFDGGVVDDESYEIRIPADQGIAGHVATTGQILNIPDAYAHPLFYRGVDDSTGFRTRNILCFPIKNENQEVIGVAELVNKINGPWFSKFDEDLATAFSIYCGISIAHSLLYKKVNEAQYRSHLANEMMMYHMKVSDDEYTKLLHDGIQPVAAIDSNFASFTYTPRSLPEDDTSMAILSMLQDMNFINNYKIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFDHFSRKDYQRMLDLMRDIILATDLAHHLRIFKDLQKMAEVGYDRNNKQHHRLLLCLLMTSCDLSDQTKGWKTTRKIAELIYKEFFSQGDLEKAMGNRPMEMMDREKAYIPELQISFMEHIAMPIYKLLQDLFPKAAELYERVASNREHWTKVSHKFTIRGLPSNNSLDFLDEEYEVPDLDGTRAPINGCCSLDAE

SEQ ID NO: 835716 - protein, 117 aa, Homo sapiens
MVPWADRFVHENKSISFYQKKQPYPHRHTKARHATQKRTTTRGAKVTAFPQACAQSGPLRRTRDTRRRDTGRGVSQTPERRDTGTPAHPGKKPSTRGRHHTGRHTHVNSHYNNPRHD

SEQ ID NO: 835717 - protein, 445 aa, Homo sapiens
MNRHLCVWLFRHPSLNGYLQCHIQLHSHQFRQIHLDTRLQVFRQNRNCILHLLSKNWSRRYCHQDTKMLWKHKALQKYMENLSKEYQTLEQCLQHIPVNEENRRSLNRRHAELAPLAAIYQEIQETEQAIEELESMCKSLNKQDEKQLQELALEERQTIDQKINMLYNELFQSLVPKEKYDKNDVILEVTAGRTTGGDICQQFTREIFDMYQNYSCYKHWQFELLNYTPADYGGLHHAAARISGDGVYKHLKYEGGIHRVQRIPEVGLSSRMQRIHTGTMSVIVLPQPDEVDVKLDPKDLRIDTFRAKGAGGQHVNKTDSAVRLVHIPTGLVVECQQERSQIKNKEIAFRVLRARLYQQIIEKDKRQQQSARKLQVGTRAQSERIRTYNFTQDRVSDHRIAYEVRDIKEFLCGGKGLDQLIQRLLQSADEEAIAELLDEHLKSAK

SEQ ID NO: 835718 - protein, 486 aa, Homo sapiens
MNRHLCVWLFRHPSLNGYLQCHIQLHSHQFRQIHLDTRLQVFRQNRNCILHLLSKNWSRRYCHQDTKMLWKHKALQKYMENLSKEYQTLEQCLQHIPVNEENRRSLNRRHAELAPLAAIYQEIQETEQAIEELESMCKNRVLLCGPGWNAVVYIIAHFNLELLDSSNPPTSASQVAGTTGLNKQDEKQLQELALEERQTIDQKINMLYNELFQSLVPKEKYDKNDVILEVTAGRTTGGDICQQFTREIFDMYQNYSCYKHWQFELLNYTPADYGGLHHAAARISGDGVYKHLKYEGGIHRVQRIPEVGLSSRMQRIHTGTMSVIVLPQPDEVDVKLDPKDLRIDTFRAKGAGGQHVNKTDSAVRLVHIPTGLVVECQQERSQIKNKEIAFRVLRARLYQQIIEKDKRQQQSARKLQVGTRAQSERIRTYNFTQDRVSDHRIAYEVRDIKEFLCGGKGLDQLIQRLLQSADEEAIAELLDEHLKSAK

SEQ ID NO: 835719 - protein, 445 aa, Homo sapiens; identical to SEQ ID NO: 835717

SEQ ID NO: 835720 - protein, 496 aa, Homo sapiens
MNRHLCVWLFRHPSLNGYLQCHIQLHSHQFRQIHLDTRLQVFRQNRNCILHLLSKNWSRRYCHQDTKMLWKHKALQKYMENLSKEYQTLEQCLQHIPVNEENRRSLNRRHAELAPLAAIYQEIQETEQAIEELESMCKNRVLLCGPGWNAVVYIIAHFNLELLDSSNPPTSASQVAGTTGLNKQDEKQLQELALEERQTIDQKINMLYNELFQSLVPKEKYDKNDVILEVTAGRTTGGDICQQFTREIFDMYQNYSCYKHWQFELLNYTPADYGGLHHAAARISGDGVYKHLKYEGGIHRVQRIPEVGLSSRMQRIHTGTMSVIVLPQPDEVDVKLDPKDLRIDTFRAKGAGGQHVNKTDSAVRLVHIPTGLVVECQQERSQIKNKEIAFRVLRARLYQQIIEKDKRQQQSARKLQVGTRAQSERIRTYNFTQDRVSDHRIAYEVRDIKAQSHSTGGSRDPAHSTFLSLDSVRSPGILIMTSSVRNFYVVGRAWIS

SEQ ID NO: 835721 - protein, 264 aa, Homo sapiens
MTLHAYLAPYPLRTTPTASPSTRFNTNSTNPHELPLHLLLSSPTTLYAQTAPSTRTPTYSALLTCTQLQLRYTPDWLALCAISLYRTLTLHPHNLRSTHIPRIATPLTTPHSPSTPHSLKHRRTTRLHYTGPRQRYPLPHPTQQAHISAHFPIHYLDFNSSHDISASTRTHHSRTPNATPRRLPPAHTRFTTHRPRNILIAHEPSHVNGATEHHLCSAIAPRQPYSPAAHRSNNPERFLETARPCLELGTLFASPYSEHTSSEN

SEQ ID NO: 835722 - protein, 445 aa, Homo sapiens; identical to SEQ ID NO: 835717

SEQ ID NO: 835723 - protein, 67 aa, Homo sapiens
VSMCVEYVLLWKVYQKTPALAVKAGLKEEETELKQLNLHQDTEPKEQEGSMLIKLIVPSDLSTSPQG

SEQ ID NO: 835724 - protein, 152 aa, Homo sapiens
MNRHLCVWLFRHPSLNGYLQCHIQLHSHQFRQIHLDTRLQVFRQNRNCILHLLSKNWSRRYCHQDTKMLWKHKALQKYMENLSKEYQTLEQCLQHIPVNEENRRSLNRRHAELAPLAAIYQEIQETEQAIEELESMCKNRVLLCGPGWNAVV

SEQ ID NO: 835725 - protein, 686 aa, Homo sapiens
MESQDIFTGTQTELIAGGQLLSCLSPQPAPGVDNVPEGSLPVHGEQALPKDQQITALGREEPVAIESPGQDLLGESRSEPVDVKPFASCEDSEAPVPAEDGGSDAGMCGLCQKAQLERMGVSGPSGSDLWAGAAVAKPQAKGQLAGGSLLMHCPCYGSEWGLWWRSQDLAPSPSGMAGLSFGTPTLDEPWLGVENDREELQTCLIKEQLSQLSLAGALDVPHAELVPTECQAVTAPVSSCDLGGRDLCGGCTGSSSACYALATDLPGGLEAVEAQEVDVNSFSWNLKELFFSDQTDQTSSNCSCATSELRETPSSLAVGSDPDVGSLQEQGSCVLDDRELLLLTGTCVDLGQGRRFRESCVGHDPTEPLEVCLVSSEHYAASDRESPGHVPSTLDAGPEDTCPSAEEPRLNVQVTSTPVIVMRGAAGLQREIQEGAYSGSCYHRDGLRLSIQFEVRRVELQGPTPLFCCWLVKDLLHSQRDSAARTRLFLASLPGSTHSTAAELTGPSLVEVLRARPWFEEPPKAVELEGLAACEGEYSQKYSTMSPLGSGAFGFVWTAVDKEKNKEVVVKFIKKEKVLEDCWIEDPKLGKVTLEIAILSRVEHANIIKVLDIFENQGFFQLVMEKHGSGLDLFAFIDRHPRLDEPLASYIFRQVRAGQSRVSVNAGLGAWVRWLQRSVIHTRFSL

SEQ ID NO: 835726 - protein, 1330 aa, Homo sapiens
MEDGGLTAFEEDQRCLSQSLPLPVSAEGPAAQTTAEPSRSFSSAHRHLSRRNGLSRLCQSRTALSEDRWSSYCLSSLAAQNICTSKLHCPAAPEHTDPSEPRGSVSCCSLLRGLSSGWSSPLLPAPVCNPNKAIFTVDAKTTEILVANDKACGLLGYSSQDLIGQKLTQFFLRSDSDVVEALSEEHMEADGHAAVVFGTVVDIISRSGEKIPVSVWMKRMRQERRLCCVVVLEPVERVSTWVAFQSDGTVTSCDSLFAHLHGYVSGEDVAGQHITDLIPSVQLPPSGQHIPKNLKIQRSVGRARDGTTFPLSLKLKSQPSSEEATTGEAAPVSGYRASVWVFCTISGLITLLPDGTIHGINHSFALTLFGYGKTELLGKNITFLIPGFYSYMDLAYNSSLQLPDLASCLDVGNESGCGERTLDPWQGQDPAEGGQDPRINVVLAGGHVVPRDEIRKLMESQDIFTGTQTELIAGGQLLSCLSPQPAPGVDNVPEGSLPVHGEQALPKDQQITALGREEPVAIESPGQDLLGESRSEPVDVKPFASCEDSEAPVPAEDGGSDAGMCGLCQKAQLERMGVSGPSGSDLWAGAAVAKPQAKGQLAGGSLLMHCPCYGSEWGLWWRSQDLAPSPSGMAGLSFGTPTLDEPWLGVENDREELQTCLIKEQLSQLSLAGALDVPHAELVPTECQAVTAPVSSCDLGGRDLCGGCTGSSSACYALATDLPGGLEAVEAQEVDVNSFSWNLKELFFSDQTDQTSSNCSCATSELRETPSSLAVGSDPDVGSLQEQGSCVLDDRELLLLTGTCVDLGQGRRFRESCVGHDPTEPLEVCLVSSEHYAASDRESPGHVPSTLDAGPEDTCPSAEEPRLNVQVTSTPVIVMRGAAGLQREIQEGAYSGSCYHRDGLRLSIQFEVRRVELQGPTPLFCCWLVKDLLHSQRDSAARTRLFLASLPGSTHSTAAELTGPSLVEVLRARPWFEEPPKAVELEGLAACEGEYSQKYSTMSPLGSGAFGFVWTAVDKEKNKEVVVKFIKKEKVLEDCWIEDPKLGKVTLEIAILSRVEHANIIKVLDIFENQGFFQLVMEKHGSGLDLFAFIDRHPRLDEPLASYIFRQVRAGQSRLVSAVGYLRLKDIIHRDIKDENIVIAEDFTIKLIDFGSAAYLERGKLFYTFCGTIEYCAPEVLMGNPYRGPELEMWSLGVTLYTLVFEENPFCELEETVEAAIHPPYLVSKELMSLVSGLLQPVPERRTTLEKLVTDPWVTQPVNLADYTWEEVFRVNKPESGVLSAASLEMGNRSLSDVAQAQELCGGPVPGEAPNGQGCLHPGDPRLLTS

SEQ ID NO: 835727 - protein, 162 aa, Homo sapiens [sequence omitted]

SEQ ID NO: 835728 - protein, 1323 aa, Homo sapiens
MEDGGLTAFEEDQRCLSQSLPLPVSAEGPAAQTTAEPSRSFSSAHRHLSRRNGLSRLCQSRTALSEDRWSSYCLSSLAAQNICTSKLHCPAAPEHTDPSEPRGSVSCCSLLRGLSSGWSSPLLPAPVCNPNKAIFTVDAKTTEILVANDKACGLLGYSSQDLIGQKLTQFFLRSDSDVVEALSEEHMEADGHAAVVFGTVVDIISRSGEKIPVSVWMKRMRQERRLCCVVVLEPVERVSTWVAFQSDGTVTSCDSLFAHLHGYVSGEDVAGQHITDLIPSVQLPPSGQHIPKNLKIQRSVGRARDGTTFPLSLKLKSQPSSEEATTGEAAPVSGYRASVWVFCTISGLITLLPDGTIHGINHSFALTLFGYGKTELLGKNITFLIPGFYSYMDLAYNSSLQLPDLASCLDVGNESGCGERTLDPWQGQDPAEGGQDPRINVVLAGGHVVPRDEIRKLMESQDIFTGTQTELIAGGQLLSCLSPQPAPGVDNVPEGSLPVHGEQALPKDQQITALGREEPVAIESPGQDLLGESRSEPVDVKPFASCEDSEAPVPAEDGGSDAGMCGLCQKAQLERMGVSGPSGSDLWAGAAVAKPQAKGQLAGGSLLMHCPCYGSEWGLWWRSQDLAPSPSGMAGLSFGTPTLDEPWLGVENDREELQTCLIKEQLSQLSLAGALDVPHAELVPTECQAVTAPVSSCDLGGRDLCGGCTGSSSACYALATDLPGGLEAVEAQEVDVNSFSWNLKELFFSDQTDQTSSNCSCATSELRETPSSLAVGSDPDVGSLQEQGSCVLDDRELLLLTGTCVDLGQGRRFRESCVGHDPTEPLEVCLVSSEHYAASDRESPGHVPSTLDAGPEDTCPSAEEPRLNVQVTSTPVIVMRGAAGLQREIQEGAYSGSCYHRDGLRLSIQFEVRRVELQGPTPLFCCWLVKDLLHSQRDSAARTRLFLASLPGSTHSTAAELTGPSLVEVLRARPWFEEPPKAVELEGLAACEGEYSQKYSTMSPLGSGAFGFVWTAVDKEKNKEVVVKFIKKEKVLEDCWIEDPKLGKVTLEIAILSRVEHANIIKVLDIFENQGFFQLVMEKHGSGLDLFAFIDRHPRLDEPLASYIFRQLVSAVGYLRLKDIIHRDIKDENIVIAEDFTIKLIDFGSAAYLERGKLFYTFCGTIEYCAPEVLMGNPYRGPELEMWSLGVTLYTLVFEENPFCELEETVEAAIHPPYLVSKELMSLVSGLLQPVPERRTTLEKLVTDPWVTQPVNLADYTWEEVFRVNKPESGVLSAASLEMGNRSLSDVAQAQELCGGPVPGEAPNGQGCLHPGDPRLLTS

SEQ ID NO: 835729 - protein, 1137 aa, Homo sapiens
MGFPDSARAGQRSLVDIISRSGEKIPVSVWMKRMRQERRLCCVVVLEPVERVSTWVAFQSDGTVTSCDSLFAHLHGYVSGEDVAGQHITDLIPSVQLPPSGQHIPKNLKIQRSVGRARDGTTFPLSLKLKSQPSSEEATTGEAAPVSGYRASVWVFCTISGLITLLPDGTIHGINHSFALTLFGYGKTELLGKNITFLIPGFYSYMDLAYNSSLQLPDLASCLDVGNESGCGERTLDPWQGQDPAEGGQDPRINVVLAGGHVVPRDEIRKLMESQDIFTGTQTELIAGGQLLSCLSPQPAPGVDNVPEGSLPVHGEQALPKDQQITALGREEPVAIESPGQDLLGESRSEPVDVKPFASCEDSEAPVPAEDGGSDAGMCGLCQKAQLERMGVSGPSGSDLWAGAAVAKPQAKGQLAGGSLLMHCPCYGSEWGLWWRSQDLAPSPSGMAGLSFGTPTLDEPWLGVENDREELQTCLIKEQLSQLSLAGALDVPHAELVPTECQAVTAPVSSCDLGGRDLCGGCTGSSSACYALATDLPGGLEAVEAQEVDVNSFSWNLKELFFSDQTDQTSSNCSCATSELRETPSSLAVGSDPDVGSLQEQGSCVLDDRELLLLTGTCVDLGQGRRFRESCVGHDPTEPLEVCLVSSEHYAASDRESPGHVPSTLDAGPEDTCPSAEEPRLNVQVTSTPVIVMRGAAGLQREIQEGAYSGSCYHRDGLRLSIQFEVRRVELQGPTPLFCCWLVKDLLHSQRDSAARTRLFLASLPGSTHSTAAELTGPSLVEVLRARPWFEEPPKAVELEGLAACEGEYSQKYSTMSPLGSGAFGFVWTAVDKEKNKEVVVKFIKKEKVLEDCWIEDPKLGKVTLEIAILSRVEHANIIKVLDIFENQGFFQLVMEKHGSGLDLFAFIDRHPRLDEPLASYIFRQLVSAVGYLRLKDIIHRDIKDENIVIAEDFTIKLIDFGSAAYLERGKLFYTFCGTIEYCAPEVLMGNPYRGPELEMWSLGVTLYTLVFEENPFCELEETVEAAIHPPYLVSKELMSLVSGLLQPVPERRTTLEKLVTDPWVTQPVNLADYTWEEVFRVNKPESGVLSAASLEMGNRSLSDVAQAQELCGGPVPGEAPNGQGCLHPGDPRLLTS

SEQ ID NO: 835730 - protein, 1220 aa, Homo sapiens
MEDGGLTAFEEDQRCLSQSLPLPVSAEGPAAQTTAEPSRSFSSAHRHLSRRNGLSRLCQSRTALSEDRWSSYCLSSLAAQNICTSKLHCPAAPEHTDPSEPRGSVSCCSLLRGLSSGWSSPLLPAPVCNPNKAIFTVDAKTTEILVANDKACGLLGYSSQDLIGQKLTQFFLRSDSDVVEALSEEHMEADGHAAVVFGTVVDIISRSGEKIPVSVWMKRMRQERRLCCVVVLEPVERVSTWVAFQSDGTVTSCDSLFAHLHGYVSGEDVAGQHITDLIPSVQLPPSGQHIPKNLKIQRSVGRARDGTTFPLSLKLKSQPSSEEATTGEAAPVSGYRASVWVFCTISGLITLLPDGTIHGINHSFALTLFGYGKTELLGKNITFLIPGFYSYMDLAYNSSLQLPDLASCLDVGNESGCGERTLDPWQGQDPAEGGQDPRINVVLAGGHVVPRDEIRKLMESQDIFTGTQTELIAGGQLLSCLSPQPAPGVDNVPEGSLPVHGEQALPKDQQITALGREEPVAIESPGQDLLGESRSEPVDVKPFASCEDSEAPVPAEDGGSDAGMCGLCQKAQLERMGVSGPSGSDLWAGAAVAKPQAKGQLAGGSLLMHCPCYGSEWGLWWRSQDLAPSPSGMAGLSFGTPTLDEPWLGVENDREELQTCLIKEQLSQLSLAGALDVPHAELVPTECQAVTAPVSSCDLGGRDLCGGCTGSSSACYALATDLPGGLEAVEAQEVDVNSFSWNLKELFFSDQTDQTSSNCSCATSELRETPSSLAVGSDPDVGSLQEQGSCVLDDRELLLLTGTCVDLGQGRRFRESCVGHDPTEPLEVCLVSSEHYAASDRESPGHVPSTLDAGPEDTCPSAEEPRLNVQVTSTPVIVMRGAAGLQREIQEGAYSGSCYHRDGLRLSIQFEVRRVELQGPTPLFCCWLVKDLLHSQRDSAARTRLFLASLPGSTHSTAAELTGPSLVEVLRARPWFEEPPKAVELEGLAACEGEYSQKYSTMSPLGSGAFGFVWTAVDKEKNKEVVVKFIKKEKVLEDCWIEDPKLGKVTLEIAILSRVEHANIIKVLDIFENQGFFQLVMEKHGSGLDLFAFIDRHPRLDEPLASYIFRQVRAGQSRLVSAVGYLRLKDIIHRDIKDENIVIAEDFTIKLIDFGSAAYLERGKLFYTFCGTIEYCAPEVLMGNPLVLQHPSHRRHSHLPKGHVCPWSHQARSHQDREHA

SEQ ID NO: 835731 - protein, 351 aa, Homo sapiens
TRKLTESAVLCWRLAGRGAESGLPRRGFFFLLECKYQSRYIEIRRSYSVGEAMEELLPDGQIWANMDPEERMLAAATAFTHICAGQGEGDVRREAQSIQYDPYSKASVAPGKRPALPVQLQYPHVESNVPSETVSEASQRLRKPVMKRKVLRRKPDGEVLVTDESIISESESGTENDQDLWDLRQRLMNVQFQEDKESSFDVSQKFNLPHEYQGISQDQLICSLQREGMGSPAYEQDLIVASRPKSFILPKLDQLSRNRGKTDRVARYFEYKRDWDSIRLPGEDHRKELRWGVREQMLCRAEPQSKPQHIYVPNNYLVPTEKKRSALRWGVRCDLANGVIPRKLPFPLSPS

SEQ ID NO: 835732 - protein, 351 aa, Homo sapiens; identical to SEQ ID NO: 835731

SEQ ID NO: 835733 - protein, 299 aa, Homo sapiens
MEELLPDGQIWANMDPEERMLAAATAFTHICAGQGEGDVRREAQSIQYDPYSKASVAPGKRPALPVQLQYPHVESNVPSETVSEASQRLRKPVMKRKVLRRKPDGEVLVTDESIISESESGTENDQDLWDLRQRLMNVQFQEDKESSFDVSQKFNLPHEYQGISQDQLICSLQREGMGSPAYEQDLIVASRPKSFILPKLDQLSRNRGKTDRVARYFEYKRDWDSIRLPGEDHRKELRWGVREQMLCRAEPQSKPQHIYVPNNYLVPTEKKRSALRWGVRCDLANGVIPRKLPFPLSPS

SEQ ID NO: 835734 - protein, 330 aa, Homo sapiens
MEPSKVFFFLLECKYQSRYIEIRRSYSVGEAMEELLPDGQIWANMDPEERMLAAATAFTHICAGQGEGDVRREAQSIQYDPYSKASVAPGKRPALPVQLQYPHVESNVPSETVSEASQRLRKPVMKRKVLRRKPDGEVLVTDESIISESESGTENDQDLWDLRQRLMNVQFQEDKESSFDVSQKFNLPHEYQGISQDQLICSLQREGMGSPAYEQDLIVASRPKSFILPKLDQLSRNRGKTDRVARYFEYKRDWDSIRLPGEDHRKELRWGVREQMLCRAEPQSKPQHIYVPNNYLVPTEKKRSALRWGVRCDLANGVIPRKLPFPLSPS

SEQ ID NO: 835735 - protein, 334 aa, Homo sapiens
TRKLTESAVLCWRLAGRGAESGLPRRGRSYSVGEAMEELLPDGQIWANMDPEERMLAAATAFTHICAGQGEGDVRREAQSIQYDPYSKASVAPGKRPALPVQLQYPHVESNVPSETVSEASQRLRKPVMKRKVLRRKPDGEVLVTDESIISESESGTENDQDLWDLRQRLMNVQFQEDKESSFDVSQKFNLPHEYQGISQDQLICSLQREGMGSPAYEQDLIVASRPKSFILPKLDQLSRNRGKTDRVARYFEYKRDWDSIRLPGEDHRKELRWGVREQMLCRAEPQSKPQHIYVPNNYLVPTEKKRSALRWGVRCDLANGVIPRKLPFPLSPS

SEQ ID NO: 835736 - protein, 2622 aa, Homo sapiens
QLEEEYENLLKASFERMDHLRQLQNIIQATSREIMWINDCEEEELLYDWSDKNTNIAQKQEAFSIRMSQLEVKEKELNKLKQESDQLVLNQHPASDKIEAYMDTLQTQWSWILQITKCIDVHLKENAAYFQFFEEAQSTEAYLKGLQDSIRKKYPCDKNMPLQHLLEQIKELEKEREKILEYKRQVQNLVNKSKKIVQLKPRNPDYRSNKPIILRALCDYKQDQKIVHKGDECILKDNNERSKWYVTGPGGVDMLVPSVGLIIPPPNPLAVDLSCKIEQYYEAILALWNQLYINMKSLVSWHYCMIDIEKIRAMTIAKLKTMRQEDYMKTIADLELHYQEFIRNSQGSEMFGDDDKRKIQSQFTDAQKHYQTLVIQLPGYPQHQTVTTTEITHHGTCQDVNHNKVIETNRENDKQETWMLMELQKIRRQIEHCEGRMTLKNLPLADQGSSHHITVKINELKSVQNDSQAIAEVLNQLKDMLANFRGSEKYCYLQNEVFGLFQKLENINGVTDGYLNSLCTVRALLQAILQTEDMLKVYEARLTEEETVCLDLDKVEAYRCGLKKIKNDLNLKKSLLATMKTELQKAQQIHSQTSQQYPLYDLDLGKFGEKVTQLTDRWQRIDKQIDFRLWDLEKQIKQLRNYRDNYQAFCKWLYDAKRRQDSLESMKFGDSNTVMRFLNEQKNLHSEISGKRDKSEEVQKIAELCANSIKDYELQLASYTSGLETLLNIPIKRTMIQSPSGVILQEAADVHARYIELLTRSGDYYRFLSEMLKSLEDLKLKNTKIEVLEEELRLARDANSENCNKNKFLDQNLQKYQAECSQFKAKLASLEELKRQAELDGKSAKQNLDKCYGQIKELNEKITRLTYEIEDEKRRRKSVEDRFDQQKNDYDQLQKARQCEKENLGWQKLESEKAIKEKEYEIERLRVLLQEEGTRKREYENELAKVRNHYNEEMSNLRNKYETEINITKTTIKEISMQKEDDSKNLRNQLDRLSRENRDLKDEIVRLNDSILQATEQRRRAEENALQQKACGSEIMQKKQHLEIELKQVMQQRSEDNARHKQSLEEAAKTIQDKNKEIERLKAEFQEEAKRRWEYENELSKVRNNYDEEIISLKNQFETEINITKTTIHQLTMQKEEDTSGYRAQIDNLTRENRSLSEEIKRLKNTLTQTTENLRRVEEDIQQQKATGSEVSQRKQQLEVELRQVTQMRTEESVRYKQSLDDAAKTIQDKNKEIERLKQLIDKETNDRKCLEDENARLQRVQYDLQKANSSATETINKLKVQEQELTRLRIDYERVSQERTVKDQDITRFQNSLKELQLQKQKVEEELNRLKRTASEDSCKRKKLEEELEGMRRSLKEQAIKITNLTQQLEQASIVKKRSEDDLRQQRDVLDGHLREKQRTQEELRRLSSEVEALRRQLLQEQESVKQAHLRNEHFQKAIEDKSRSLNESKIEIERLQSLTENLTKEHLMLEEELRNLRLEYDDLRRGRSEADSDKNATILELRSQLQISNNRTLELQGLINDLQRERENLRQEIEKFQKQALEASNRIQESKNQCTQVVQERESLLVKIKVLEQDKARLQRLEDELNRAKSTLEAETRVKQRLECEKQQIQNDLNQWKTQYSRKEEAIRKIESEREKSEREKNSLRSEIERLQAEIKRIEERCRRKLEDSTRETQSQLETERSRYQREIDKLRQRPYGSHRETQTECEWTVDTSKLVFDGLRKKVTAMQLYECQLIDKTTLDKLLKGKKSVEEVASEIQPFLRGAGSIAGASASPKEKYSLVEAKRKKLISPESTVMLLEAQAATGGIIDPHRNEKLTVDSAIARDLIDFDDRQQIYAAEKAITGFDDPFSGKTVSVSEAIKKNLIDRETGMRLLEAQIASGGVVDPVNSVFLPKDVALARGLIDRDLYRSLNDPRDSQKNFVDPVTKKKVSYVQLKERCRIEPHTGLLLLSVQKRSMSFQGIRQPVTVTELVDSGILRPSTVNELESGQISYDEVGERIKDFLQGSSCIAGIYNETTKQKLGIYEAMKIGLVRPGTALELLEAQAATGFIVDPVSNLRLPVEEAYKRGLVGIEFKEKLLSAERAVTGYNDPETGNIISLFQAMNKELIEKGHGIRLLEAQIATGGIIDPKESHRLPVDIAYKRGYFNEELSEILSDPSDDTKGFFDPNTEENLTYLQLKERCIKDEETGLCLLPLKEKKKQVQTSQKNTLRKRRVVIVDPETNKEMSVQEAYKKGLIDYETFKELCEQECEWEEITITGSDGSTRVVLVDRKTGSQYDIQDAIDKGLVDRKFFDQYRSGSLSLTQFADMISLKNGVGTSSSMGSGVSDDVFSSSRHESVSKISTISSVRNLTIRSSSFSDTLEESSPIAAIFDTENLEKISITEGIERGIVDSITGQRLLEAQACTGGIIHPTTGQKLSLQDAVSQGVIDQDMATRLKPAQKAFIGFEGVKGKKKMSAAEAVKEKWLPYEAGQRFLEFQYLTGGLVDPEVHGRISTEEAIRKGFIDGRAAQRLQDTSSYAKILTCPKTKLKISYKDAINRSMVEDITGLRLLEAASVSSKGLPSPYNMSSAPGSRSGSRSGSRSGSRSGSRSGSRRGSFDATGNSSYSYSYSFSSSSIGH

SEQ ID NO: 835737 - protein, 2622 aa, Homo sapiens; identical to SEQ ID NO: 835736

SEQ ID NO: 835738 - protein, 1809 aa, Homo sapiens
MVLIGMFSRVSSPEVYDGQLKRQAELDGKSAKQNLDKCYGQIKELNEKITRLTYEIEDEKRRRKSVEDRFDQQKNDYDQLQKARQCEKENLGWQKLESEKAIKEKEYEIERLRVLLQEEGTRKREYENELAKVRNHYNEEMSNLRNKYETEINITKTTIKEISMQKEDDSKNLRNQLDRLSRENRDLKDEIVRLNDSILQATEQRRRAEENALQQKACGSEIMQKKQHLEIELKQVMQQRSEDNARHKQSLEEAAKTIQDKNKEIERLKAEFQEEAKRRWEYENELSKVRNNYDEEIISLKNQFETEINITKTTIHQLTMQKEEDTSGYRAQIDNLTRENRSLSEEIKRLKNTLTQTTENLRRVEEDIQQQKATGSEVSQRKQQLEVELRQVTQMRTEESVRYKQSLDDAAKTIQDKNKEIERLKQLIDKETNDRKCLEDENARLQRVQYDLQKANSSATETINKLKVQEQELTRLRIDYERVSQERTVKDQDITRFQNSLKELQLQKQKVEEELNRLKRTASEDSCKRKKLEEELEGMRRSLKEQAIKITNLTQQLEQASIVKKRSEDDLRQQRDVLDGHLREKQRTQEELRRLSSEVEALRRQLLQEQESVKQAHLRNEHFQKAIEDKSRSLNESKIEIERLQSLTENLTKEHLMLEEELRNLRLEYDDLRRGRSEADSDKNATILELRSQLQISNNRTLELQGLINDLQRERENLRQEIEKFQKQALEASNRIQESKNQCTQVVQERESLLVKIKVLEQDKARLQRLEDELNRAKSTLEAETRVKQRLECEKQQIQNDLNQWKTQYSRKEEAIRKIESEREKSEREKNSLRSEIERLQAEIKRIEERCRRKLEDSTRETQSQLETERSRYQREIDKLRQRPYGSHRETQTECEWTVDTSKLVFDGLRKKVTAMQLYECQLIDKTTLDKLLKGKKSVEEVASEIQPFLRGAGSIAGASASPKEKYSLVEAKRKKLISPESTVMLLEAQAATGGIIDPHRNEKLTVDSAIARDLIDFDDRQQIYAAEKAITGFDDPFSGKTVSVSEAIKKNLIDRETGMRLLEAQIASGGVVDPVNSVFLPKDVALARGLIDRDLYRSLNDPRDSQKNFVDPVTKKKVSYVQLKERCRIEPHTGLLLLSVQKRSMSFQGIRQPVTVTELVDSGILRPSTVNELESGQISYDEVGERIKDFLQGSSCIAGIYNETTKQKLGIYEAMKIGLVRPGTALELLEAQAATGFIVDPVSNLRLPVEEAYKRGLVGIEFKEKLLSAERAVTGYNDPETGNIISLFQAMNKELIEKGHGIRLLEAQIATGGIIDPKESHRLPVDIAYKRGYFNEELSEILSDPSDDTKGFFDPNTEENLTYLQLKERCIKDEETGLCLLPLKEKKKQVQTSQKNTLRKRRVVIVDPETNKEMSVQEAYKKGLIDYETFKELCEQECEWEEITITGSDGSTRVVLVDRKTGSQYDIQDAIDKGLVDRKFFDQYRSGSLSLTQFADMISLKNGVGTSSSMGSGVSDDVFSSSRHESVSKISTISSVRNLTIRSSSFSDTLEESSPIAAIFDTENLEKISITEGIERGIVDSITGQRLLEAQACTGGIIHPTTGQKLSLQDAVSQGVIDQDMATRLKPAQKAFIGFEGVKGKKKMSAAEAVKEKWLPYEAGQRFLEFQYLTGGLVDPEVHGRISTEEAIRKGFIDGRAAQRLQDTSSYAKILTCPKTKLKISYKDAINRSMVEDITGLRLLEAASVSSKGLPSPYNMSSAPGSRSGSRSGSRSGSRSGSRSGSRRGSFDATGNSSYSYSYSFSSSSIGH

SEQ ID NO: 835739 - protein, 2021 aa, Homo sapiens
QLEEEYENLLKASFERMDHLRQLQNIIQATSREIMWINDCEEEELLYDWSDKNTNIAQKQEAFSIRMSQLEVKEKELNKLKQESDQLVLNQHPASDKIEAYMDTLQTQWSWILQITKCIDVHLKENAAYFQFFEEAQSTEAYLKGLQDSIRKKYPCDKNMPLQHLLEQIKELEKEREKILEYKRQVQNLVNKSKKIVQLKPRNPDYRSNKPIILRALCDYKQDQKIVHKGDECILKDNNERSKWYVTGPGGVDMLVPSVGLIIPPPNPLAVDLSCKIEQYYEAILALWNQLYINMKSLVSWHYCMIDIEKIRAMTIAKLKTMRQEDYMKTIADLELHYQEFIRNSQGSEMFGDDDKRKIQSQFTDAQKHYQTLVIQLPGYPQHQTVTTTEITHHGTCQDVNHNKVIETNRENDKQETWMLMELQKIRRQIEHCEGRMTLKNLPLADQGSSHHITVKINELKSVQNDSQAIAEVLNQLKDMLANFRGSEKYCYLQNEVFGLFQKLENINGVTDGYLNSLCTVRALLQAILQTEDMLKVYEARLTEEETVCLDLDKVEAYRCGLKKIKNDLNLKKSLLATMKTELQKAQQIHSQTSQQYPLYDLDLGKFGEKVTQLTDRWQRIDKQIDFRLWDLEKQIKQLRNYRDNYQAFCKWLYDAKRRQDSLESMKFGDSNTVMRFLNEQKNLHSEISGKRDKSEEVQKIAELCANSIKDYELQLASYTSGLETLLNIPIKRTMIQSPSGVILQEAADVHARYIELLTRSGDYYRFLSEMLKSLEDLKLKNTKIEVLEEELRLARDANSENCNKNKFLDQNLQKYQAECSQFKAKLASLEELKRQAELDGKSAKQNLDKCYGQIKELNEKITRLTYEIEDEKRRRKSVEDRFDQQKNDYDQLQKARQCEKENLGWQKLESEKAIKEKEYEIERLRVLLQEEGTRKREYENELASNRIQESKNQCTQVVQERESLLVKIKVLEQDKARLQRLEDELNRAKSTLEAETRVKQRLECEKQQIQNDLNQWKTQYSRKEEAIRKIESEREKSEREKNSLRSEIERLQAEIKRIEERCRRKLEDSTRETQSQLETERSRYQREIDKLRQRPYGSHRETQTECEWTVDTSKLVFDGLRKKVTAMQLYECQLIDKTTLDKLLKGKKSVEEVASEIQPFLRGAGSIAGASASPKEKYSLVEAKRKKLISPESTVMLLEAQAATGGIIDPHRNEKLTVDSAIARDLIDFDDRQQIYAAEKAITGFDDPFSGKTVSVSEAIKKNLIDRETGMRLLEAQIASGGVVDPVNSVFLPKDVALARGLIDRDLYRSLNDPRDSQKNFVDPVTKKKVSYVQLKERCRIEPHTGLLLLSVQKRSMSFQGIRQPVTVTELVDSGILRPSTVNELESGQISYDEVGERIKDFLQGSSCIAGIYNETTKQKLGIYEAMKIGLVRPGTALELLEAQAATGFIVDPVSNLRLPVEEAYKRGLVGIEFKEKLLSAERAVTGYNDPETGNIISLFQAMNKELIEKGHGIRLLEAQIATGGIIDPKESHRLPVDIAYKRGYFNEELSEILSDPSDDTKGFFDPNTEENLTYLQLKERCIKDEETGLCLLPLKEKKKQVQTSQKNTLRKRRVVIVDPETNKEMSVQEAYKKGLIDYETFKELCEQECEWEEITITGSDGSTRVVLVDRKTGSQYDIQDAIDKGLVDRKFFDQYRSGSLSLTQFADMISLKNGVGTSSSMGSGVSDDVFSSSRHESVSKISTISSVRNLTIRSSSFSDTLEESSPIAAIFDTENLEKISITEGIERGIVDSITGQRLLEAQACTGGIIHPTTGQKLSLQDAVSQGVIDQDMATRLKPAQKAFIGFEGVKGKKKMSAAEAVKEKWLPYEAGQRFLEFQYLTGGLVDPEVHGRISTEEAIRKGFIDGRAAQRLQDTSSYAKILTCPKTKLKISYKDAINRSMVEDITGLRLLEAASVSSKGLPSPYNMSSAPGSRSGSRSGSRSGSRSGSRSGSRRGSFDATGNSSYSYSYSFSSSSIGH

SEQ ID NO: 835740 - protein, 1567 aa, Homo sapiens
MTIGGNLKRGNLDTPPQAQDQVQSGLFLDVVSDRVRRWEYENELSKVRNNYDEEIISLKNQFETEINITKTTIHQLTMQKEEDTSGYRAQIDNLTRENRSLSEEIKRLKNTLTQTTENLRRVEEDIQQQKATGSEVSQRKQQLEVELRQVTQMRTEESVRYKQSLDDAAKTIQDKNKEIERLKQLIDKETNDRKCLEDENARLQRVQYDLQKANSSATETINKLKVQEQELTRLRIDYERVSQERTVKDQDITRFQNSLKELQLQKQKVEEELNRLKRTASEDSCKRKKLEEELEGMRRSLKEQAIKITNLTQQLEQASIVKKRSEDDLRQQRDVLDGHLREKQRTQEELRRLSSEVEALRRQLLQEQESVKQAHLRNEHFQKAIEDKSRSLNESKIEIERLQSLTENLTKEHLMLEEELRNLRLEYDDLRRGRSEADSDKNATILELRSQLQISNNRTLELQGLINDLQRERENLRQEIEKFQKQALEASNRIQESKNQCTQVVQERESLLVKIKVLEQDKARLQRLEDELNRAKSTLEAETRVKQRLECEKQQIQNDLNQWKTQYSRKEEAIRKIESEREKSEREKNSLRSEIERLQAEIKRIEERCRRKLEDSTRETQSQLETERSRYQREIDKLRQRPYGSHRETQTECEWTVDTSKLVFDGLRKKVTAMQLYECQLIDKTTLDKLLKGKKSVEEVASEIQPFLRGAGSIAGASASPKEKYSLVEAKRKKLISPESTVMLLEAQAATGGIIDPHRNEKLTVDSAIARDLIDFDDRQQIYAAEKAITGFDDPFSGKTVSVSEAIKKNLIDRETGMRLLEAQIASGGVVDPVNSVFLPKDVALARGLIDRDLYRSLNDPRDSQKNFVDPVTKKKVSYVQLKERCRIEPHTGLLLLSVQKRSMSFQGIRQPVTVTELVDSGILRPSTVNELESGQISYDEVGERIKDFLQGSSCIAGIYNETTKQKLGIYEAMKIGLVRPGTALELLEAQAATGFIVDPVSNLRLPVEEAYKRGLVGIEFKEKLLSAERAVTGYNDPETGNIISLFQAMNKELIEKGHGIRLLEAQIATGGIIDPKESHRLPVDIAYKRGYFNEELSEILSDPSDDTKGFFDPNTEENLTYLQLKERCIKDEETGLCLLPLKEKKKQVQTSQKNTLRKRRVVIVDPETNKEMSVQEAYKKGLIDYETFKELCEQECEWEEITITGSDGSTRVVLVDRKTGSQYDIQDAIDKGLVDRKFFDQYRSGSLSLTQFADMISLKNGVGTSSSMGSGVSDDVFSSSRHESVSKISTISSVRNLTIRSSSFSDTLEESSPIAAIFDTENLEKISITEGIERGIVDSITGQRLLEAQACTGGIIHPTTGQKLSLQDAVSQGVIDQDMATRLKPAQKAFIGFEGVKGKKKMSAAEAVKEKWLPYEAGQRFLEFQYLTGGLVDPEVHGRISTEEAIRKGFIDGRAAQRLQDTSSYAKILTCPKTKLKISYKDAINRSMVEDITGLRLLEAASVSSKGLPSPYNMSSAPGSRSGSRSGSRSGSRSGSRSGSRRGSFDATGNSSYSYSYSFSSSSIGH

SEQ ID NO: 835741 - protein, 457 aa, Homo sapiens
MNIPNTEENLTYLQLKERCIKDEETGLCLLPLKEKKKQVQTSQKNTLRKRRVVIVDPETNKEMSVQEAYKKGLIDYETFKELCEQECEWEEITITGSDGSTRVVLVDRKTGSQYDIQDAIDKGLVDRKFFDQYRSGSLSLTQFADMISLKNGVGTSSSMGSGVSDDVFSSSRHESVSKISTISSVRNLTIRSSSFSDTLEESSPIAAIFDTENLEKISITEGIERGIVDSITGQRLLEAQACTGGIIHPTTGQKLSLQDAVSQGVIDQDMATRLKPAQKAFIGFEGVKGKKKMSAAEAVKEKWLPYEAGQRFLEFQYLTGGLVDPEVHGRISTEEAIRKGFIDGRAAQRLQDTSSYAKILTCPKTKLKISYKDAINRSMVEDITGLRLLEAASVSSKGLPSPYNMSSAPGSRSGSRSGSRSGSRSGSRSGSRRGSFDATGNSSYSYSYSFSSSSIGH

SEQ ID NO: 835742 - protein, 2524 aa, Homo sapiens
QLEEEYENLLKASFERMDHLRQLQNIIQATSREIMWINDCEEEELLYDWSDKNTNIAQKQEAFSIRMSQLEVKEKELNKLKQESDQLVLNQHPASDKIEAYMDTLQTQWSWILQITKCIDVHLKENAAYFQFFEEAQSTEAYLKGLQDSIRKKYPCDKNMPLQHLLEQIKELEKEREKILEYKRQVQNLVNKSKKIVQLKPRNPDYRSNKPIILRALCDYKQDQKIVHKGDECILKDNNERSKWYVTGPGGVDMLVPSVGLIIPPPNPLAVDLSCKIEQYYEAILALWNQLYINMKSLVSWHYCMIDIEKIRAMTIAKLKTMRQEDYMKTIADLELHYQEFIRNSQGSEMFGDDDKRKIQSQFTDAQKHYQTLVIQLPGYPQHQTVTTTEITHHGTCQDVNHNKVIETNRENDKQETWMLMELQKIRRQIEHCEGRMTLKNLPLADQGSSHHITVKINELKSVQNDSQAIAEVLNQLKDMLANFRGSEKYCYLQNEVFGLFQKLENINGVTDGYLNSLCTVRALLQAILQTEDMLKVYEARLTEEETVCLDLDKVEAYRCGLKKIKNDLNLKKSLLATMKTELQKAQQIHSQTSQQYPLYDLDLGKFGEKVTQLTDRWQRIDKQIDFRLWDLEKQIKQLRNYRDNYQAFCKWLYDAKRRQDSLESMKFGDSNTVMRFLNEQKNLHSEISGKRDKSEEVQKIAELCANSIKDYELQLASYTSGLETLLNIPIKRTMIQSPSGVILQEAADVHARYIELLTRSGDYYRFLSEMLKSLEDLKLKNTKIEVLEEELRLARDANSENCNKNKFLDQNLQKYQAECSQFKAKLASLEELKRQAELDGKSAKQNLDKCYGQIKELNEKITRLTYEIEDEKRRRKSVEDRFDQQKNDYDQLQKARQCEKENLGWQKLESEKAIKEKEYEIERLRVLLQEEGTRKREYENELAKVRNHYNEEMSNLRNKYETEINITKTTIKEISMQKEDDSKNLRNQLDRLSRENRDLKDEIVRLNDSILQATEQRRRAEENALQQKACGSEIMQKKQHLEIELKQVMQQRSEDNARHKQSLEEAAKTIQDKNKEIERLKAEFQEEAKRRWEYENELSKVRNNYDEEIISLKNQFETEINITKTTIHQLTMQKEEDTSGYRAQIDNLTRENRSLSEEIKRLKNTLTQTTENLRRVEEDIQQQKATGSEVSQRKQQLEVELRQVTQMRTEESVRYKQSLDDAAKTIQDKNKEIERLKQLIDKETNDRKCLEDENARLQRVQYDLQKANSSATETINKLKVQEQELTRLRIDYERVSQERTVKDQDITRFQNSLKELQLQKQKVEEELNRLKRTASEDSCKRKKLEEELEGMRRSLKEQAIKITNLTQQLEQASIVKKRSEDDLRQQRDVLDGHLREKQRTQEELRRLSSEVEALRRQLLQEQESVKQAHLRNEHFQKAIEDKSRSLNESKIEIERLQSLTENLTKEHLMLEEELRNLRLEYDDLRRGRSEADSDKNATILELRSQLQISNNRTLELQGLINDLQRERENLRQEIEKFQKQALEASNRIQESKNQCTQVVQERESLLVKIKVLEQDKARLQRLEDELNRAKSTLEAETRVKQRLECEKQQIQNDLNQWKTQYSRKEEAIRKIESEREKSEREKNSLRSEIERLQAEIKRIEERCRRKLEDSTRETQSQLETERSRYQREIDKLRQRPYGSHRETQTECEWTVDTSKLVFDGLRKKVTAMQLYECQLIDKTTLDKLLKGKKSVEEVASEIQPFLRGAGSIAGASASPKEKYSLVEAKRKKLISPESTVMLLEAQAATGGIIDPHRNEKLTVDSAIARDLIDFDDRQQIYAAEKAITGFDDPFSGKTVSVSEAIKKNLIDRETGMRLLEAQIASGGVVDPVNSVFLPKDVALARGLIDRDLYRSLNDPRDSQKNFVDPVTKKKVSYVQLKERCRIEPHTGLLLLSVQKRSMSFQGIRQPVTVTELVDSGILRPSTVNELESGQISYDEVGERIKDFLQGSSCIAGIYNETTKQKLGIYEAMKIGLVRPGTALELLEAQAATGFIVDPVSNLRLPVEEAYKRGLVGIEFKEKLLSAERAVTGYNDPETGNIISLFQAMNKELIEKGHGIRLLEAQIATGGIIDPKESHRLPVDIAYKRGYFNEELSEILSDPSDDTKGFFDPNTEENLTYLQLKERCIKDEETGLCLLPLKEKKKQVQTSQKNTLRKRRVVIVDPETNKEMSVQEAYKKGLIDYETFKELCEQECEWEEITITGSDGSTRVVLVDRKTGSQYDIQDAIDKGLVDRKFFDQYRSGSLSLTQFADMISLKNGVGTSSSMGSGVSDDVFSSSRHESVSKISTISSVRNLTIRSSSFSDTLEESSPIAAIFDTENLEKISITEGIERGIVDSITGQRLLEAQACTGGIIHPTTGQKLSLQDAVSQGVIDQDMATRLKPAQKAFIGFEGVKGKKKMSAAEAVKEKWLPYEAGQRFLEFQYLTGGLAASVGAAIYEPLPDGFFGAYPPMHFRVNKTSREVLVD

SEQ ID NO: 835743 - protein, 2129 aa, Homo sapiens
QLEEEYENLLKASFERMDHLRQLQNIIQATSREIMWINDCEEEELLYDWSDKNTNIAQKQEAFSIRMSQLEVKEKELNKLKQESDQLVLNQHPASDKIEAYMDTLQTQWSWILQITKCIDVHLKENAAYFQFFEEAQSTEAYLKGLQDSIRKKYPCDKNMPLQHLLEQIKELEKEREKILEYKRQVQNLVNKSKKIVQLKPRNPDYRSNKPIILRALCDYKQDQKIVHKGDECILKDNNERSKWYVTGPGGVDMLVPSVGLIIPPPNPLAVDLSCKIEQYYEAILALWNQLYINMKSLVSWHYCMIDIEKIRAMTIAKLKTMRQEDYMKTIADLELHYQEFIRNSQGSEMFGDDDKRKIQSQFTDAQKHYQTLVIQLPGYPQHQTVTTTEITHHGTCQDVNHNKVIETNRENDKQETWMLMELQKIRRQIEHCEGRMTLKNLPLADQGSSHHITVKINELKSVQNDSQAIAEVLNQLKDMLANFRGSEKYCYLQNEVFGLFQKLENINGVTDGYLNSLCTVRALLQAILQTEDMLKVYEARLTEEETVCLDLDKVEAYRCGLKKIKNDLNLKKSLLATMKTELQKAQQIHSQTSQQYPLYDLDLGKFGEKVTQLTDRWQRIDKQIDFRLWDLEKQIKQLRNYRDNYQAFCKWLYDAKRRQDSLESMKFGDSNTVMRFLNEQKNLHSEISGKRDKSEEVQKIAELCANSIKDYELQLASYTSGLETLLNIPIKRTMIQSPSGVILQEAADVHARYIELLTRSGDYYRFLSEMLKSLEDLKLKNTKIEVLEEELRLARDANSENCNKNKFLDQNLQKYQAECSQFKAKLASLEELKRQAELDGKSAKQNLDKCYGQIKELNEKITRLTYEIEDEKRRRKSVEDRFDQQKNDYDQLQKARQCEKENLGWQKLESEKAIKEKEYEIERLRVLLQEEGTRKREYENELAKVRNHYNEEMSNLRNKYETEINITKTTIKEISMQKEDDSKNLRNQLDRLSRENRDLKDEIVRLNDSILQATEQRRRAEENALQQKACGSEIMQKKQHLEIELKQVMQQRSEDNARHKQSLEEAAKTIQDKNKEIERLKAEFQEEAKRRWEYENELSKVRNNYDEEIISLKNQFETEINITKTTIHQLTMQKEEDTSGYRAQIDNLTRENRSLSEEIKRLKNTLTQTTENLRRVEEDIQQQKATGSEVSQRKQQLEVELRQVTQMRTEESVRYKQSLDDAAKTIQDKNKEIERLKQLIDKETNDRKCLEDENARLQRVQYDLQKANSSATETINKLKVQEQELTRLRIDYERVSQERTVKDQDITRFQNSLKELQLQKQKVEEELNRLKRTASEDSCKRKKLEEELEGMRRSLKEQAIKITNLTQQLEQASIVKKRSEDDLRQQRDVLDGHLREKQRTQEELRRLSSEVEALRRQLLQEQESVKQAHLRNEHFQKAIEDKSRSLNESKIEIERLQSLTENLTKEHLMLEEELRNLRLEYDDLRRGRSEADSDKNATILELRSQLQISNNRTLELQGLINDLQRERENLRQEIEKFQKQALEASNRIQESKNQCTQVVQERESLLVKIKVLEQDKARLQRLEDELNRAKSTLEAETRVKQRLECEKQQIQNDLNQWKTQYSRKEEAIRKIESEREKSEREKNSLRSEIERLQAEIKRIEERCRRKLEDSTRETQSQLETERSRYQREIDKLRQRPYGSHRETQTECEWTVDTSKLVFDGLRKKVTAMQLYECQLIDKTTLDKLLKGKKSVEEVASEIQPFLRGAGSIAGASASPKEKYSLVEAKRKKLISPESTVMLLEAQAATGGIIDPHRNEKLTVDSAIARDLIDFDDRQQIYAAEKAITGFDDPFSGKTVSVSEAIKKNLIDRETGMRLLEAQIASGGVVDPVNSVFLPKDVALARGLIDRDLYRSLNDPRDSQKNFVDPVTKKKVSYVQLKERCRIEPHTGLLLLSVQKRSMSFQGIRQPVTVTELVDSGILRPSTVNELESGQISYDEVGERIKDFLQGSSCIAGIYNETTKQKLGIYEAMKIGLVRPGTALELLEAQAATGFIVDPVSNLRLPVEEAYKRGLVGIEFKEKLLSAERAVTGYNDPETGNIISLFQAMNKELIEKGQQRVDAAANLVVVGGR

SEQ ID NO: 835744 - protein, 1291 aa, Homo sapiens
QLEEEYENLLKASFERMDHLRQLQNIIQATSREIMWINDCEEEELLYDWSDKNTNIAQKQEAFSIRMSQLEVKEKELNKLKQESDQLVLNQHPASDKIEAYMDTLQTQWSWILQITKCIDVHLKENAAYFQFFEEAQSTEAYLKGLQDSIRKKYPCDKNMPLQHLLEQIKELEKEREKILEYKRQVQNLVNKSKKIVQLKPRNPDYRSNKPIILRALCDYKQDQKIVHKGDECILKDNNERSKWYVTGPGGVDMLVPSVGLIIPPPNPLAVDLSCKIEQYYEAILALWNQLYINMKSLVSWHYCMIDIEKIRAMTIAKLKTMRQEDYMKTIADLELHYQEFIRNSQGSEMFGDDDKRKIQSQFTDAQKHYQTLVIQLPGYPQHQTVTTTEITHHGTCQDVNHNKVIETNRENDKQETWMLMELQKIRRQIEHCEGRMTLKNLPLADQGSSHHITVKINELKSVQNDSQAIAEVLNQLKDMLANFRGSEKYCYLQNEVFGLFQKLENINGVTDGYLNSLCTVRALLQAILQTEDMLKVYEARLTEEETVCLDLDKVEAYRCGLKKIKNDLNLKKSLLATMKTELQKAQQIHSQTSQQYPLYDLDLGKFGEKVTQLTDRWQRIDKQIDFRLWDLEKQIKQLRNYRDNYQAFCKWLYDAKRRQDSLESMKFGDSNTVMRFLNEQKNLHSEISGKRDKSEEVQKIAELCANSIKDYELQLASYTSGLETLLNIPIKRTMIQSPSGVILQEAADVHARYIELLTRSGDYYRFLSEMLKSLEDLKLKNTKIEVLEEELRLARDANSENCNKNKFLDQNLQKYQAECSQFKAKLASLEELKRQAELDGKSAKQNLDKCYGQIKELNEKITRLTYEIEDEKRRRKSVEDRFDQQKNDYDQLQKARQCEKENLGWQKLESEKAIKEKEYEIERLRVLLQEEGTRKREYENELAKVRNHYNEEMSNLRNKYETEINITKTTIKEISMQKEDDSKNLRNQLDRLSRENRDLKDEIVRLNDSILQATEQRRRAEENALQQKACGSEIMQKKQHLEIELKQVMQQRSEDNARHKQSLEEAAKTIQDKNKEIERLKAEFQEEAKRRWEYENELSKVRNNYDEEIISLKNQFETEINITKTTIHQLTMQKEEDTSGYRAQIDNLTRENRSLSEEIKRLKNTLTQTTENLRRVEEDIQQQKATGSEVSQRKQQLEVELRQVTQMRTEESVRYKQSLDDAAKTIQDKNKEIERLKQLIDKETNDRKCLEDENARLQRVQYDLQKANSSATETINKLKVQGRGSTRPRI

SEQ ID NO: 835745 - protein, 2707 aa, Homo sapiens
QLEEEYENLLKASFERMDHLRQLQNIIQATSREIMWINDCEEEELLYDWSDKNTNIAQKQEAFSIRMSQLEVKEKELNKLKQESDQLVLNQHPASDKIEAYMDTLQTQWSWILQITKCIDVHLKENAAYFQFFEEAQSTEAYLKGLQDSIRKKYPCDKNMPLQHLLEQIKELEKEREKILEYKRQVQNLVNKSKKIVQLKPRNPDYRSNKPIILRALCDYKQDQKIVHKGDECILKDNNERSKWYVTGPGGVDMLVPSVGLIIPPPNPLAVDLSCKIEQYYEAILALWNQLYINMKSLVSWHYCMIDIEKIRAMTIAKLKTMRQEDYMKTIADLELHYQEFIRNSQGSEMFGDDDKRKIQSQFTDAQKHYQTLVIQLPGYPQHQTGRLGTSFSLYQPSIHFKKKGVCIKLVSEPFLWMLYSQCSSCTKFSELILKFKGRRYTFRKYGCFLRPSTLIPRYSLIFVALTSFSVTTTEITHHGTCQDVNHNKVIETNRENDKQETWMLMELQKIRRQIEHCEGRMTLKNLPLADQGSSHHITVKINELKSVQNDSQAIAEVLNQLKDMLANFRGSEKYCYLQNEVFGLFQKLENINGVTDGYLNSLCTVRALLQAILQTEDMLKVYEARLTEEETVCLDLDKVEAYRCGLKKIKNDLNLKKSLLATMKTELQKAQQIHSQTSQQYPLYDLDLGKFGEKVTQLTDRWQRIDKQIDFRLWDLEKQIKQLRNYRDNYQAFCKWLYDAKRRQDSLESMKFGDSNTVMRFLNEQKNLHSEISGKRDKSEEVQKIAELCANSIKDYELQLASYTSGLETLLNIPIKRTMIQSPSGVILQEAADVHARYIELLTRSGDYYRFLSEMLKSLEDLKLKNTKIEVLEEELRLARDANSENCNKNKFLDQNLQKYQAECSQFKAKLASLEELKRQAELDGKSAKQNLDKCYGQIKELNEKITRLTYEIEDEKRRRKSVEDRFDQQKNDYDQLQKARQCEKENLGWQKLESEKAIKEKEYEIERLRVLLQEEGTRKREYENELAKVRNHYNEEMSNLRNKYETEINITKTTIKEISMQKEDDSKNLRNQLDRLSRENRDLKDEIVRLNDSILQATEQRRRAEENALQQKACGSEIMQKKQHLEIELKQVMQQRSEDNARHKQSLEEAAKTIQDKNKEIERLKAEFQEEAKRRWEYENELSKVRNNYDEEIISLKNQFETEINITKTTIHQLTMQKEEDTSGYRAQIDNLTRENRSLSEEIKRLKNTLTQTTENLRRVEEDIQQQKATGSEVSQRKQQLEVELRQVTQMRTEESVRYKQSLDDAAKTIQDKNKEIERLKQLIDKETNDRKCLEDENARLQRVQYDLQKANSSATETINKLKVQEQELTRLRIDYERVSQERTVKDQDITRFQNSLKELQLQKQKVEEELNRLKRTASEDSCKRKKLEEELEGMRRSLKEQAIKITNLTQQLEQASIVKKRSEDDLRQQRDVLDGHLREKQRTQEELRRLSSEVEALRRQLLQEQESVKQAHLRNEHFQKAIEDKSRSLNESKIEIERLQSLTENLTKEHLMLEEELRNLRLEYDDLRRGRSEADSDKNATILELRSQLQISNNRTLELQGLINDLQRERENLRQEIEKFQKQALEASNRIQESKNQCTQVVQERESLLVKIKVLEQDKARLQRLEDELNRAKSTLEAETRVKQRLECEKQQIQNDLNQWKTQYSRKEEAIRKIESEREKSEREKNSLRSEIERLQAEIKRIEERCRRKLEDSTRETQSQLETERSRYQREIDKLRQRPYGSHRETQTECEWTVDTSKLVFDGLRKKVTAMQLYECQLIDKTTLDKLLKGKKSVEEVASEIQPFLRGAGSIAGASASPKEKYSLVEAKRKKLISPESTVMLLEAQAATGGIIDPHRNEKLTVDSAIARDLIDFDDRQQIYAAEKAITGFDDPFSGKTVSVSEAIKKNLIDRETGMRLLEAQIASGGVVDPVNSVFLPKDVALARGLIDRDLYRSLNDPRDSQKNFVDPVTKKKVSYVQLKERCRIEPHTGLLLLSVQKRSMSFQGIRQPVTVTELVDSGILRPSTVNELESGQISYDEVGERIKDFLQGSSCIAGIYNETTKQKLGIYEAMKIGLVRPGTALELLEAQAATGFIVDPVSNLRLPVEEAYKRGLVGIEFKEKLLSAERAVTGYNDPETGNIISLFQAMNKELIEKGHGIRLLEAQIATGGIIDPKESHRLPVDIAYKRGYFNEELSEILSDPSDDTKGFFDPNTEENLTYLQLKERCIKDEETGLCLLPLKEKKKQVQTSQKNTLRKRRVVIVDPETNKEMSVQEAYKKGLIDYETFKELCEQECEWEEITITGSDGSTRVVLVDRKTGSQYDIQDAIDKGLVDRKFFDQYRSGSLSLTQFADMISLKNGVGTSSSMGSGVSDDVFSSSRHESVSKISTISSVRNLTIRSSSFSDTLEESSPIAAIFDTENLEKISITEGIERGIVDSITGQRLLEAQACTGGIIHPTTGQKLSLQDAVSQGVIDQDMATRLKPAQKAFIGFEGVKGKKKMSAAEAVKEKWLPYEAGQRFLEFQYLTGGLVDPEVHGRISTEEAIRKGFIDGRAAQRLQDTSSYAKILTCPKTKLKISYKDAINRSMVEDITGLRLLEAASVSSKGLPSPYNMSSAPGSRSGSRSGSRSGSRSGSRSGSRRGSFDATGNSSYSYSYSFSSSSIGH

SEQ ID NO: 835746 - protein, 1855 aa, Homo sapiens
MTGTTIGRAGTGDCLRLFTLAGRMCCTLTGLVASLELPSKFLDQNLQKYQAECSQFKAKLASLEELKRQAELDGKSAKQNLDKCYGQIKELNEKITRLTYEIEDEKRRRKSVEDRFDQQKNDYDQLQKARQCEKENLGWQKLESEKAIKEKEYEIERLRVLLQEEGTRKREYENELAKVRNHYNEEMSNLRNKYETEINITKTTIKEISMQKEDDSKNLRNQLDRLSRENRDLKDEIVRLNDSILQATEQRRRAEENALQQKACGSEIMQKKQHLEIELKQVMQQRSEDNARHKQSLEEAAKTIQDKNKEIERLKAEFQEEAKRRWEYENELSKVRNNYDEEIISLKNQFETEINITKTTIHQLTMQKEEDTSGYRAQIDNLTRENRSLSEEIKRLKNTLTQTTENLRRVEEDIQQQKATGSEVSQRKQQLEVELRQVTQMRTEESVRYKQSLDDAAKTIQDKNKEIERLKQLIDKETNDRKCLEDENARLQRVQYDLQKANSSATETINKLKVQEQELTRLRIDYERVSQERTVKDQDITRFQNSLKELQLQKQKVEEELNRLKRTASEDSCKRKKLEEELEGMRRSLKEQAIKITNLTQQLEQASIVKKRSEDDLRQQRDVLDGHLREKQRTQEELRRLSSEVEALRRQLLQEQESVKQAHLRNEHFQKAIEDKSRSLNESKIEIERLQSLTENLTKEHLMLEEELRNLRLEYDDLRRGRSEADSDKNATILELRSQLQISNNRTLELQGLINDLQRERENLRQEIEKFQKQALEASNRIQESKNQCTQVVQERESLLVKIKVLEQDKARLQRLEDELNRAKSTLEAETRVKQRLECEKQQIQNDLNQWKTQYSRKEEAIRKIESEREKSEREKNSLRSEIERLQAEIKRIEERCRRKLEDSTRETQSQLETERSRYQREIDKLRQRPYGSHRETQTECEWTVDTSKLVFDGLRKKVTAMQLYECQLIDKTTLDKLLKGKKSVEEVASEIQPFLRGAGSIAGASASPKEKYSLVEAKRKKLISPESTVMLLEAQAATGGIIDPHRNEKLTVDSAIARDLIDFDDRQQIYAAEKAITGFDDPFSGKTVSVSEAIKKNLIDRETGMRLLEAQIASGGVVDPVNSVFLPKDVALARGLIDRDLYRSLNDPRDSQKNFVDPVTKKKVSYVQLKERCRIEPHTGLLLLSVQKRSMSFQGIRQPVTVTELVDSGILRPSTVNELESGQISYDEVGERIKDFLQGSSCIAGIYNETTKQKLGIYEAMKIGLVRPGTALELLEAQAATGFIVDPVSNLRLPVEEAYKRGLVGIEFKEKLLSAERAVTGYNDPETGNIISLFQAMNKELIEKGHGIRLLEAQIATGGIIDPKESHRLPVDIAYKRGYFNEELSEILSDPSDDTKGFFDPNTEENLTYLQLKERCIKDEETGLCLLPLKEKKKQVQTSQKNTLRKRRVVIVDPETNKEMSVQEAYKKGLIDYETFKELCEQECEWEEITITGSDGSTRVVLVDRKTGSQYDIQDAIDKGLVDRKFFDQYRSGSLSLTQFADMISLKNGVGTSSSMGSGVSDDVFSSSRHESVSKISTISSVRNLTIRSSSFSDTLEESSPIAAIFDTENLEKISITEGIERGIVDSITGQRLLEAQACTGGIIHPTTGQKLSLQDAVSQGVIDQDMATRLKPAQKAFIGFEGVKGKKKMSAAEAVKEKWLPYEAGQRFLEFQYLTGGLVDPEVHGRISTEEAIRKGFIDGRAAQRLQDTSSYAKILTCPKTKLKISYKDAINRSMVEDITGLRLLEAASVSSKGLPSPYNMSSAPGSRSGSRSGSRSGSRSGSRSGSRRGSFDATGNSSYSYSYSFSSSSIGH

SEQ ID NO: 835747 - protein, 2538 aa, Homo sapiens
QLEEEYENLLKASFERMDHLRQLQNIIQATSREIMWINDCEEEELLYDWSDKNTNIAQKQEAFSIRMSQLEVKEKELNKLKQESDQLVLNQHPASDKIEAYMDTLQTQWSWILQITKCIDVHLKENAAYFQFFEEAQSTEAYLKGLQDSIRKKYPCDKNMPLQHLLEQIKELEKEREKILEYKRQVQNLVNKSKKIVQLKPRNPDYRSNKPIILRALCDYKQDQKIVHKGDECILKDNNERSKWYVTGPGGVDMLVPSVGLIIPPPNPLAVDLSCKIEQYYEAILALWNQLYINMKSLVSWHYCMIDIEKIRAMTIAKLKTMRQEDYMKTIADLELHYQEFIRNSQGSEMFGDDDKRKIQSQFTDAQKHYQTLVIQLPGYPQHQTVTTTEITHHGTCQDVNHNKVIETNRENDKQETWMLMELQKIRRQIEHCEGRMTLKNLPLADQGSSHHITVKINELKSVQNDSQAIAEVLNQLKDMLANFRGSEKYCYLQNEVFGLFQKLENINGVTDGYLNSLCTVRALLQAILQTEDMLKVYEARLTEEETVCLDLDKVEAYRCGLKKIKNDLNLKKSLLATMKTELQKAQQIHSQTSQQYPLYDLDLGKFGEKVTQLTDRWQRIDKQIDFRLWDLEKQIKQLRNYRDNYQAFCKWLYDAKRRQDSLESMKFGDSNTVMRFLNEQKNLHSEISGKRDKSEEVQKIAELCANSIKDYELQLASYTSGLETLLNIPIKRTMIQSPSGVILQEAADVHARYIELLTRSGDYYRFLSEMLKSLEDLKLKNTKIEVLEEELRLARDANSENCNKNKFLDQNLQKYQAECSQFKAKLASLEELKRQAELDGKSAKQNLDKCYGQIKELNEKITRLTYEIEDEKRRRKSVEDRFDQQKNDYDQLQKARQCEKENLGWQKLESEKAIKEKEYEIERLRVLLQEEGTRKREYENELAKVRNHYNEEMSNLRNKYETEINITKTTIKEISMQKEDDSKNLRNQLDRLSRENRDLKDEIVRLNDSILQATEQRRRAEENALQQKACGSEIMQKKQHLEIELKQVMQQRSEDNARHKQSLEEAAKTIQDKNKEIERLKAEFQEEAKRRWEYENELSKVRNNYDEEIISLKNQFETEINITKTTIHQLTMQKEEDTSGYRAQIDNLTRENRSLSEEIKRLKNTLTQTTENLRRVEEDIQQQKATGSEVSQRKQQLEVELRQVTQMRTEESVRYKQSLDDAAKTIQDKNKEIERLKQLIDKETNDRKCLEDENARLQRVQYDLQKANSSATETINKLKVQEQELTRLRIDYERVSQERTVKDQDITRFQNSLKELQLQKQKVEEELNRLKRTASEDSCKRKKLEEELEGMRRSLKEQAIKITNLTQQLEQASIVKKRSEDDLRQQRDVLDGHLREKQRTQEGRSEADSDKNATILELRSQLQISNNRTLELQGLINDLQRERENLRQEIEKFQKQALEASNRIQESKNQCTQVVQERESLLVKIKVLEQDKARLQRLEDELNRAKSTLEAETRVKQRLECEKQQIQNDLNQWKTQYSRKEEAIRKIESEREKSEREKNSLRSEIERLQAEIKRIEERCRRKLEDSTRETQSQLETERSRYQREIDKLRQRPYGSHRETQTECEWTVDTSKLVFDGLRKKVTAMQLYECQLIDKTTLDKLLKGKKSVEEVASEIQPFLRGAGSIAGASASPKEKYSLVEAKRKKLISPESTVMLLEAQAATGGIIDPHRNEKLTVDSAIARDLIDFDDRQQIYAAEKAITGFDDPFSGKTVSVSEAIKKNLIDRETGMRLLEAQIASGGVVDPVNSVFLPKDVALARGLIDRDLYRSLNDPRDSQKNFVDPVTKKKVSYVQLKERCRIEPHTGLLLLSVQKRSMSFQGIRQPVTVTELVDSGILRPSTVNELESGQISYDEVGERIKDFLQGSSCIAGIYNETTKQKLGIYEAMKIGLVRPGTALELLEAQAATGFIVDPVSNLRLPVEEAYKRGLVGIEFKEKLLSAERAVTGYNDPETGNIISLFQAMNKELIEKGHGIRLLEAQIATGGIIDPKESHRLPVDIAYKRGYFNEELSEILSDPSDDTKGFFDPNTEENLTYLQLKERCIKDEETGLCLLPLKEKKKQVQTSQKNTLRKRRVVIVDPETNKEMSVQEAYKKGLIDYETFKELCEQECEWEEITITGSDGSTRVVLVDRKTGSQYDIQDAIDKGLVDRKFFDQYRSGSLSLTQFADMISLKNGVGTSSSMGSGVSDDVFSSSRHESVSKISTISSVRNLTIRSSSFSDTLEESSPIAAIFDTENLEKISITEGIERGIVDSITGQRLLEAQACTGGIIHPTTGQKLSLQDAVSQGVIDQDMATRLKPAQKAFIGFEGVKGKKKMSAAEAVKEKWLPYEAGQRFLEFQYLTGGLVDPEVHGRISTEEAIRKGFIDGRAAQRLQDTSSYAKILTCPKTKLKISYKDAINRSMVEDITGLRLLEAASVSSKGLPSPYNMSSAPGSRSGSRSGSRSGSRSGSRSGSRRGSFDATGNSSYSYSYSFSSSSIGH

SEQ ID NO: 835748 - protein, 1561 aa, Homo sapiens
SRVKNERESSCTDIGRYPYCTQLLSATCMRRWEYENELSKVRNNYDEEIISLKNQFETEINITKTTIHQLTMQKEEDTSGYRAQIDNLTRENRSLSEEIKRLKNTLTQTTENLRRVEEDIQQQKATGSEVSQRKQQLEVELRQVTQMRTEESVRYKQSLDDAAKTIQDKNKEIERLKQLIDKETNDRKCLEDENARLQRVQYDLQKANSSATETINKLKVQEQELTRLRIDYERVSQERTVKDQDITRFQNSLKELQLQKQKVEEELNRLKRTASEDSCKRKKLEEELEGMRRSLKEQAIKITNLTQQLEQASIVKKRSEDDLRQQRDVLDGHLREKQRTQEELRRLSSEVEALRRQLLQEQESVKQAHLRNEHFQKAIEDKSRSLNESKIEIERLQSLTENLTKEHLMLEEELRNLRLEYDDLRRGRSEADSDKNATILELRSQLQISNNRTLELQGLINDLQRERENLRQEIEKFQKQALEASNRIQESKNQCTQVVQERESLLVKIKVLEQDKARLQRLEDELNRAKSTLEAETRVKQRLECEKQQIQNDLNQWKTQYSRKEEAIRKIESEREKSEREKNSLRSEIERLQAEIKRIEERCRRKLEDSTRETQSQLETERSRYQREIDKLRQRPYGSHRETQTECEWTVDTSKLVFDGLRKKVTAMQLYECQLIDKTTLDKLLKGKKSVEEVASEIQPFLRGAGSIAGASASPKEKYSLVEAKRKKLISPESTVMLLEAQAATGGIIDPHRNEKLTVDSAIARDLIDFDDRQQIYAAEKAITGFDDPFSGKTVSVSEAIKKNLIDRETGMRLLEAQIASGGVVDPVNSVFLPKDVALARGLIDRDLYRSLNDPRDSQKNFVDPVTKKKVSYVQLKERCRIEPHTGLLLLSVQKRSMSFQGIRQPVTVTELVDSGILRPSTVNELESGQISYDEVGERIKDFLQGSSCIAGIYNETTKQKLGIYEAMKIGLVRPGTALELLEAQAATGFIVDPVSNLRLPVEEAYKRGLVGIEFKEKLLSAERAVTGYNDPETGNIISLFQAMNKELIEKGHGIRLLEAQIATGGIIDPKESHRLPVDIAYKRGYFNEELSEILSDPSDDTKGFFDPNTEENLTYLQLKERCIKDEETGLCLLPLKEKKKQVQTSQKNTLRKRRVVIVDPETNKEMSVQEAYKKGLIDYETFKELCEQECEWEEITITGSDGSTRVVLVDRKTGSQYDIQDAIDKGLVDRKFFDQYRSGSLSLTQFADMISLKNGVGTSSSMGSGVSDDVFSSSRHESVSKISTISSVRNLTIRSSSFSDTLEESSPIAAIFDTENLEKISITEGIERGIVDSITGQRLLEAQACTGGIIHPTTGQKLSLQDAVSQGVIDQDMATRLKPAQKAFIGFEGVKGKKKMSAAEAVKEKWLPYEAGQRFLEFQYLTGGLVDPEVHGRISTEEAIRKGFIDGRAAQRLQDTSSYAKILTCPKTKLKISYKDAINRSMVEDITGLRLLEAASVSSKGLPSPYNMSSAPGSRSGSRSGSRSGSRSGSRSGSRRGSFDATGNSSYSYSYSFSSSSIGH

SEQ ID NO: 835749 - protein, 1050 aa, Homo sapiens
QDRRSGCESAAEEHDSLRLKTPLAETRVKQRLECEKQQIQNDLNQWKTQYSRKEEAIRKIESEREKSEREKNSLRSEIERLQAEIKRIEERCRRKLEDSTRETQSQLETERSRYQREIDKLRQRPYGSHRETQTECEWTVDTSKLVFDGLRKKVTAMQLYECQLIDKTTLDKLLKGKKSVEEVASEIQPFLRGAGSIAGASASPKEKYSLVEAKRKKLISPESTVMLLEAQAATGGIIDPHRNEKLTVDSAIARDLIDFDDRQQIYAAEKAITGFDDPFSGKTVSVSEAIKKNLIDRETGMRLLEAQIASGGVVDPVNSVFLPKDVALARGLIDRDLYRSLNDPRDSQKNFVDPVTKKKVSYVQLKERCRIEPHTGLLLLSVQKRSMSFQGIRQPVTVTELVDSGILRPSTVNELESGQISYDEVGERIKDFLQGSSCIAGIYNETTKQKLGIYEAMKIGLVRPGTALELLEAQAATGFIVDPVSNLRLPVEEAYKRGLVGIEFKEKLLSAERAVTGYNDPETGNIISLFQAMNKELIEKGHGIRLLEAQIATGGIIDPKESHRLPVDIAYKRGYFNEELSEILSDPSDDTKGFFDPNTEENLTYLQLKERCIKDEETGLCLLPLKEKKKQVQTSQKNTLRKRRVVIVDPETNKEMSVQEAYKKGLIDYETFKELCEQECEWEEITITGSDGSTRVVLVDRKTGSQYDIQDAIDKGLVDRKFFDQYRSGSLSLTQFADMISLKNGVGTSSSMGSGVSDDVFSSSRHESVSKISTISSVRNLTIRSSSFSDTLEESSPIAAIFDTENLEKISITEGIERGIVDSITGQRLLEAQACTGGIIHPTTGQKLSLQDAVSQGVIDQDMATRLKPAQKAFIGFEGVKGKKKMSAAEAVKEKWLPYEAGQRFLEFQYLTGGLVDPEVHGRISTEEAIRKGFIDGRAAQRLQDTSSYAKILTCPKTKLKISYKDAINRSMVEDITGLRLLEAASVSSKGLPSPYNMSSAPGSRSGSRSGSRSGSRSGSRSGSRRGSFDATGNSSYSYSYSFSSSSIGH

SEQ ID NO: 835750 - protein, 2265 aa, Homo sapiens
QLEEEYENLLKASFERMDHLRQLQNIIQATSREIMWINDCEEEELLYDWSDKNTNIAQKQEAFSIRMSQLEVKEKELNKLKQESDQLVLNQHPASDKIEAYMDTLQTQWSWILQITKCIDVHLKENAAYFQFFEEAQSTEAYLKGLQDSIRKKYPCDKNMPLQHLLEQIKELEKEREKILEYKRQVQNLVNKSKKIVQLKPRNPDYRSNKPIILRALCDYKQDQKIVHKGDECILKDNNERSKWYVTGPGGVDMLVPSVGLIIPPPNPLAVDLSCKIEQYYEAILALWNQLYINMKSLVSWHYCMIDIEKIRAMTIAKLKTMRQEDYMKTIADLELHYQEFIRNSQGSEMFGDDDKRKIQSQFTDAQKHYQTLVIQLPGYPQHQTVTTTEITHHGTCQDVNHNKVIETNRENDKQETWMLMELQKIRRQIEHCEGRMTLKNLPLADQGSSHHITVKINELKSVQNDSQAIAEVLNQLKDMLANFRGSEKYCYLQNEVFGLFQKLENINGVTDGYLNSLCTVRALLQAILQTEDMLKVYEARLTEEETVCLDLDKVEAYRCGLKKIKNDLNLKKSLLATMKTELQKAQQIHSQTSQQYPLYDLDLGKFGEKVTQLTDRWQRIDKQIDFRLWDLEKQIKQLRNYRDNYQAFCKWLYDAKRRQDSLESMKFGDSNTVMRFLNEQKNLHSEISGKRDKSEEVQKIAELCANSIKDYELQLASYTSGLETLLNIPIKRTMIQSPSGVILQEAADVHARYIELLTRSGDYYRFLSEMLKSLEDLKLKNTKIEVLEEELRLARDANSENCNKNKFLDQNLQKYQAECSQFKAKLASLEELKRQAELDGKSAKQNLDKCYGQIKELNEKITRLTYEIEDEKRRRKSVEDRFDQQKNDYDQLQKARQCEKENLGWQKLESEKAIKEKEYEIERLRVLLQEEGTRKREYENELAKVRNHYNEEMSNLRNKYETEINITKTTIKEISMQKEDDSKNLRNQLDRLSRENRDLKDEIVRLNDSILQATEQRRRAEENALQQKACGSEIMQKKQHLEIELKQVMQQRSEDNARHKQSLEEAAKTIQDKNKEIERLKAEFQEEAKRRWEYENELSKVRNNYDEEIISLKNQFETEINITKTTIHQLTMQKEEDTSGYRAQIDNLTRENRSLSEEIKRLKNTLTQTTENLRRVEEDIQQQKATGSEVSQRKQQLEVELRQVTQMRTEESVRYKQSLDDAAKTIQDKNKEIERLKQLIDKETNDRKCLEDENARLQRVQYDLQKANSSATETINKLKVQEQELTRLRIDYERVSQERTVKDQDITRFQNSLKELQLQKQKVEEELNRLKRTASEDSCKRKKLEEELEGMRRSLKEQAIKITNLTQQLEQASIVKKRSEDDLRQQRDVLDGHLREKQRTQEELRRLSSEVEALRRQLLQEQESVKQAHLRNEHFQKAIEDKSRSLNESKIEIERLQSLTENLTKEHLMLEEELRNLRLEYDDLRRGRSEADSDKNATILELRSQLQISNNRTLELQGLINDLQRERENLRQEIEKFQKQALEASNRIQESKNQCTQVVQERESLLVKIKVLEQDKARLQRLEDELNRAKSTLEAETRVKQRLECEKQQIQNDLNQWKTQYSRKEEAIRKIESEREKSEREKNSLRSEIERLQAEIKRIEERCRRKLEDSTRETQSQLETERSRYQREIDKLRQRPYGSHRETQTECEWTVDTSKLVFDGLRKKVTAMQLYECQLIDKTTLDKLLKGKKSVEEVASEIQPFLRGAGSIAGASASPKEKYSLVEAKRKKLISPESTVMLLEAQAATGGIIDPHRNEKLTVDSAIARDLIDFDDRQQIYAAEKAITGFDDPFSGKTVSVSEAIKKNLIDRETGMRLLEAQIASGGVVDPVNSVFLPKDVALARGLIDRDLYRSLNDPRDSQKNFVDPVTKKKVSYVQLKERCRIEPHTGLLLLSVQKRSMSFQGIRQPVTVTELVDSGILRPSTVNELESGQISYDEVGERIKDFLQGSSCIAGIYNETTKQKLGIYEAMKIGLVRPGTALELLEAQAATGFIVDPVSNLRLPVEEAYKRGLVGIEFKEKLLSAERAVTGYNDPETGNIISLFQAMNKELIEKGHGIRLLEAQIATGGIIDPKESHRLPVDIAYKRGYFNEELSEILSDPSDDTKGFFDPNTEENLTYLQLKERCIKDEETGLCLLPLKEKKKQVQTSQKNTLRKRRVVIVDPETNKEMSVQEAYKKGLIDYETFIIAALAALRLLFLHETGSTTP

SEQ ID NO: 835751 - protein, 1718 aa, Homo sapiens
QLEEEYENLLKASFERMDHLRQLQNIIQATSREIMWINDCEEEELLYDWSDKNTNIAQKQEAFSIRMSQLEVKEKELNKLKQESDQLVLNQHPASDKIEAYMDTLQTQWSWILQITKCIDVHLKENAAYFQFFEEAQSTEAYLKGLQDSIRKKYPCDKNMPLQHLLEQIKELEKEREKILEYKRQVQNLVNKSKKIVQLKPRNPDYRSNKPIILRALCDYKQDQKIVHKGDECILKDNNERSKWYVTGPGGVDMLVPSVGLIIPPPNPLAVDLSCKIEQYYEAILALWNQLYINMKSLVSWHYCMIDIEKIRAMTIAKLKTMRQEDYMKTIADLELHYQEFIRNSQGSEMFGDDDKRKIQSQFTDAQKHYQTLVIQLPGYPQHQTVTTTEITHHGTCQDVNHNKVIETNRENDKQETWMLMELQKIRRQIEHCEGRMTLKNLPLADQGSSHHITVKINELKSVQNDSQAIAEVLNQLKDMLANFRGSEKYCYLQNEVFGLFQKLENINGVTDGYLNSLCTVRALLQAILQTEDMLKVYEARLTEEETVCLDLDKVEAYRCGLKKIKNDLNLKKSLLATMKTELQKAQQIHSQTSQQYPLYDLDLGKFGEKVTQLTDRWQRIDKQIDFRLWDLEKQIKQLRNYRDNYQAFCKWLYDAKRRQDSLESMKFGDSNTVMRFLNEQKNLHSEISGKRDKSEEVQKIAELCANSIKDYELQLASYTSGLETLLNIPIKRTMIQSPSGVILQEAADVHARYIELLTRSGDYYRFLSEMLKSLEDLKLKNTKIEVLEEELRLARDANSENCNKNKFLDQNLQKYQAECSQFKAKLASLEELKRQAELDGKSAKQNLDKCYGQIKELNEKITRLTYEIEDEKRRRKSVEDRFDQQKNDYDQLQKARQCEKENLGWQKLESEKAIKEKEYEIERLRVLLQEEGTRKREYENELAKVRNHYNEEMSNLRNKYETEINITKTTIKEISMQKEDDSKNLRNQLDRLSRENRDLKDEIVRLNDSILQATEQRRRAEENALQQKACGSEIMQKKQHLEIELKQVMQQRSEDNARHKQSLEEAAKTIQDKNKEIERLKAEFQEEAKRRWEYENELSKVRNNYDEEIISLKNQFETEINITKTTIHQLTMQKEEDTSGYRAQIDNLTRENRSLSEEIKRLKNTLTQTTENLRRVEEDIQQQKATGSEVSQRKQQLEVELRQVTQMRTEESVRYKQSLDDAAKTIQDKNKEIERLKQLIDKETNDRKCLEDENARLQRVQYDLQKANSSATETINKLKVQEQELTRLRIDYERVSQERTVKDQDITRFQNSLKELQLQKQKVEEELNRLKRTASEDSCKRKKLEEELEGMRRSLKEQAIKITNLTQQLEQASIVKKRSEDDLRQQRDVLDGHLREKQRTQEELRRLSSEVEALRRQLLQEQESVKQAHLRNEHFQKAIEDKSRSLNESKIEIERLQSLTENLTKEHLMLEEELRNLRLEYDDLRRGRSEADSDKNATILELRSQLQISNNRTLELQGLINDLQRERENLRQEIEKFQKQALEASNRIQESKNQCTQVVQERESLLVKIKVLEQDKARLQRLEDELNRAKSTLEAETRVKQRLECEKQQIQNDLNQWKTQYSRKEEAIRKIESEREKSEREKNSLRSEIERLQAEIKRIEERCRRKLEDSTRETQSQLETERSRYLWPVFIEFRASGSPYWVATRADRSVHVVSYWS

SEQ ID NO: 835752 - protein, 489 aa, Homo sapiens
AELPARPSSAGRDKVMDRNPSPPPPGRDKEEEEEVAGGDCIGSTVYSKHWLFGVLSGLIQIVSPENTKSSSDDEEQLTELDEEMENEICRVWDMSMDEDVALFLQEFNAPDIFMGVLAKSKCPRLREICVGILGNMACFQEICVSISSDKNLGQVLLHCLYDSDPPTLLETSRLLLTCLSQAEVASVWVERIQEHPAIYDSICFIMSSSTNVDLLVKVGEVVDKLFDLDEKLMLEWVRNGAAQPLDQPQEESEEQPVFRLVPCILEAAKQVRSENPEWLDVYMHILQLLTTVDDGIQAIVHCPDTGKDIWNLLFDLVCHEFCQSDDPPIILQEQKTVLASVFSVLSAIYASQTEQEYLKIEKVDLPLIDSLIRVLQNMEQCQKKPENSAESNTEETKRTDLTQDDFHLKILKDILCEFLSNIFQALTKETVAQGVKEGQLSKQKCSSAFQNLLPFYSPVVEDFIKILREVDKALADDLEKNFPSLKVQT

SEQ ID NO: 835753 - protein, 135 aa, Homo sapiens
AELPARPSSAGRDKVMDRNPSPPPPGRDKEEEEEVAGGDCIGSTVYSKHWLFGVLSGLIQIVSPENTKSSSDDEEQLTELDEEMENEICRVWDMSMDEDVALFLQEFNAPDIFMGVLAKSKCPRLRFSCQRDQYH

SEQ ID NO: 835754 - protein, 489 aa, Homo sapiens; identical to SEQ ID NO: 835752

SEQ ID NO: 835755 - protein, 494 aa, Homo sapiens
AELPARPSSAGRDKVMDRNPSPPPPGRDKEEEEEVAGGDCIGSTVYSKHWLFGVLSGLIQIVSPENTKSSSDDEEQLTELDEEMENEICRVWDMSMDEDVALFLQEFNAPDIFMGVLAKSKCPRLREICVGILGNMACFQEICVSISSDKNLGQVLLHCLYDSDPPTLLETSRLLLTCLSQAEVASVWVERIQEHPAIYDSICFIMSSSTNVDLLVKVGEVVDKLFDLDEKLMLEWVRNGAAQPLDQPQEESEEQPVFRLVPCILEAAKQVRSENPEWLDVYMHILQLLTTVDDGIQAIVHCPDTGKDIWNLLFDLVCHEFCQSDDPPIILQEQKTVLASVFSVLSAIYASQTEQEYLKIEKVDLPLIDSLIRVLQNMEQCQKKPENSAESNTEETKRTDLTQDDFHLKILKDILCEFLSNIFQALTKETVAQGVKEGQLSKQKCSSAFQNLLPFYSPVVEDFIKILREVDKALADDLEKNFPSLKEPYAKIQM

SEQ ID NO: 835756 - protein, 390 aa, Homo sapiens
AELPARPSSAGRDKVMDRNPSPPPPGRDKEEEEEVAGGDCIGSTVYSKHWLFGVLSGLIQIVSPENTKSSSDDEEQLTELDEEMENEICRVWDMSMDEDVALFLQEFNAPDIFMGVLAKSKCPRLREICVGILGNMACFQEICVSISSDKNLGQVLLHCLYDSDPPTLLETSRLLLTCLSQAEVASVWVERIQEHPAIYDSICFIMSSSTNVDLLVKVGEVVDKLFDLDEKLMLEWVRNGAAQPLDQPQEESEEQPVFRLVPCILEAAKQVRSENPEWLDVYMHILQLLTTVDDGIQAIVHCPDTGKDIWNLLFDLVCHEFCQSDDPPIILQEQKTVLASVFSVLSAIYASQTEQEYLKIEKGDGGSGSKGRPVEQTEVFLCISKPSSFL

SEQ ID NO: 835757 - protein, 179 aa, Homo sapiens
AELPARPSSAGRDKVMDRNPSPPPPGRDKEEEEEVAGGDCIGSTVYSKHWLFGVLSGLIQIVSPENTKSSSDDEEQLTELDEEMENEICRVWDMSMDEDVALFLQEFNAPDIFMGVLAKSKCPRLREICVGILGNMACFQEICVSISSDKNLGQVLLHCLYDSDPPTLLETSRSGQCLG

SEQ ID NO: 835758 - protein, 146 aa, Homo sapiens
QHALHLDESAEDAEEPVFAVDRAPYAVSTGHLLLLLLVCDPAAAARGCDKEETKRTDLTQDDFHLKILKDILCEFLSNIFQALTKETVAQGVKEGQLSKQKCSSAFQNLLPFYSPVVEDFIKILREVDKALADDLEKNFPSLKVQT

SEQ ID NO: 835759 - protein, 154 aa, Homo sapiens
IRLGTRLGVVMDRNPSPPPPGRDKEEEEEVAGGDCIGSTVYSKHWLFGVLSGLIQIVSPENTKSSSDDEEQLTELDEEMENEICRVWDMSMDEETVAQGVKEGQLSKQKCSSAFQNLLPFYSPVVEDFIKILREVDKALADDLEKNFPSLKVQT

SEQ ID NO: 835760 - protein, 489 aa, Homo sapiens; identical to SEQ ID NO: 835752

SEQ ID NO: 835761 - protein, 493 aa, Homo sapiens
AELPARPSSAGRDKVMDRNPSPPPPGRDKEEEEEVAGGDCIGSTVYSKHWLFGVLSGLIQIVSPENTKSSSDDEEQLTELDEEMENEICRVWDMSMDEDVALFLQEFNAPDIFMGVLAKSKCPRLREICVGILGNMACFQEICVSISSDKNLGQVLLHCLYDSDPPTLLETSRLLLTCLSQAEVASVWVERIQEHPAIYDSICFIMSSSTNVDLLVKVGEVVDKLFDLDEKLMLEWVRNGAAQPLDQPQEESEEQPVFRLVPCILEAAKQVRSENPEWLDVYMHILQLLTTVDDGIQAIVHCPDTGKDIWNLLFDLVCHEFCQSDDPPIILQEQKTVLASVFSVLSAIYASQTEQEYLKIEKVDLPLIDSLIRVLQNMEQCQKKPENSAESNTEETKRTDLTQDDFHLKILKDILCEFLSNIFQALTKETVAQGVKEGQLSKQKCSSAFQNLLPFYSPVVEDFIKILREVDKALADDLEKNFPSLKGFRSLNP

SEQ ID NO: 835762 - protein, 393 aa, Homo sapiens
AELPARPSSAGRDKVMDRNPSPPPPGRDKEEEEEVAGGDCIGSTVYSKHWLFGVLSGLIQIVSPENTKSSSDDEEQLTELDEEMENEICRVWDMSMDEDVALFLQEFNAPDIFMGVLAKSKCPRLREICVGILGNMACFQEICVSISSDKNLGQVLLHCLYDSDPPTLLETSRLLLTCLSQAEVASVWVERIQEHPAIYDSICFIMSSSTNVDLLVKVGEVVDKLFDLDEKLMLEWVRNGAAQPLDQPQEESEEQPVFRLVPCILEAAKQVRSENPEWLDVYMHILQLLTTVDDGIQAIVHCPDTGKDIWNLLFDLVCHEFCQSDDPPIILQEQKTVLASVFSVLSAIYASQTEQEYLKIEKASFGSYKIWNSVRKNQRTRQSLTQRKLKGLI

SEQ ID NO: 835763 - protein, 484 aa, Homo sapiens
IRLGTRLGVVMDRNPSPPPPGRDKEEEEEVAGGDCIGSTVYSKHWLFGVLSGLIQIVSPENTKSSSDDEEQLTELDEEMENEICRVWDMSMDEDVALFLQEFNAPDIFMGVLAKSKCPRLREICVGILGNMACFQEICVSISSDKNLGQVLLHCLYDSDPPTLLETSRLLLTCLSQAEVASVWVERIQEHPAIYDSICFIMSSSTNVDLLVKVGEVVDKLFDLDEKLMLEWVRNGAAQPLDQPQEESEEQPVFRLVPCILEAAKQVRSENPEWLDVYMHILQLLTTVDDGIQAIVHCPDTGKDIWNLLFDLVCHEFCQSDDPPIILQEQKTVLASVFSVLSAIYASQTEQEYLKIEKVDLPLIDSLIRVLQNMEQCQKKPENSAESNTEETKRTDLTQDDFHLKILKDILCEFLSNIFQALTKETVAQGVKEGQLSKQKCSSAFQNLLPFYSPVVEDFIKILREVDKALADDLEKNFPSLKVQT

SEQ ID NO: 835764 - protein, 446 aa, Homo sapiens
IRLGTRLGVVMDRNPSPPPPGRDKEEEEEVAGGDCIGSTVYSKHWLFGVLSGLIQDVALFLQEFNAPDIFMGVLAKSKCPRLREICVGILGNMACFQEICVSISSDKNLGQVLLHCLYDSDPPTLLETSRLLLTCLSQAEVASVWVERIQEHPAIYDSICFIMSSSTNVDLLVKVGEVVDKLFDLDEKLMLEWVRNGAAQPLDQPQEESEEQPVFRLVPCILEAAKQVRSENPEWLDVYMHILQLLTTVDDGIQAIVHCPDTGKDIWNLLFDLVCHEFCQSDDPPIILQEQKTVLASVFSVLSAIYASQTEQEYLKIEKVDLPLIDSLIRVLQNMEQCQKKPENSAESNTEETKRTDLTQDDFHLKILKDILCEFLSNIFQALTKETVAQGVKEGQLSKQKCSSAFQNLLPFYSPVVEDFIKILREVDKALADDLEKNFPSLKVQT

SEQ ID NO: 835765 - protein, 130 aa, Homo sapiens
MNDTVTIRTRKFMTNRLLQRKQMVIDVLHPGKATVPKTEIREKLAKMYKTTPDVIFVFGFRTHFGGGKTTGFGMIYDSLDYAKKNEPKHRLARHGLYEKKKTSRKQRKERKNRMKKVRGTAKANVGAGKK

SEQ ID NO: 835766 - protein, 130 aa, Homo sapiens; identical to SEQ ID NO: 835765

SEQ ID NO: 835767 - protein, 130 aa, Homo sapiens; identical to SEQ ID NO: 835765

SEQ ID NO: 835768 - protein, 130 aa, Homo sapiens; identical to SEQ ID NO: 835765

SEQ ID NO: 835769 - protein, 104 aa, Homo sapiens
MGLHYGGCYQHVDICVPNTTISEAARTPENKTKNSRPDSRPKPERGTEEKKKHPAREETTHRRRPNTQKGEHYEPTEGRPQHEQTEAPQNTRNIHSNPQPASST

SEQ ID NO: 835770 - protein, 68 aa, Homo sapiens
AAAYYYYYKFAAARPKMYKTTPDVIFVFGFRTHFGGGKTTGFGMIYDSLGIMQRKMNPNIDFARHGPV

SEQ ID NO: 835771 - protein, 73 aa, Homo sapiens
YPYTVKKGRQKVIPGYLKDFPGKISKGDRLVASRVYPQHFGRQEDSLAEEFETTRAEFGTIDRHHERHRNYPH

SEQ ID NO: 835772 - protein, 70 aa, Homo sapiens
AATTTKFAAASTCLKTSRKQRKGTQEQNERKSGGLQRANVGAGKKEVSWRLDQNEVSSMSWRLDHSRRSK

SEQ ID NO: 835773 - protein, 105 aa, Homo sapiens
NTRAPRFIKQVLRDLQRDLGSHTIIMGDFNTPLSTLDRSTRQKVNKDIQELNSALHQADLTGGIDKHRVYRCHHQNVQDHTGCHLCIWIQNSFWWWQDNWLWHDL

SEQ ID NO: 835774 - protein, 130 aa, Homo sapiens; identical to SEQ ID NO: 835765

SEQ ID NO: 835775 - protein, 130 aa, Homo sapiens; identical to SEQ ID NO: 835765

SEQ ID NO: 835776 - protein, 130 aa, Homo sapiens; identical to SEQ ID NO: 835765

SEQ ID NO: 835777 - protein, 130 aa, Homo sapiens; identical to SEQ ID NO: 835765

SEQ ID NO: 835778 - protein, 130 aa, Homo sapiens; identical to SEQ ID NO: 835765

SEQ ID NO: 835779 - protein, 130 aa, Homo sapiens; identical to SEQ ID NO: 835765

SEQ ID NO: 835780 - protein, 130 aa, Homo sapiens; identical to SEQ ID NO: 835765

SEQ ID NO: 835781 - protein, 130 aa, Homo sapiens; identical to SEQ ID NO: 835765

SEQ ID NO: 835782 - protein, 195 aa, Homo sapiens
MTCPKSFSSFMLGKGVSFRRLPLEFTPPLTASEPFATQVLFLAFLKMRELGLGVQALGRISQEERCTDVKNSKARESRGVVWQVEVPGPWSVWTCGRLRRGCGKYLQVAVTWRKTENREQCCQACLLERALVRNGAFMSPASPAPAGSPHPVDGDLVLHLPEALSATLTLSPHIQAINKSFGPFFEIHQESSCFS

SEQ ID NO: 835783 - protein, 93 aa, Homo sapiens
EESLPGPERVEVSSEGLRVTTAIFSALKFMHTLLSEENKWSLMSFTPGKATVPKTEIREKLAQNVQDHTGCHLCIWIQNSFWWWQDNWLWHDL

SEQ ID NO: 835784 - protein, 139 aa, Homo sapiens
CCGRSRGSLHVQGLHAGKATVPKTEIREKLAQNVQDHTGCHLCIWIQNSFWWWQDNWLWHERPRMNSCQPLHPQDNCNTLRRSRAVEAEETTLCVCMSVHRISKTPEYHVSLHDLITYDSIQMVKSRRSYSEGHEALDM

SEQ ID NO: 835785 - protein, 149 aa, Homo sapiens
MRELGLGVQALGRISQEERCTDVKNSKARESRGVVWQVEVPGPWSVWTCGRLRRGCGKYLQVAVTWRKTENREQCCQACLLERALVRNGAFMSPASPAPAGSPHPVDGDLVLHLPEALSATLTLSPHIQAINKSFGPFFEIHQESSCFS

SEQ ID NO: 835786 - protein, 130 aa, Homo sapiens; identical to SEQ ID NO: 835765

SEQ ID NO: 835787 - protein, 130 aa, Homo sapiens; identical to SEQ ID NO: 835765

SEQ ID NO: 835788 - protein, 130 aa, Homo sapiens; identical to SEQ ID NO: 835765

SEQ ID NO: 835789 - protein, 130 aa, Homo sapiens; identical to SEQ ID NO: 835765

SEQ ID NO: 835790 - protein, 130 aa, Homo sapiens; identical to SEQ ID NO: 835765

SEQ ID NO: 835791 - protein, 130 aa, Homo sapiens; identical to SEQ ID NO: 835765

SEQ ID NO: 835792 - protein, 130 aa, Homo sapiens; identical to SEQ ID NO: 835765

SEQ ID NO: 835793 - protein, 607 aa, Homo sapiens
MIARCLLAVRSLRRVGGSRILLRMTLGREVMSPLQAMSSYTVAGRNVLRWDLSPEQIKTRTEELIVQTKQVYDAVGMLGIEEVTYENCLQALADVEVKYIVERTMLDFPQHVSSDKEVRAASTEADKRLSRFDIEMSMRGDIFERIVHLQETCDLGKIKPEARRYLEKSIKMGKRNGLHLPEQVQNEIKSMKKRMSELCIDFNKNLNEDDTFLVFSKAELGALPDDFIDSLEKTDDDKYKITLKYPHYFPVMKKCCIPETRRRMEMAFNTRCKEENTIILQQLLPLRTKVAKLLGYSTHADFVLEMNTAKSTSRVTAFLDDLSQKLKPLGEAEREFILNLKKKECKDRGFEYDGKINAWDLYYYMTQTEELKYSIDQEFLKEYFPIEVVTEGLLNTYQELLGLSFEQMTDAHVWNKSVTLYTVKDKATGEVLGQFYLDLYPREGKYNHAACFGLQPGCLLPDGSRMMAVAALVVNFSQPVAGRPSLLRHDEVRTYFHEFGHVMHQICAQVSFFFPPVNLPISFFRKLLDCCQVSAPNRFFQKLNVFKNFIGLLQNQNFPYPVLFHNIFLLGGSSTSERCLLNNSLWKKNKTICKERLQILCFFLLIL

SEQ ID NO: 835794 - protein, 96 aa, Homo sapiens
ARPSLWSAMPVDRMMMVYTVPTEISGHRDIVLWILTIRKRLVQTVLCVTDPDATCVRVITGISELAGPSRARLSEPLDLSLTLFIVSLNSNSAADQ

SEQ ID NO: 835795 - protein, 704 aa, Homo sapiens
MIARCLLAVRSLRRVGGSRILLRMTLGREVMSPLQAMSSYTVAGRNVLRWDLSPEQIKTRTEELIVQTKQVYDAVGMLGIEEVTYENCLQALADVEVKYIVERTMLDFPQHVSSDKEVRAASTEADKRLSRFDIEMSMRGDIFERIVHLQETCDLGKIKPEARRYLEKSIKMGKRNGLHLPEQVQNEIKSMKKRMSELCIDFNKNLNEDDTFLVFSKAELGALPDDFIDSLEKTDDDKYKITLKYPHYFPVMKKCCIPETRRRMEMAFNTRCKEENTIILQQLLPLRTKVAKLLGYSTHADFVLEMNTAKSTSRVTAFLDDLSQKLKPLGEAEREFILNLKKKECKDRGFEYDGKINAWDLYYYMTQTEELKYSIDQEFLKEYFPIEVVTEGLLNTYQELLGLSFEQMTDAHVWNKSVTLYTVKDKATGEVLGQFYLDLYPREGKYNHAACFGLQPGCLLPDGSRMMAVAALVVNFSQPVAGRPSLLRHDEVRTYFHEFGHVMHQICAQTDFARFSGTNVETDFVEVPSQMLENWVWDVDSLRRLSKHYKDGSPIADDLLEKLVASRLVNTGLLTLRQIVLSKVDQSLHTNTSLDAASEYAKYCSEILGVAATPGTNMPATFGHLAGGYDGQYYGYLWSEVFSMDMFYSCFKKEGIMNPEVGMKYRNLILKPGGSLDGMDMLHNFLKREPNQKAFLMSRGLHAP

SEQ ID NO: 835796 - protein, 173 aa, Homo sapiens
MIARCLLAVRSLRRVGGSRILLRMTLGREVMSPLQAMSSYTVAGRNVLRWDLSPEQIKTRTEELIVQTKQVYDAVGMLGIEEVTYENCLQALADVEVKYIVERTMLDFPQHVSSDKEVRAASTEADKRLSRFDIEMSMRGDIFERIVHLQVSGVINPFKEGKTLQQKRTFSHK

SEQ ID NO: 835797 - protein, 704 aa, Homo sapiens; identical to SEQ ID NO: 835795

SEQ ID NO: 835798 - protein, 686 aa, Homo sapiens
MIARCLLAVRSLRRVGGSRILLRMTLGREVMSPLQAMSSYTVAGRNVLRWDLSPEQIKTRTEELIVQTKQVYDAVGMLGIEEVTYENCLQALADVEVKYIVERTMLDFPQHVSSDKEVRAASTEADKRLSRFDIEMSMRGDIFERIVHLQETCDLGKIKPEARRYLEKSIKMGKRNGLHLPEQVQNEIKSMKKRMSELCIDFNKNLNEDDTFLVFSKAELGALPDDFIDSLEKTDDDKYKITLKYPHYFPVMKKCCIPETRRRMEMAFNTRCKEENTIILQQLLPLRTKVAKLLGYSTHADFVLEMNTAKSTSRVTAFLDDLSQKLKPLGEAEREFILNLKKKECKDRGFEYDGKINAWDLYYYMTQTEELKYSIDQEFLKEYFPIEVVTEGLLNTYQELLGLSFEQMTDAHVWNKSVTLYTVKDKATGEVLGQFYLDLYPREGKYNHAACFGLQPGCLLPDGSRMMAVAALVVNFSQPVAGRPSLLRHDETDFARFSGTNVETDFVEVPSQMLENWVWDVDSLRRLSKHYKDGSPIADDLLEKLVASRLVNTGLLTLRQIVLSKVDQSLHTNTSLDAASEYAKYCSEILGVAATPGTNMPATFGHLAGGYDGQYYGYLWSEVFSMDMFYSCFKKEGIMNPEVGMKYRNLILKPGGSLDGMDMLHNFLKREPNQKAFLMSRGLHAP

SEQ ID NO: 835799 - protein, 144 aa, Homo sapiens
VPMLAASRVCACGPFPRRGTDSKSNTPELSRRGRPPARPWGRTGAPPAAAVDLAGLPSPGPLPAPPSQPLGAAAPLPRLWTPRLWGVSTGVVPLPAHRPGLSELERTSDLGRQRPAPPLLPPSTSMPSVHERGGGGQKSPVAYE

SEQ ID NO: 835800 - protein, 144 aa, Homo sapiens; identical to SEQ ID NO: 835799

SEQ ID NO: 835801 - protein, 152 aa, Homo sapiens
VPMLAASRVCACGPFPRRGTDSKSNTPELSRRGRPPARPWGRTGAPPAAAVDLAGLPSPGPLPAPPSQPLGAAAPLPRLWTPRLWGVSTGVVPLPAHRPGLSELERTSDLSVRHRCAIAAHLSLPAPMRPTMALCVALKLLCLAVLAQECPP

SEQ ID NO: 835802 - protein, 290 aa, Homo sapiens
MPQSRGNRWGGAQGGGGGAPRWGGPAGTSGSLAGVCAKAVLWEPLKVGQAGGRGKVTLGKEPAEAKPERQPDPGREPVIACLSSCQPVSLFGGIGLPGDRPVRLRARGHCSRDPVCVPRSYLHLFSICHVPVTSSLLPFPSCSSPSTGLRNCQAKVMELAHGPDALPQGSAPPRHCSENLRRRWWLLQGSIQRKGGKKRGRGCWRPAGLWLPGLGGCLGSWGAMWAGWGGCLPQGAGWLWWEQIVFTPSPHTQPTLASYSRGLSHPWALCAVCTFAAPAAESYLSQPRAP

SEQ ID NO: 835803 - protein, 290 aa, Homo sapiens; identical to SEQ ID NO: 835802

SEQ ID NO: 835804 - protein, 160 aa, Homo sapiens
MPESKVGDTCVWDSKVENQQKKPVENRMKEDKSSIREAISKAKSTANIKTEQEGEASEKSLHLSPQHITHQTMPIGQRGSEQGKRVENINGTSYPSLQQKTNAVKKLHKCDECGKSFKYNSRLVQHKIMHTGEKRYECDDCGGTFRSSSSLRVHKRIHTG

SEQ ID NO: 835805 - protein, 335 aa, Homo sapiens
DVCGKTFRNNAGLKVHRRLHTGEKPYKCDVCGKAYISRSSLKNHKGIHLGEKPYKCSYCEKSFNYSSALEQHKRIHTREKPFGCDECGKAFRNNSGLKVHKRIHTGERPYKCEECGKAYISLSSLINHKSVHPGEKPFKCDECEKAFITYRTLTNHKKVHLGEKPYKCDVCEKSFNYTSLLSQHRRVHTREKPYECDRCEKVFRNNSSLKVHKRIHTGERPYECDVCGKAYISHSSLINHKSTHPGRTPHTCDECGKAFFSSRTLISHKRVHLGEKPFKCVECGKSFSYSSLLSQHKRIHTGEKPYVCDRCGKAFRNSSGLTVHKRIHTVSDELP

SEQ ID NO: 835806 - protein, 449 aa, Homo sapiens
DVCGKTFRNNAGLKVHRRLHTGEKPYKCDVCGKAYISRSSLKNHKGIHLGEKPYKCSYCEKSFNYSSALEQHKRIHTREKPFGCDECGKAFRNNSGLKVHKRIHTGERPYKCEECGKAYISLSSLINHKSVHPGEKPFKCDECEKAFITYRTLTNHKKVHLGEKPYKCDVCEKSFNYTSLLSQHRRVHTREKPYECDRCEKVFRNNSSLKVHKRIHTGERPYECDVCGKAYISHSSLINHKSTHPGRTPHTCDECGKAFFSSRTLISHKRVHLGEKPFKCVECGKSFSYSSLLSQHKRIHTGEKPYVCDRCGKAFRNSSGLTVHKRIHTGEKPYECDECGKAYISHSSLINHKSVHQGKQPYNCECGKSFNYRSVLDQHKRIHTGKKPYRCNECGKAFNIRSNLTKHKRTHTGEESLNVIYVGSYSGTSQKRTYEGGNALDGGRMRMPL

SEQ ID NO: 835807 - protein, 449 aa, Homo sapiens; identical to SEQ ID NO: 835806

SEQ ID NO: 835808 - protein, 111 aa, Homo sapiens
DILRTLKTDSIFVGLKVKNRSALLEAAPPLNKNVGGRARWLTAVIPALWEAEAGGSRGQEIETSLANSETPSLPKIQKISRECWRAPVVPATWEAEAGERFNPGDGACREP

SEQ ID NO: 835809 - protein, 357 aa, Homo sapiens
RAARSNAHFLSRNPRRERRLEELLDAEALPLPDGADMSEQSKDLSDPNFAAEAPNSEVHSSPGVSEGVPPSATLAEPQSPPLGPTAAPQAAPPPQAPNDEGDPKALQQAAEEGRAHQAPSAAQPGPAPPAPAQLVQKAHELMWYVLVKDQKKMIIWFPDMVKDVIGSYKKWCRSILRRTSLILARVFGLHLRLTSLHTMEFALVKALEPEELDRVALSNRMPMTGLLLMILSLIYVKGRGARESAVWNVLRILGLRPWKKHSTFGDVRKLITEEFVQMNYLKYQRVPYVEPPEYEFFWGSRASREITKMQIMEFLARVFKKDPQAWPSRYREALEEARALREANPTAHYPRSSVSED

SEQ ID NO: 835810 - protein, 357 aa, Homo sapiens; identical to SEQ ID NO: 835809

SEQ ID NO: 835811 - protein, 357 aa, Homo sapiens; identical to SEQ ID NO: 835809

SEQ ID NO: 835812 - protein, 364 aa, Homo sapiens
RAARSNAHFLSRNPRRERRLEELLDAEALPLPDGADMSEQSKDLSDPNFAAEAPNSEVHSSPGVSEGVPPSATLAEPQSPPLGPTAAPQAAPPPQAPNDEGDPKALQQAAEEGRAHQAPSAAQPGPAPPAPAQLVQKAHELMWYVLVKDQKKMIIWFPDMVKDVIGSYKKWCRSILRRTSLILARVFGLHLRLTSLHTMEFALVKALEPEELDRVALSNRMPMTGLLLMILSLIYVKGRGARESAVWNVLRILGLRPWKKHSTFGDVRKLITEEFVQMNYLKYQRVPYVEPPEYEFFWGSRASREITKMQIMEFLARVFKKDPQAWPSRYREALEEARALREANPTAHYPRSSVSEEKKKNEKK

SEQ ID NO: 835813 - protein, 138 aa, Homo sapiens
RGGARRQHNSKGYRVMGSEFRGGARRQRDSKGYRDTGSEFRGGARRQHNSKGYRDMGSEFRGGPRRQRDSKGYRDTGIFEEENGIEGQGGSLTGSSPQTAHSTAAEPPGEVTAARLLDSERRGARRNHREKCHPNFEL

SEQ ID NO: 835814 - protein, 216 aa, Homo sapiens
MPKGKKAKGKKVAPAPAVVKKQEAKKVVNPLFEKRPKNFGIGQDIQPKRDLTRFVKWPRYIRLQRQRAILYKRLKVPPAINQFTQALDRQTATQLLKLAHKYRPETKQEKKQRLLARAEKKAAGKGDVPTKRPPVLRAGVNTVTTLVENKKAQLVVIAHDVDPIELVVFLPALCRKMGVPYCIIKGTGKTGTSSPQEDLHHCRLHTGELGRQRRFG

SEQ ID NO: 835815 - protein, 228 aa, Homo sapiens
NIRLGTRLGVIGRGKGKKAKGKKVAPAPAVVKKQEAKKVVNPLFEKRPKNFGIGQDIQPKRDLTRFVKWPRYIRLQRQRAILYKRLKVPPAINQFTQALDRQTATQLLKLAHKYRPETKQEKKQRLLARAEKKAAGKGDVPTKRPPVLRAGVNTVTTLVENKKAQLVVIAHDVDPIELVVFLPALCRKMGVPYCIIKGTGKTGTSSPQEDLHHCRLHTGELGRQRRFG

SEQ ID NO: 835816 - protein, 228 aa, Homo sapiens; identical to SEQ ID NO: 835815

SEQ ID NO: 835817 - protein, 216 aa, Homo sapiens; identical to SEQ ID NO: 835814

SEQ ID NO: 835818 - protein, 216 aa, Homo sapiens; identical to SEQ ID NO: 835814

SEQ ID NO: 835819 - protein, 216 aa, Homo sapiens; identical to SEQ ID NO: 835814

SEQ ID NO: 835820 - protein, 228 aa, Homo sapiens; identical to SEQ ID NO: 835815

SEQ ID NO: 835821 - protein, 216 aa, Homo sapiens; identical to SEQ ID NO: 835814

SEQ ID NO: 835822 - protein, 122 aa, Homo sapiens
NQRGIRAPIANAGGDIRSTYLTLLTFRSVTNHPLNSKHRHDLCISKLDLYQKPLNMFWFEGIGMIKRPDIPYFSWPKRHEPGKLSRVRNPRDTCGSRSEMHLLVLPLQDPTHQFLACPSGEN

SEQ ID NO: 835823 - protein, 112 aa, Homo sapiens
VFDGTGANAIISCYNDENADFPVTCAAPQPPLQTQTPGTWLRKAIDPPPKPPKFFWQPLDKTRVGIQEFLAQKARSRQCSQRRGHLRLQVRDAPASPASTGPNPSVPSLSFW

SEQ ID NO: 835824 - protein, 122 aa, Homo sapiens; identical to SEQ ID NO: 835822

SEQ ID NO: 835825 - protein, 73 aa, Homo sapiens
RMRRIAAIRANHYRSPSTLTRPFIVSHYTSLQPPCSFTLHPLLDPSLSSIAPSCSHHHMGRLFFLAPHRIYSP

SEQ ID NO: 835826 - protein, 122 aa, Homo sapiens; identical to SEQ ID NO: 835822

SEQ ID NO: 835827 - protein, 950 aa, Homo sapiens
PRLAPRARDCAPGPAPGLPPAPTGRSAARGSAGSMGKAAAPSRGGGCGGRSRGLSSLFTVVPCLSCHTAAPGMSASTSGSGPEPKPQPQPVPEPERGPLSEQVSEAVSEAVPRSEPVSETTSEPEPGAGQPSELLQGSRPGSESSSGVGAGPFTKAASEPLSRAVGSATFLRPESGSLPALKPLPLLRPGQAKTPLGVPMSGTGTTSSAPLALLPLDSFEGWLLKWTNYLKGYQRRWFVLGNGLLSYYRNQGEMAHTCRGTINLSTAHIDTEDSCGILLTSGARSYHLKASSEVDRQQWITALELAKAKAVRVMNTHSDDSGDDDEATTPADKSELHHTLKNLSLKLDDLSTCNDLIAKHGAALQRSLTELDGLKIPSESGEKLKVVNERATLFRITSNAMINACRDFLELAEIHSRKWQRALQYEQEQRVHLEETIEQLAKQHNSLERAFHSAPGRPANPSKSFIEGSLLTPKGEDSEEDEDTEYFDAMEDSTSFITVITEAKEDSRKAEGSTGTSSVDWSSADNVLDGASLVPKGSSKVKRRVRIPNKPNYSLNLWSIMKNCIGRELSRIPMPVNFNEPLSMLQRLTEDLEYHHLLDKAVHCTSSVEQMCLVAAFSVSSYSTTVHRIAKPFNPMLGETFELDRLDDMGLRSLCEQVSHHPPSAAHYVFSKHGWSLWQEITISSKFRGKYISIMPLGAIHLEFQASGNHYVWRKSTSTVHNIIVGKLWIDQSGDIEIVNHKTNDRCQLKFLPYSYFSKEAARKVTGVVSDSQGKAHYVLSGSWDEQMECSKVMHSSPSSPSSDGKQKTVYQTLSAKLLWKKYPLPENAENMYYFSELALTLNEHEEGVAPTDSRLRPDQRLMEKGRWDEANTEKQRLEEKQRLSRRRRLEACGPGSSCSSEEEKEADAYTPLWFEKRLDPLTGEMACVYKGGYWEAKEKQDWHMCPNIF

SEQ ID NO: 835828 - protein, 853 aa, Homo sapiens
PRLAPRARDCAPGPAPGLPPAPTGRSAARGSAGSMGKAAAPSRGGGCGGRSRGLSSLFTVVPCLSCHTAAPGMSASTSGSGPEPKPQPQPVPEPERGPLSEQVSEAVSEAVPRSEPVSETTSEPEPGAGQPSELLQGSRPGSESSSGVGAGPFTKAASEPLSRAVGSATFLRPESGSLPALKPLPLLRPGQAKTPLGVPMSGTGTTSSAPLALLPLDSFEGWLLKWTNYLKGYQRRWFVLGNGLLSYYRNQGEMAHTCRGTINLSTAHIDTEDSCGILLTSGARSYHLKASSEVDRQQWITALELAKAKAVRVMNTHSDDSGDDDEATTPADKSELHHTLKNLSLKLDDLSTCNDLIAKHGAALQRSLTELDGLKIPSESGEKLKVVNERATLFRITSNAMINACRDFLELAEIHSRKWQRALQYEQEQRVHLEETIEQLAKQHNSLERAFHSAPGRPANPSKSFIEGSLLTPKGEDSEEDEDTEYFDAMEDSTSFITVITEAKEDSRKAEGSTGTSSVDWSSADNVLDGASLVPKGSSKVKRRVRIPNKPNYSLNLWSIMKNCIGRELSRIPMPVNFNEPLSMLQRLTEDLEYHHLLDKAVHCTSSVEQMCLVAAFSVSSYSTTVHRIAKPFNPMLGETFELDRLDDMGLRSLCEQVSHHPPSAAHYVFSKHGWSLWQEITISSKFRGKYISIMPLGAIHLEFQASGNHYVWRKSTSTVHNIIVGKLWIDQSGDIEIVNHKTNDRCQLKFLPYSYFSKEAARKGERGEHVLLLRAGPDPQRARGGRSANRQPPAARPAADGEGPLGRGQYREAAAGGEAAPVAAPAAGGLRAGQQLQLGGREGGGCLHATVV

SEQ ID NO: 835829 - protein, 486 aa, Homo sapiens
SRATPGACLSPQHSQDGAWRRPAAAEETLGVRDGHQACRDFLELAEIHSRKWQRALQYEQEQRVHLEETIEQLAKQHNSLERAFHSAPGRPANPSKSFIEGSLLTPKGEDSEEDEDTEYFDAMEDSTSFITVITEAKEDSRKAEGSTGTSSVDWSSADNVLDGASLVPKGSSKVKRRVRIPNKPNYSLNLWSIMKNCIGRELSRIPMPVNFNEPLSMLQRLTEDLEYHHLLDKAVHCTSSVEQMCLVAAFSVSSYSTTVHRIAKPFNPMLGETFELDRLDDMGLRSLCEQVSHHPPSAAHYVFSKHGWSLWQEITISSKFRGKYISIMPLGAIHLEFQASGNHYVWRKSTSTVHNIIVGKLWIDQSGDIEIVNHKTNDRCQLKFLPYSYFSKEAARKGERGEHVLLLRAGPDPQRARGGRSANRQPPAARPAADGEGPLGRGQYREAAAGGEAAPVAAPAAGGLRAGQQLQLGGREGGGCLHATVV

SEQ ID NO: 835830 - protein, 556 aa, Homo sapiens
MIVRSPQPRGALEELPLTSLMDDSGDDDEATTPADKSELHHTLKNLSLKLDDLSTCNDLIAKHGAALQRSLTELDGLKIPSESGEKLKVVNERATLFRITSNAMINACRDFLELAEIHSRKWQRALQYEQEQRVHLEETIEQLAKQHNSLERAFHSAPGRPANPSKSFIEGSLLTPKGEDSEEDEDTEYFDAMEDSTSFITVITEAKEDSRKAEGSTGTSSVDWSSADNVLDGASLVPKGSSKVKRRVRIPNKPNYSLNLWSIMKNCIGRELSRIPMPVNFNEPLSMLQRLTEDLEYHHLLDKAVHCTSSVEQMCLVAAFSVSSYSTTVHRIAKPFNPMLGETFELDRLDDMGLRSLCEQVSHHPPSAAHYVFSKHGWSLWQEITISSKFRGKYISIMPLGAIHLEFQASGNHYVWRKSTSTVHNIIVGKLWIDQSGDIEIVNHKTNDRCQLKFLPYSYFSKEAARKGERGEHVLLLRAGPDPQRARGGRSANRQPPAARPAADGEGPLGRGQYREAAAGGEAAPVAAPAAGGLRAGQQLQLGGREGGGCLHATVV

SEQ ID NO: 835831 - protein, 959 aa, Homo sapiens
PRLAPRARDCAPGPAPGLPPAPTGRSAARGSAGSMGKAAAPSRGGGCGGRSRGLSSLFTVVPCLSCHTAAPGMSASTSGSGPEPKPQPQPVPEPERGPLSEQVSEAVSEAVPRSEPVSETTSEPEPGAGQPSELLQGSRPGSESSSGVGAGPFTKAASEPLSRAVGSATFLRPESGSLPALKPLPLLRPGQAKTPLGVPMSGTGTTSSAPLALLPLDSFEGWLLKWTNYLKGYQRRWFVLGNGLLSYYRNQGEMAHTCRGTINLSTAHIDTEDSCGILLTSGARSYHLKASSEVDRQQWITALELAKAKAVRVMNTHSDDSGDDDEATTPADKSELHHTLKNLSLKLDDLSTCNDLIAKHGAALQRSLTELDGLKIPSESGEKLKVVNERATLFRITSNAMINACRDFLELAEIHSRKWQRALQYEQEQRVHLEETIEQLAKQHNSLERAFHSAPGRPANPSKSFIEGSLLTPKGEDSEEDEDTEYFDAMEDSTSFITVITEAKEDSRKAEGSTGTSSVDWSSADNVLDGASLVPKGSSKVKRRVRIPNKPNYSLNLWSIMKNCIGRELSRIPMPVNFNEPLSMLQRLTEDLEYHHLLDKAVHCTSSVEQMCLVAAFSVSSYSTTVHRIAKPFNPMLGETFELDRSTTWACAPSVSSLWQEITISSKFRGKYISIMPLGAIHLEFQASGNHYVWRKSTSTVHNIIVGKLWIDQSGDIEIVNHKTNDRCQLKFLPYSYFSKEAARKDKQDQPPLSTPGGPGQSLHLRWSCQCPQVTGVVSDSQGKAHYVLSGSWDEQMECSKVMHSSPSSPSSDGKQKTVYQTLSAKLLWKKYPLPENAENMYYFSELALTLNEHEEGVAPTDSRLRPDQRLMEKGRWDEANTEKQRLEEKQRLSRRRRLEACGPGSSCSSEEEKEADAYTPLWFEKRLDPLTGEMACVYKGGYWEAKEKQDWHMCPNIF

SEQ ID NO: 835832 - protein, 102 aa, Homo sapiens
MRPRSGLGWVSQALPGPLGTSPCQSLCRAPSLIQLIKHTAHSPAQHSENSRATPGACLSPQHSQDGAWRRPAAAEETLGVRDGHQVGASGLGEVDGLSASMG

SEQ ID NO: 835833 - protein, 111 aa, Homo sapiens
DIIMRLYFPVPPRSHCRRLPRHCLPTRDQNCFVLNKQFWLFRDNERLSWLPSCTVFYQTSEAHLCLRSHQNSSKFKCLMNCFMRNTTPWGWSRFLSAAPASGEHGGRVSPE

SEQ ID NO: 835834 - protein, 163 aa, Homo sapiens
TCPLPPGAIHLEFQASGNHYVWRKSTSTVHNIIVGKLWIDQSGDIEIVNHKTNDRCQLKFLPYSYFSKEAARKVKQDQPPLSTPGGPGQSLHLRWSCQCPQVTGVVSDSQGKAHYVLSGSWDEQMECSKVMHSSPSSPSSDGKQKTVYQTLSAKLLWKKYPLP

SEQ ID NO: 835835 - protein, 561 aa, Homo sapiens
AAAAAAARALAASGQDPRPHPRAPPWDDSGDDDEATTPADKSELHHTLKNLSLKLDDLSTCNDLIAKHGAALQRSLTELDGLKIPSESGEKLKVVNERATLFRITSNAMINACRDFLELAEIHSRKWQRALQYEQEQRVHLEETIEQLAKQHNSLERAFHSAPGRPANPSKSFIEGSLLTPKGEDSEEDEDTEYFDAMEDSTSFITVITEAKEDSRKAEGSTGTSSVDWSSADNVLDGASLVPKGSSKVKRRVRIPNKPNYSLNLWSIMKNCIGRELSRIPMPVNFNEPLSMLQRLTEDLEYHHLLDKAVHCTSSVEQMCLVAAFSVSSYSTTVHRIAKPFNPMLGETFELDRLDDMGLRSLCEQVSHHPPSAAHYVFSKHGWSLWQEITISSKFRGKYISIMPLGAIHLEFQASGNHYVWRKSTSTVHNIIVGKLWIDQSGDIEIVNHKTNDRCQLKFLPYSYFSKEAARKGERGEHVLLLRAGPDPQRARGGRSANRQPPAARPAADGEGPLGRGQYREAAAGGEAAPVAAPAAGGLRAGQQLQLGGREGGGCLHATVV

SEQ ID NO: 835836 - protein, 950 aa, Homo sapiens; identical to SEQ ID NO: 835827

SEQ ID NO: 835837 - protein, 425 aa, Homo sapiens
PRLAPRARDCAPGPAPGLPPAPTGRSAARGSAGSMGKAAAPSRGGGCGGRSRGLSSLFTVVPCLSCHTAAPGMSASTSGSGPEPKPQPQPVPEPERGPLSEQVSEAVSEAVPRSEPVSETTSEPEPGAGQPSELLQGSRPGSESSSGVGAGPFTKAASEPLSRAVGSATFLRPESGSLPALKPLPLLRPGQAKTPLGVPMSGTGTTSSAPLALLPLDSFEGWLLKWTNYLKGYQRRWFVLGNGLLSYYRNQGEMAHTCRGTINLSTAHIDTEDSCGILLTSGARSYHLKASSEVDRQQWITALELAKAKAVRVMNTHSDDSGDDDEATTPADKSELHHTLKNLSLKLDDLSTCNDLIAKHGAALQRSLTELDGLKIPSESGEKLKVVNERATLFRITSNAMINKPLPEASQALPPYPRPKLLCLE

SEQ ID NO: 835838 - protein, 74 aa, Homo sapiens
MKFQECHSEVMRHGQKIYPSHHRIEMAVEIASLKCQHSSINQSPTRKNSNSTTGWLLWDLLMGIGNSGSNVVLT

SEQ ID NO: 835839 - protein, 74 aa, Homo sapiens; identical to SEQ ID NO: 835838

SEQ ID NO: 835840 - protein, 499 aa, Homo sapiens
DREDVYKFFCGIRGHAYYNQKTTSITARMDEQALLGLNPNADSDFRQRALAYFEQLKISPDAWQVCAEALAQRTYSDDHVKFFCFQVLEHQVKYKYSELTTVQQQLIRETLISWLQAQMLNPQPEKTFIRNKAAQVFALLFVTEYLTKWPKFFFDILSVVDLNPRGVDLYLRILMAIDSELVDRDVVHTSEEARRNTLIKDTMREQCIPNLVESWYQILQNYQFTNSEVTCQCLEVVGAYVSWIDLSLIANDRFINMLLGHMSIEVLREEACDCLFEVVNKGMDPVDKMKLVESLCQVLQSAGFFSIDQEEDVDFLARFSKLVNGMGQSLIVSWSKLIKNGDIKNAQEALQAIETKVALMLQLLIHEDDDISSNIIGFCYDYLHILKQLTVLSDQQKANVEAIMLAVMKKLTYDEEYNFENEGEDEAMFVEYRKQLKLLLDRLAQVSPELLLASVRRVFSSTLQNWQTTRFMEVEVAIRLLYMLAEALPVSHGAHFSVW

SEQ ID NO: 835841 - protein, 972 aa, Homo sapiens
DREDVYKFFCGIRGHAYYNQKTTSITARMDEQALLGLNPNADSDFRQRALAYFEQLKISPDAWQVCAEALAQRTYSDDHVKFFCFQVLEHQVKYKYSELTTVQQQLIRETLISWLQAQMLNPQPEKTFIRNKAAQVFALLFVTEYLTKWPKFFFDILSVVDLNPRGVDLYLRILMAIDSELVDRDVVHTSEEARRNTLIKDTMREQCIPNLVESWYQILQNYQFTNSEVTCQCLEVVGAYVSWIDLSLIANDRFINMLLGHMSIEVLREEACDCLFEVVNKGMDPVDKMKLVESLCQVLQSAGFFSIDQEEDVDFLARFSKLVNGMGQSLIVSWSKLIKNGDIKNAQEALQAIETKVALMLQLLIHEDDDISSNIIGFCYDYLHILKQLTVLSDQQKANVEAIMLAVMKKLTYDEEYNFENEGEDEAMFVEYRKQLKLLLDRLAQVSPELLLASVRRVFSSTLQNWQTTRFMEVEVAIRLLYMLAEALPVSHGAHFSGDVSKASALQDMMRTLVTSGVSSYQHTSVTLEFFETVVRYEKFFTVEPQHIPCVLMAFLDHRGLRHSSAKQMNPFIEDILNRIQDLLELSPPENGHQSLLSSDDQLFIYETAGVLIVNSEYPAERKQALMRNLLTPLMEKFKILLEKLMLAQDEERQASLADCLNHAVGFASRTSKAFSNKQTVKQCGCSEVYLDCLQTFLPALSCPLQKDILRSGVRTFLHRMIICLEEEVLPFIPSASEHMLKDCEAKDLQEFIPLINQITAKFKIQVSPFLQQMFMPLLHAIFEVLLRPAEENDQSAALEKQMLRRSYFAFLQTVTGSGMSEVIANQGAENVERVLVTVIQGAVEYPDPIAQKTCFIILSKLVELWGGKDGPVGFADFVYKHIVPACFLAPLKQTFDLADAQTVLALSECAVTLKTIHLKRGPECVQYLQQEYLPSLQVAPEIIQEFCQALQQPDAKVFKNYLKVFFQRAKP

SEQ ID NO: 835842 - protein, 990 aa, Homo sapiens
DREDVYKFFCGIRGHAYYNQKTTSITARMDEQALLGLNPNADSDFRQRALAYFEQLKISPDAWQVCAEALAQRTYSDDHVKFFCFQVLEHQVKYKYSELTTVQQQLIRETLISWLQAQMLNPQPEKTFIRNKAAQVFALLFVTEYLTKWPKFFFDILSVVDLNPRGVDLYLRILMAIDSELVDRDVVHTSEEARRNTLIKDTMREQCIPNLVESWYQILQNYQFTNSEVTCQCLEVVGAYVSWIDLSLIANDRFINMLLGHMSIEVLREEACDCLFEVVNKGMDPVDKMKLVESLCQVLQSAGFFSIDQEEDVDFLARFSKLVNGMGQSLIVSWSKLIKNGDIKNAQEALQAIETKVALMLQLLIHEDDDISSNIIGFCYDYLHILKQLTVLSDQQKANVEAIMLAVMKKLTYDEEYNFENEGEDEAMFVEYRKQLKLLLDRLAQVSPELLLASVRRVFSSTLQNWQTTRFMEVEVAIRLLYMLAEALPVSHGAHFSGDVSKASALQDMMRTLVTSGVSSYQHTSVTLEFFETVVRYEKFFTVEPQHIPCVLMAFLDHRGLRHSSAKVRSRTAYLFSRFVKSLNKQMNPFIEDILNRIQDLLELSPPENGHQSLLSSDDQLFIYETAGVLIVNSEYPAERKQALMRNLLTPLMEKFKILLEKLMLAQDEERQASLADCLNHAVGFASRTSKAFSNKQTVKQCGCSEVYLDCLQTFLPALSCPLQKDILRSGVRTFLHRMIICLEEEVLPFIPSASEHMLKDCEAKDLQEFIPLINQITAKFKIQVSPFLQQMFMPLLHAIFEVLLRPAEENDQSAALEKQMLRRSYFAFLQTVTGSGMSEVIANQGAENVERVLVTVIQGAVEYPDPIAQKTCFIILSKLVELWGGKDGPVGFADFVYKHIVPACFLAPLKQTFDLADAQTVLALSECAVTLKTIHLKRGPECVQYLQQEYLPSLQVAPEIIQEFCQALQQPDAKVFKNYLKVFFQRAKP

SEQ ID NO: 835843 - protein, 420 aa, Homo sapiens
DREDVYKFFCGIRGHAYYNQKTTSITARMDEQALLGLNPNADSDFRQRALAYFEQLKISPDAWQVCAEALAQRTYSDDHVKFFCFQVLEHQVKYKYSELTTVQQQLIRETLISWLQAQMLNPQPEKTFIRNKAAQVFALLFVTEYLTKWPKFFFDILSVVDLNPRGVDLYLRILMAIDSELVDRDVVHTSEEARRNTLIKDTMREQCIPNLVESWYQILQNYQFTNSEVTCQCLEVVGAYVSWIDLSLIANDRFINMLLGHMSIEVLREEACDCLFEVVNKGMDPVDKMKLVESLCQVLQSAGFFSIDQEEDVDFLARFSKLVNGMGQSLIVSWSKLIKNGDIKNAQEALQAIETKVALMLQLLIHEDDDISSNIIGFCYDYLHILKQVSFCFILFAQYIIQRSHGEVENMEKLKMRKYP

SEQ ID NO: 835844 - protein, 541 aa, Homo sapiens
NSARGTAGPASGPGVVRDPAASQPRKRPGREGGEGARRSDTMAGGGGSSDGSGRAAGRRASRSSGRARRGRHEPGLGGPAERGAGEARLEEAVNRWVLKFYFHEALRAFRGSRYGDFRQIRDIMQALLVRPLGKEHTVSRLLRVMQCLSRIEEGENLDCSFDMEAELTPLESAINVLEMIKTEFTLTEAVVESSRKLVKEAAVIICIKNKEFEKASKILKKHMSKDPTTQKLRNDLLNIIREKNLAHPVIQNFSYETFQQKMLRFLESHLDDAEPYLLTMAKKALKSESAASSTGKEDKQPAPGPVEKPPREPARQLRNPPTTIGMMTLKAAFKTLSGAQDSEAAFAKLDQKDLVLPTQALPASPALKNKRPRKDENESSAPADGEGGSELQPKNKRMTISRLVLEEDSQSTEPSAGLNSSQEAASAPPSKPTVLNQPLPGEKNPKVPKGKWNSSNGVEEKETWVEEDELFQVQAAPDEDSTTNITKKQKWTVEESEWVKAGVQKYGEGNWAAISKNYPFVNRTAVMIKDRWRTMKRLGMN

SEQ ID NO: 835845 - protein, 541 aa, Homo sapiens; identical to SEQ ID NO: 835844

SEQ ID NO: 835846 - protein, 360 aa, Homo sapiens
RLFDQGWQWSNPVESWSREAAVIICIKNKEFEKASKILKKHMSKDPTTQKLRNDLLNIIREKNLAHPVIQNFSYETFQQKMLRFLESHLDDAEPYLLTMAKKALKSESAASSTGKEDKQPAPGPVEKPPREPARQLRNPPTTIGMMTLKAAFKTLSGAQDSEAAFAKLDQKDLVLPTQALPASPALKNKRPRKDENESSAPADGEGGSELQPKNKRMTISRLVLEEDSQSTEPSAGLNSSQEAASAPPSKPTVLNQPLPGEKNPKVPKGKWNSSNGVEEKETWVEEDELFQVQAAPDEDSTTNITKKQKWTVEESEWVKAGVQKYGEGNWAAISKNYPFVNRTAVMIKDRWRTMKRLGMN

SEQ ID NO: 835847 - protein, 435 aa, Homo sapiens
MEEDDSYVPSDLTAEERQELENIRRRKQELLADIQRLKDEIAEVANEIENLGSTEEKAVIICIKNKEFEKASKILKKHMSKDPTTQKLRNDLLNIIREKNLAHPVIQNFSYETFQQKMLRFLESHLDDAEPYLLTIGFVSELVCILSIFLVKEAENYMQFCGLFFLMTSFLSQMAKKALKSESAASSTGKEDKQPAPGPVEKPPREPARQLRNPPTTIGMMTLKAAFKTLSGAQDSEAAFAKLDQKDLVLPTQALPASPALKNKRPRKDENESSAPADGEGGSELQPKNKRMTISRLVLEEDSQSTEPSAGLNSSQEAASAPPSKPTVLNQPLPGEKNPKVPKGKWNSSNGVEEKETWVEEDELFQVQAAPDEDSTTNITKKQKWTVEESEWVKAGVQKYGEGNWAAISKNYPFVNRTAVMIKDRWRTMKRLGMN

SEQ ID NO: 835848 - protein, 454 aa, Homo sapiens
MAGGGGSSDGSGRAAGRRASRSSGRARRGRHEPGLGGPAERGAGEARLEEAVNRWVLKFYFHEALRAFRGSRYGDFRQIRDIMQALLVRPLGKEHTVSRLLRVMQCLSRIEEGENLDCSFDMEAELTPLESAINVLEMIKTEFTLTEAVVESSRKLVKEAAVIICIKNKEFEKASKILKKHMSKDPTTQKLRNDLLNIIREKNLAHPVIQNFSYETFQQKMLRFLESHLDDAEPYLLTMAKKALKSESAASSTGKEDKQPAPGPVEKPPREPARQLRNPPTTIGMMTLKAAFKTLSGAQDSEAAFAKLDQKDLVLPTQALPASPALKNKRPRKDENESSAPADGEGGSELQPKNKRMTISRLVLEEDSQSTEPSAGLNSSQEAASAPPSKPTVLNQPLPGEKNPKVPKGKWNSSNGVEEKETWVEEDELFQVQGKQKILLGLFLMLAEVQMRVT

SEQ ID NO: 835849 - protein, 115 aa, Homo sapiens
FSYEAFQQKILRFLESHLDDAEPYLLTAVIICIKNKEFEKASKILKKHMSKDPTTQKLRNDLLNIIREKNLAHPVIQNFSYETFQQKMLRFLESHLDDAEPYLLTLSLFVSKTKN

SEQ ID NO: 835850 - protein, 529 aa, Homo sapiens
GIRHEGRRAPLPARASCVTQRRHSRGSGPAGRAGRARGDRTRWREEAGVATAAGGQLAGGRPAVAGGPGGGATSRGWGARRSAARGRHGWKRQSIAGCSSSTSTRRCGPFGVAALLVRPLGKEHTVSRLLRVMQCLSRIEEGENLDCSFDMEAELTPLESAINVLEMIKTEFTLTEAVVESSRKLVKEAAVIICIKNKEFEKASKILKKHMSKDPTTQKLRNDLLNIIREKNLAHPVIQNFSYETFQQKMLRFLESHLDDAEPYLLTMAKKALKSESAASSTGKEDKQPAPGPVEKPPREPARQLRNPPTTIGMMTLKAAFKTLSGAQDSEAAFAKLDQKDLVLPTQALPASPALKNKRPRKDENESSAPADGEGGSELQPKNKRMTISRLVLEEDSQSTEPSAGLNSSQEAASAPPSKPTVLNQPLPGEKNPKVPKGKWNSSNGVEEKETWVEEDELFQVQAAPDEDSTTNITKKQKWTVEESEWVKAGVQKYGEGNWAAISKNYPFVNRTAVMIKDRWRTMKRLGMN

SEQ ID NO: 835851 - protein, 428 aa, Homo sapiens
MAGGGGSSDGSGRAAGRRASRSSGRARRGRHEPGLGGPAERGAGEARLEEAVNRWVLKFYFHEALRAFRGSRYGDFRQIRDIMQALLVRPLGKEHTVSRLLRVMQCLSRIEEGENLDCSFDMEAELTPLESAINVLEMIKTEFTLTEAVVESSRKLVKEAAVIICIKNKEFEKASKILKKHMSKDPTTQKLRNDLLNIIREKNLAHPVIQNFSYETFQQKMLRFLESHLDDAEPYLLTMAKKALKSESAASSTGKEDKQPAPGPVEKPPREPARQLRNPPTTIGMMTLKAAFKTLSGAQDSEAAFAKLDQKDLVLPTQALPASPALKNKRPRKDENESSAPADGEGGSELQPKNKRMTISRLVLEEDSQSTEPSAGLNSSQEAASAPPSKPTVLNQPLPGEKNPKYEDLLCRNFGAGWWSWLGLVLLP

SEQ ID NO: 835852 - protein, 38 aa, Homo sapiens
MGSTTRAHDQGFMRVRVKRPPNRICVSNMAVYFTWVQA

SEQ ID NO: 835853 - protein, 725 aa, Homo sapiens
MAKGFYISKSLGILGILLGVAAVCTIIALSVVYSQEKNKNANSSPVASTTPSASATTNPASATTLDQSKAWNRYRLPNTLKPDSYRVTLRPYLTPNDRGLYVFKGSSTVRFTCKEATDVIIIHSKKLNYTLSQGHRVVLRGVGGSQPPDIDKTELVEPTEYLVVHLKGSLVKDSQYEMDSEFEGELADDLAGFYRSEYMEGNVRKVVATTQMQAADARKSFPCFDEPAMKAEFNITLIHPKDLTALSNMLPKGPSTPLPEDPNWNVTEFHTTPKMSTYLLAFIVSEFDYVEKQASNGVLIRIWARPSAIAAGHGDYALNVTGPILNFFAGHYDTPYPIPKSDQIGLPDFNAGAMENWGLVTYRENSLLFDPLSSSSSNKERVVTVIAHELAHQWFGNLVTIEWWNDLWLNEGFASYVEYLGADYAEPTWNLKDLMVLNDVYRVMAVDALASSHPLSTPASEINTPAQISELFDAISYSKGASVLRMLSSFLSEDVFKQGLASYLHTFAYQNNIYLNLWDHLQEAVNNRSINFPHTVRDIMNRWTLQMGFLVITVGYQHGGTLYPGKNFLLGTRIPMVPGPQIQYVWIVPIKSIRDGRQTAGLWGGKWEKPNGPSGIRQSGAQRNHNVMRQSRGANTRNCYNTHWPEQEHCAPRCIGETKIELTTEPDTVLQVHTTTCRKDTQQQRQRLAAHVHSQTASYCIAAVARYDRIYAELSDERSKTARAE

SEQ ID NO: 835854 - protein, 725 aa, Homo sapiens; identical to SEQ ID NO: 835853

SEQ ID NO: 835855 - protein, 707 aa, Homo sapiens
MAKGFYISKSLGILGILLGVAAVCTIIALSVVYSQEKNKNANSSPVASTTPSASATTNPASATTLDQSKAWNRYRLPNTLKPDSYRVTLRPYLTPNDRGLYVFKGSSTVRFTCKEATDVIIIHSKKLNYTLSQGHRVVLRGVGGSQPPDIDKTELVEPTEYLVVHLKGSLVKDSQYEMDSEFEGELADDLAGFYRSEYMEGNVRKVVATTQMQAADARKSFPCFDEPAMKAEFNITLIHPKDLTALSNMLPKGPSTPLPEDPNWNVMEFDYVEKQASNGVLIRIWARPSAIAAGHGDYALNVTGPILNFFAGHYDTPYPIPKSDQIGLPDFNAGAMENWGLVTYRENSLLFDPLSSSSSNKERVVTVIAHELAHQWFGNLVTIEWWNDLWLNEGFASYVEYLGADYAEPTWNLKDLMVLNDVYRVMAVDALASSHPLSTPASEINTPAQISELFDAISYSKGASVLRMLSSFLSEDVFKQGLASYLHTFAYQNNIYLNLWDHLQEAVNNRSINFPHTVRDIMNRWTLQMGFLVITVGYQHGGTLYPGKNFLLGTRIPMVPGPQIQYVWIVPIKSIRDGRQTAGLWGGKWEKPNGPSGIRQSGAQRNHNVMRQSRGANTRNCYNTHWPEQEHCAPRCIGETKIELTTEPDDSLQVHTTTCRKDTQQQRQRLAAHVHSQTASYCIAAVARYDRIYAELSDERSKTARAE

SEQ ID NO: 835856 - protein, 135 aa, Homo sapiens
DIDKTELVEPTEYLVVHLKGSLVKDSQYEMDSEFEGELADDLAGFYRSEYMEGNVRKLSSGWAARWGGSEVLRQGWILRAKEGLSLQAFEPCGARDWPIASPPAAGKAAANAPNWEGFPTPHQGAGDEGQSVPWT

SEQ ID NO: 835857 - protein, 535 aa, Homo sapiens
MAKGFYISKSLGILGILLGVAAVCTIIALSVVYSQEKNKNANSSPVASTTPSASATTNPASATTLDQSKAWNRYRLPNTLKPDSYRVTLRPYLTPNDRGLYVFKGSSTVRFTCKEATDVIIIHSKKLNYTLSQGHRVVLRGVGGSQPPDIDKTELVEPTEYLVVHLKGSLVKDSQYEMDSEFEGELADDLAGFYRSEYMEGNVRKVVATTQMQAADARKSFPCFDEPAMKAEFNITLIHPKDLTALSNMLPKGPSTPLPEDPNWNVTEFHTTPKMSTYLLAFIVSEFDYVEKQASNGVLIRIWARPSAIAAGHGDYALNVTGPILNFFAGHYDTPYPIPKSDQIGLPDFNAGAMENWGLVTYRENSLLFDPLSSSSSNKERVVTVIAHELAHQWFGNLVTIEWWNDLWLNEGFASYVEYLGADYAEPTWNLKDLMVLNDVYRVMAVDALASSHPLSTPASEINTPAQISELFDAISYSKGASVLRMLSSFLSEDVFKQGLASYLHTFAYQNNIYLNLWDHLGGQHHLGASHHLGA

SEQ ID NO: 835858 - protein, 521 aa, Homo sapiens
MAKGFYISKSLGILGILLGVAAVCTIIALSVVYSQEKNKNANSSPVASSPSTPLPEDPNWNVTEFHTTPKMSTYLLAFIVSEFDYVEKQASNGVLIRIWARPSAIAAGHGDYALNVTGPILNFFAGHYDTPYPIPKSDQIGLPDFNAGAMENWGLVTYRENSLLFDPLSSSSSNKERVVTVIAHELAHQWFGNLVTIEWWNDLWLNEGFASYVEYLGADYAEPTWNLKDLMVLNDVYRVMAVDALASSHPLSTPASEINTPAQISELFDAISYSKGASVLRMLSSFLSEDVFKQGLASYLHTFAYQNNIYLNLWDHLQEAVNNRSINFPHTVRDIMNRWTLQMGFLVITVGYQHGGTLYPGKNFLLGTRIPMVPGPQIQYVWIVPIKSIRDGRQTAGLWGGKWEKPNGPSGIRQSGAQRNHNVMRQSRGANTRNCYNTHWPEQEHCAPRCIGETKIELTTEPDTVLQVHTTTCRKDTQQQRQRLAAHVHSQTASYCIAAVARYDRIYAELSDERSKTARAE

SEQ ID NO: 835859 - protein, 1251 aa, Homo sapiens
MSTERDSETTFDEDSQPNDEVVPYSDDETEDELDDQGSAVEPEQNRVNREAEENREPFRKECTWQVKANDRKYHEQPHFMNTKFLCIKESKYANNAIKTYKYNAFTFIPMNLFEQFKRAANLYFLALLILQAVPQISTLAWYTTLVPLLVVLGVTAIKDLVDDVARHKMDKEINNRTCEVIKDGRFKVAKWKEIQVGDVIRLKKNDFVPADILLLSSSEPNSLCYVETAELDGETNLKFKMSLEITDQYLQREDTLATFDGFIECEEPNNRLDKFTGTLFWRNTSFPLDADKILLRGCVIRNTDFCHGLVIFAGADTKIMKNSGKTRFKRTKIDYLMNYMVYTIFVVLILLSAGLAIGHAYWEAQVGNSSWYLYDGEDDTPSYRGFLIFWGYIIVLNTMVPISLYVSVEVIRLGQSHFINWDLQMYYAEKDTPAKARTTTLNEQLGQIHYIFSDKTGTLTQNIMTFKKCCINGQIYGDHRDASQHNHNKIEQVDFSWNTYADGKLAFYDHYLIEQIQSGKEPEVRQFFFLLAVCHTVMVDRTDGQLNYQAASPDEGALVNAARNFGFAFLARTQNTITISELGTERTYNVLAILDFNSDRKRMSIIVRTPEGNIKLYCKGADTVIYERLHRMNPTKQETQDALDIFANETLRTLCLCYKEIEEKEFTEWNKKFMAASVASTNRDEALDKVYEEIEKDLILLGATAIEDKLQDGVPETISKLAKADIKIWVLTGDKKETAENIGFACELLTEDTTICYGEDINSLLHARMENQRNRGGVYAKFAPPVQESFFPPGGNRALIITGSWLNEILLEKKTKRNKILKLKFPRTEEERRMRTQSKRRLEAKKEQRQKNFVDLACECSAVICCRVTPKQKAMVVDLVKRYKKAITLAIGDGANDVNMIKTAHIGVGISGQEGMQAVMSSDYSFAQFRYLQRLLLVHGRWSYIRMCKFLRYFFYKNFAFTLVHFWYSFFNGYSAQTAYEDWFITLYNVLYTSLPVLLMGLLDQDVSDKLSLRFPGLYIVGQRDLLFNYKRFFVSLLHGVLTSMILFFIPLGAYLQTVGQDGEAPSDYQSFAVTIASALVITVNFQIGLDTSYWTFVNAFSIFGSIALYFGIMFDFHSAGIHVLFPSAFQFTGTASNALRQPYIWLTIILTVAVCLLPVVAIRFLSMTIWPSESDKIQKHRKRLKAEEQWQRRQQVFRRGVSTRRSAYAFSHQRGYADLISSGRSIRKKRSPLDAIVADGTAEYRRTGDS

SEQ ID NO: 835860 - protein, 1251 aa, Homo sapiens; identical to SEQ ID NO: 835859

SEQ ID NO: 835861 - protein, 722 aa, Homo sapiens
MSTERDSETTFDEDSQPNDEVVPYSDDETEDELDDQGSAVEPEQNRVNREAEENREPFRKECTWQVKANDRKYHEQPHFMNTKFLCIKESKYANNAIKTYKYNAFTFIPMNLFEQFKRAANLYFLALLILQAVPQISTLAWYTTLVPLLVVLGVTAIKDLVDDVARHKMDKEINNRTCEVIKDGRFKVAKWKEIQVGDVIRLKKNDFVPADILLLSSSEPNSLCYVETAELDGETNLKFKMSLEITDQYLQREDTLATFDGFIECEEPNNRLDKFTGTLFWRNTSFPLDADKILLRGCVIRNTDFCHGLVIFAGADTKIMKNSGKTRFKRTKIDYLMNYMVYTIFVVLILLSAGLAIGHAYWEAQVGNSSWYLYDGEDDTPSYRGFLIFWGYIIVLNTMVPISLYVSVEVIRLGQSHFINWDLQMYYAEKDTPAKARTTTLNEQLGQIHYIFSDKTGTLTQNIMTFKKCCINGQIYGDHRDASQHNHNKIEQVDFSWNTYADGKLAFYDHYLIEQIQSGKEPEVRQFFFLLAVCHTVMVDRTDGQLNYQAASPDEGALVNAARNFGFAFLARTQNTITISELGTERTYNVLAILDFNSDRKRMSIIVRTPEGNIKLYCKGADTVIYERLHRMNPTKQETQDALDIFANETLRTLCLCYKEIEEKEFTEWNKKFMAASVASTNRDEALDKVYEEIEKDLIVSFSLNNFFFDILSRIEIFIKFY

SEQ ID NO: 835862 - protein, 722 aa, Homo sapiens; identical to SEQ ID NO: 835861

SEQ ID NO: 835863 - protein, 1251 aa, Homo sapiens; identical to SEQ ID NO: 835859

SEQ ID NO: 835864 - protein, 258 aa, Homo sapiens [sequence omitted]

SEQ ID NO: 835865 - protein, 722 aa, Homo sapiens; identical to SEQ ID NO: 835861

SEQ ID NO: 835866 - protein, 160 aa, Homo sapiens
GGGHPGDTFFRRGRARLFSGASGNSWSLYKGSASSRPGVSATPPKSPVYLDLAYLPSGSSAHLVDEEFFQRVRALCYVISGQDQRKEEGMRAVLDALLASKQHWDRDLQVTLIPTFDSVAMHTWYAETHARHQALGITVLGSNSMVSMQDDAFPACKVEF

SEQ ID NO: 835867 - protein, 1047 aa, Homo sapiens
GAARRWRRWLDLGLPRLRAHCSSWWAASSGARGSSPTSWRSSKELKVFVSRHSATFSSIVKGQRSLHHRGDNLETLVLLNPSDKSLYDELRNLLLDPASHKLLVLAGPCLEETGELLLQTGGFSPHHFLQVLKDREIRDILATTPPPVQPPILTITCPTFGDWAQLAPAVPGLQGALRLQLRLNPPAQLPNSEGLCEFLEYVAESLEPPSPFELLEPPTSGGFLRLGRPCCYIFPGGLGDAAFFAVNGFTVLVNGGSNPKSSFWKLVRHLDRVDAVLVTHPGADSLPGLNSLLRRKLAERSEVAAGGGSWDDRLRRLISPNLGVVFFNACEAASRLARGEDEAELALSLLAQLGITPLPLSRGPVPAKPTVLFEKMGVGRLDMYVLHPPSAGAERTLASVCALLVWHPAGPGEKVVRVLFPGCTPPACLLDGLVRLQHLRFLREPVVTPQDLEGPGRAESKESVGSRDSSKREGLLATHPRPGQERPGVARKEPARAEAPRKTEKEAKTPRELKKDPKPSVSRTQPREVRRAASSVPNLKKTNAQAAPKPRKAPSTSHSGFPPVANGPRSPPSLRCGEASPPSAACGSPASQLVATPSLELGPIPAGEEKALELPLAASSIPRPRTPSPESHRSPAEGSERLSLSPLRGGEAGPDASPTVTTPTVTTPSLPAEVGSPHSTEVDESLSVSFEQVLPPSAPTSEAGLSLPLRGPRARRSASPHDVDLCLVSPCEFEHRKAVPMAPAPASPGSSNDSSARSQERAGGLGAEETPPTSVSESLPTLSDSDPVPLAPGAADSDEDTEGFGVPRHDPLPDPLKVPPPLPDPSSICMVDPEMLPPKTARQTENVSRTRKPLARPNSRAAAPKATPVAAAKTKGLAGGDRASRPLSARSEPSEKGGRAPLSRKSSTPKTATRGPSGSASSRPGVSATPPKSPVYLDLAYLPSGSSAHLVDEEFFQRVRALCYVISGQDQRKEEGMRAVLDALLASKQHWDRDLQVTLIPTFDSVAMHTWYAETHARHQALGITVLGSNSMVSMQDDAFPACKVEF

SEQ ID NO: 835868 - protein, 548 aa, Homo sapiens
RGGPKMAAVAGSGAAAAPSSLLLVVGSEFGSPGLLTYVLEELERGIRSWDVDPGVCNLDEQLKVFVSRHSATFSSIVKGQRSLHHRGDNLETLVLLNPSDKSLYDELRNLLLDPASHKLLVLAGPCLEETGELLLQTGGFSPHHFLQVLKDREIRDILATTPPPVQPPILTITCPTFGDWAQLAPAVPGLQGALRLQLRLNPPAQLPNSEGLCEFLEYVAESLEPPSPFELLEPPTSGGFLRLGRPCCYIFPGGLGDAAFFAVNGFTVLVNGGSNPKSSFWKLVRHLDRVDAVLVTHPGADSLPGLNSLLRRKLAERSEVAAGGGSWDDRLRRLISPNLGVVFFNACEAASRLARGEDEAELALSLLAQLGITPLPLSRGPVPAKPTVLFEKMGVGRLDMYVLHPPSAGAERTLASVCALLVWHPAGPGEKVVRVLFPGCTPPACLLDGLVRLQHLRFLREPVVTPQDLEGPGRAESKESVGSRDSSKREGLLATHPRPGQERPGVARKEPARAEAPRKTEKEAKTPELRRPTCPTREDFGTKNQDSG

SEQ ID NO: 835869 - protein, 1064 aa, Homo sapiens
RGGPKMAAVAGSGAAAAPSSLLLVVGSEFGSPGLLTYVLEELERGIRSWDVDPGVCNLDEQLKVFVSRHSATFSSIVKGQRSLHHRGDNLETLVLLNPSDKSLYDELRNLLLDPASHKLLVLAGPCLEETGELLLQTGGFSPHHFLQVLKDREIRDILATTPPPVQPPILTITCPTFGDWAQLAPAVPGLQGALRLQLRLNPPAQLPNSEGLCEFLEYVAESLEPPSPFELLEPPTSGGFLRLGRPCCYIFPGGLGDAAFFAVNGFTVLVNGGSNPKSSFWKLVRHLDRVDAVLVTHPGADSLPGLNSLLRRKLAERSEVAAGGGSWDDRLRRLISPNLGVVFFNACEAASRLARGEDEAELALSLLAQLGITPLPLSRGPVPAKPTVLFEKMGVGRLDMYVLHPPSAGAERTLASVCALLVWHPAGPGEKVVRVLFPGCTPPACLLDGLVRLQHLRFLREPVVTPQDLEGPGRAESKESVGSRDSSKREGLLATHPRPGQERPGVARKEPARAEAPRKTEKEAKTPRELKKDPKPSVSRTQPREVRRAASSVPNLKKTNAQAAPKPRKAPSTSHSGFPPVANGPRSPPSLRCGEASPPSAACGSPASQLVATPSLELGPIPAGEEKALELPLAASSIPRPRTPSPESHRSPAEGSERLSLSPLRGGEAGPDASPTVTTPTVTTPSLPAEVGSPHSTEVDESLSVSFEQVLPPSAPTSEAGLSLPLRGPRARRSASPHDVDLCLVSPCEFEHRKAVPMAPAPASPGSSNDSSARSQERAGGLGAEETPPTSVSESLPTLSDSDPVPLAPGAADSDEDTEGFGVPRHDPLPDPLKVPPPLPDPSSICMVDPEMLPPKTARQTENVSRTRKPLARPNSRAAAPKATPVAAAKTKGLAGGDRASRPLSARSEPSEKGGRAPLSRKSSTPKTATRGPSGSASSRPGVSATPPKSPVYLDLAYLPSGSSAHLVDEEFFQRVRALCYVISGQDQRKEEGMRAVLDALLASKQHWDRDLQVTLIPTFDSVAMHTWYAETHARHQALGITVLGSNSMVSMQDDAFPACKVEF

SEQ ID NO: 835870 - protein, 1022 aa, Homo sapiens
MFSIRSWDVDPGVCNLDEQLKVFVSRHSATFSSIVKGQRSLHHRGDNLETLVLLNPSDKSLYDELRNLLLDPASHKLLVLAGPCLEETGELLLQTGGFSPHHFLQVLKDREIRDILATTPPPVQPPILTITCPTFGDWAQLAPAVPGLQGALRLQLRLNPPAQLPNSEGLCEFLEYVAESLEPPSPFELLEPPTSGGFLRLGRPCCYIFPGGLGDAAFFAVNGFTVLVNGGSNPKSSFWKLVRHLDRVDAVLVTHPGADSLPGLNSLLRRKLAERSEVAAGGGSWDDRLRRLISPNLGVVFFNACEAASRLARGEDEAELALSLLAQLGITPLPLSRGPVPAKPTVLFEKMGVGRLDMYVLHPPSAGAERTLASVCALLVWHPAGPGEKVVRVLFPGCTPPACLLDGLVRLQHLRFLREPVVTPQDLEGPGRAESKESVGSRDSSKREGLLATHPRPGQERPGVARKEPARAEAPRKTEKEAKTPRELKKDPKPSVSRTQPREVRRAASSVPNLKKTNAQAAPKPRKAPSTSHSGFPPVANGPRSPPSLRCGEASPPSAACGSPASQLVATPSLELGPIPAGEEKALELPLAASSIPRPRTPSPESHRSPAEGSERLSLSPLRGGEAGPDASPTVTTPTVTTPSLPAEVGSPHSTEVDESLSVSFEQVLPPSAPTSEAGLSLPLRGPRARRSASPHDVDLCLVSPCEFEHRKAVPMAPAPASPGSSNDSSARSQERAGGLGAEETPPTSVSESLPTLSDSDPVPLAPGAADSDEDTEGFGVPRHDPLPDPLKVPPPLPDPSSICMVDPEMLPPKTARQTENVSRTRKPLARPNSRAAAPKATPVAAAKTKGLAGGDRASRPLSARSEPSEKGGRAPLSRKSSTPKTATRGPSGSASSRPGVSATPPKSPVYLDLAYLPSGSSAHLVDEEFFQRVRALCYVISGQDQRKEEGMRAVLDALLASKQHWDRDLQVTLIPTFDSVAMHTWYAETHARHQALGITVLGSNSMVSMQDDAFPACKVEF

SEQ ID NO: 835871 - protein, 121 aa, Homo sapiens
LWVLVGRNRDLTDGLTTHCRPQGGAHKIREKPGGVSNARKGRRLGPRPEGQGAPPSLVVHSPHTPPLHLQVTLIPTFDSVAMHTWYAETHARHQALGITVLGSNSMVSMQDDAFPACKVEF

SEQ ID NO: 835872 - protein, 617 aa, Homo sapiens
MSSLPTSDGFNHPARSSGQSPDVGNPMSLARSVSASVCPIKPSDSDRIEPKAVKALKASAEFQLNSEKKEHLSLQDLSDHASSADHAPTDQSPAMPMQNSSEEITVAGNLEKSAERSTQGLKFHLHTRQEASLSVTSTRMHEPQMFLGEKDWHPENQNLSQVSDPQQHEEPGNEQYEVAQQKASHDQEYLCNIGDLELPEERQQNQHKIVDLEATMKGNGLPQNVDPPSAKKSIPSSECSGCSNSETFMEIDTAQQSLVTLLNSTGRQNANVKNIGALDLTLDNPLMEVETSKCNPSSEILNDSISTQDLQPPETNVEIPGTNKEYGHYSSPSLCGSCQPSVESAEESCPSITAALKELHELLVVSSKPASENTSEEVICQSETIAEGQTSIKDLSERWTQNEHLTQNEQCPQVSFHQAISVSVETEKLTGTSSDTGREAVENVNFRSLGDGLSTDKEGVPKSRESINKNRSVTVTSAKTSNQLHCTLGVEISPKLLAGEEDALNQTSEQTKSLSSNFILVKDLGQGIQNSVTDRPETRENVCPDASRPLLEYEPPTSHPSSSPAILPPLIFPATDIDRILRAGFTLQEALGALHRVGGNADLALLVLLAKNIVVPT

SEQ ID NO: 835873 - protein, 617 aa, Homo sapiens; identical to SEQ ID NO: 835872

SEQ ID NO: 835874 - protein, 186 aa, Homo sapiens
PPGAQMTIMSQACAERCNIMRLVDRRWAGIAKGVGTQKIIGRVHLAQVQIEGDFLPCSFSILEEQPMDMLLGLDMLKRHQCSIDLKKNVLVIGTTGSQTTFLPEGELPECARLAYGAGREDVRPEEIADQELAEALQKSAEDADCCVYCERMEATNKYFGCPNYRNIPQLGIYQFLILKMAKERKL

SEQ ID NO: 835875 - protein, 617 aa, Homo sapiens; identical to SEQ ID NO: 835872

SEQ ID NO: 835876 - protein, 168 aa, Homo sapiens
PPGAQMTIMSQACAERCNIMRLVDRRWAGIAKGVGTQKIIGRVHLAQVQIEGDFLPCSFSILEEQPMDMLLGLDMLKRHQCSIDLKKNVLVIGTTGSQTTFLPEGELPECARLAYGAGREDVRPEEIADQELAEALQKSAEDAGIWDGQTLQYLLLMGKPGKCGLQKG

SEQ ID NO: 835877 - protein, 350 aa, Homo sapiens
MSAACWEEPWGLPGGFAKRVLVTGGAGFIASHMIVSLVEDYPNYMIINLDKLDYCASLKNLETISNKQNYKFIQGDICDSHFVKLLFETEKIDIVLHFAAQTHVDLSFVRAFEFTYVNVYGTHVLVSAAHEARVEKFIYVSTDEVYGGSLDKEFDESSPKQPTNPYASSKAAAECFVQSYWEQYKFPVVITRSSNVYGPHQYPEKVIPKFISLLQHNRKCCIHGSGLQTRNFLYATDVVEAFLTVLKKGKPGEIYNIGTNFEMSVVQLAKELIQLIKETNSESEMENWVDYVNDRPTNDMRYPMKSEKIHGLGWRPKVPWKEGIKKTIEWYRENFHNWKNVEKALEPFPV

SEQ ID NO: 835878 - protein, 318 aa, Homo sapiens
MIVSLVEDYPNYMIINLDKLDYCASLKNLETISNKQNYKFIQGDICDSHFVKLLFETEKIDIVLHFAAQTHVDLSFVRAFEFTYVNVYGTHVLVSAAHEARVEKFIYVSTDEVYGGSLDKEFDESSPKQPTNPYASSKAAAECFVQSYWEQYKFPVVITRSSNVYGPHQYPEKVIPKFISLLQHNRKCCIHGSGLQTRNFLYATDVVEAFLTVLKKGKPGEIYNIGTNFEMSVVQLAKELIQLIKETNSESEMENWVDYVNDRPTNDMRYPMKSEKIHGLGWRPKVPWKEGIKKTIEWYRENFHNWKNVEKALEPFPV

SEQ ID NO: 835879 - protein, 104 aa, Homo sapiens
PEAASGCSVNVSRERGASQKVAAELPCAFQTILFTVLGTAELGDVGGVLGGTVGSSRRLCEAGPGDRRCWFHCITYDCLFSGRLSKLYDHKSRQAGLLCKLEES

SEQ ID NO: 835880 - protein, 405 aa, Homo sapiens
SQCGRDRKEQICFFAGRIWKDAADQSFAHWLPRGGLGKWKPAFRCGTRSLVARGRCLGLESRTSGVGKERIPPFAAAAATLEVHASHMIVSLVEDYPNYMIINLDKLDYCASLKNLETISNKQNYKFIQGDICDSHFVKLLFETEKIDIVLHFAAQTHVDLSFVRAFEFTYVNVYGTHVLVSAAHEARVEKFIYVSTDEVYGGSLDKEFDESSPKQPTNPYASSKAAAECFVQSYWEQYKFPVVITRSSNVYGPHQYPEKVIPKFISLLQHNRKCCIHGSGLQTRNFLYATDVVEAFLTVLKKGKPGEIYNIGTNFEMSVVQLAKELIQLIKETNSESEMENWVDYVNDRPTNDMRYPMKSEKIHGLGWRPKVPWKEGIKKTIEWYRENFHNWKNVEKALEPFPV

SEQ ID NO: 835881 - protein, 330 aa, Homo sapiens
MSAACWEEPWGLPGGFAKRVLVTGGAGFIASHMIVSLVEDYPNYMIINLDKLDYCASLKNLETISNKQNYKFIQGDICDSHFVKLLFETEKIDIVLHFAAQTHVDLSFVRAFEFTYVNVYGTHVLVSAAHEARVEKFIYVSTDEVYGGSLDKEFDESSPKQPTNPYASSKAAAECFVQSYWEQYKFPVVITRSSNVYGPHQYPEKVIPKFISLLQHNRKCCIHGSGLQTRNFLYATDVVEAFLTVLKKGKPGEIYNIGTNFEMSVVQLAKELIQLIKETNSESEMENWVDYVNDRPTNDMRYPMKSEKIHGLGWRPKVPWKEGIKKTSMF

SEQ ID NO: 835882 - protein, 350 aa, Homo sapiens; identical to SEQ ID NO: 835877

SEQ ID NO: 835883 - protein, 242 aa, Homo sapiens
MSAACWEEPWGLPGGFAKRVLVTGGAGFIASHMIVSLVEDYPNYMIINLDKLDYCASLKNLETISNKQNYKFIQGDICDSHFVKLLFETEKIDIVLHFAAQTHVDLSFVRAFEFTYVNVYGTHVLVSAAHEARVEKFIYVSTDEVYGGSLDKEFDESSPKQPTNPYASSKAAAECFVQSYWEQYKFPVVITRSSNVYGPHQYPEKVFQNLYLCSAHQEMFDYWVGLKQELLFTTDVKTIFIA

SEQ ID NO: 835884 - protein, 330 aa, Homo sapiens; identical to SEQ ID NO: 835881

SEQ ID NO: 835885 - protein, 101 aa, Homo sapiens
PEAASGCSVNVSRERGASQKVAAELPCAFQTILFTVLGTAELGDVGGVLGGTVGSSRRLCEAGPGDRRCWFHVGNGAASQAVAPQKPLPFPAALLALVHHI

SEQ ID NO: 835886 - protein, 142 aa, Homo sapiens
MAVAAVKWVMSKRTILKHLFPVQNGALYCVCHKSTYSPLPDDYNCNVELALTSDGRTIVCYHPSVDIPYEHTKPIPRPDPVHNNEETHDQVLKTRLEEKVEHLEEGPMIEQLSKMFFTTKHRWYPHGRYHRCRKNLNPPKDR

SEQ ID NO: 835887 - protein, 142 aa, Homo sapiens; identical to SEQ ID NO: 835886

SEQ ID NO: 835888 - protein, 142 aa, Homo sapiens; identical to SEQ ID NO: 835886

SEQ ID NO: 835889 - protein, 142 aa, Homo sapiens; identical to SEQ ID NO: 835886

SEQ ID NO: 835890 - protein, 155 aa, Homo sapiens
MAVAAVKWVMSKRTILKHLFPVQNGALYCVCHKSTYSPLPDDYNCNVELALTSDGRTIVCYHPSVDIPYEHTKPIPRPDPVHNNEETHDQVLKTRLEEKVEHLEEGPMIEQLSKMFFTTKHRWYPHGRGKVSLTVLRRLILNSWTQVILLPQLGL

SEQ ID NO: 835891 - protein, 142 aa, Homo sapiens; identical to SEQ ID NO: 835886

SEQ ID NO: 835892 - protein, 142 aa, Homo sapiens; identical to SEQ ID NO: 835886

SEQ ID NO: 835893 - protein, 142 aa, Homo sapiens; identical to SEQ ID NO: 835886

SEQ ID NO: 835894 - protein, 167 aa, Homo sapiens
MAVAAVKWVMSKRTILKHLFPVQNGALYCVCHKSTYSPLPDDYNCNVELALTSDGRTIVCYHPSVDIPYEHTKPIPRPDPVHNNEETHDQVLKTRLEEKVEHLEEGPMIEQLSKMFFTTKHRWYPHGRYHRCRKNLNLCLICHLRKCSLVYSVIYSKVIMIKYLFIY

SEQ ID NO: 835895 - protein, 142 aa, Homo sapiens; identical to SEQ ID NO: 835886

SEQ ID NO: 835896 - protein, 142 aa, Homo sapiens; identical to SEQ ID NO: 835886

SEQ ID NO: 835897 - protein, 142 aa, Homo sapiens; identical to SEQ ID NO: 835886

SEQ ID NO: 835898 - protein, 142 aa, Homo sapiens; identical to SEQ ID NO: 835886

SEQ ID NO: 835899 - protein, 142 aa, Homo sapiens; identical to SEQ ID NO: 835886

SEQ ID NO: 835900 - protein, 142 aa, Homo sapiens; identical to SEQ ID NO: 835886

SEQ ID NO: 835901 - protein, 142 aa, Homo sapiens; identical to SEQ ID NO: 835886

SEQ ID NO: 835902 - protein, 142 aa, Homo sapiens; identical to SEQ ID NO: 835886

SEQ ID NO: 835903 - protein, 154 aa, Homo sapiens
MADIDNKEQSELDQDLDDVEEVEEEETGEETKLKARQLTVQMMQNPQILAALQERLDGLVETPTGYIESLPRVVKRRVNALKNLQVKCAQIEAKFYEEVHDLERKYAVLYQPLFDKRFEIINAIYEPTEEECEWKPDEEDEISEELKEKAKIER

SEQ ID NO: 835904 - protein, 158 aa, Homo sapiens
MRSEPDDSDPFSFDGPEIMGCTGCQIDWKHTGKNVTLKTIKKKQKHKGRGTVRTVTKTVSNDSFFNFFAPPEVPESGDLDDDAEAILAADFEIGHFLRERIIPRSVLYFTGEAIEDDDDDYDEEGEEADEEGEEEGDEENDPDYDPKKDQNPAECKQQ

SEQ ID NO: 835905 - protein, 92 aa, Homo sapiens
EDSLTEEFQSGDLDDDAEAILAADFEIGHFLRERIIPRSVLYFTGEAIEDDDDDYDEEGEEADEEGEEEGDEENDPDYDPKKDQNPAECKQQ

SEQ ID NO: 835906 - protein, 110 aa, Homo sapiens
AQLRSYSVDPLCEPDEFFEKLFEFLFDLFNNKSKTPSQKKKDFEIGHFLRERIIPRSVLYFTGEAIEDDDDDYDEEGEEADEEGEEEGDEENDPDYDPKKDQNPAECKQQ

SEQ ID NO: 835907 - protein, 72 aa, Homo sapiens
TRGSTHASREAKFYEEVHDLERKYAVLYQPLFDKRFEIINAIYEPTEEECEWKPDEEDEISEELKEKAKIER

SEQ ID NO: 835908 - protein, 171 aa, Homo sapiens
MITNSWPCSGDIWSSYNMADIDNKEQSELDQDLDDVEEVEEEETGEETKLKARQLTVQMMQNPQILAALQERLDGLVETPTGYIESLPRVVKRRVNALKNLQVKCAQIEAKFYEEVHDLERKYAVLYQPLFDKRFEIINAIYEPTEEECEWKPDEEDEISEELKEKAKIER

SEQ ID NO: 835909 - protein, 171 aa, Homo sapiens; identical to SEQ ID NO: 835908

SEQ ID NO: 835910 - protein, 171 aa, Homo sapiens; identical to SEQ ID NO: 835908

SEQ ID NO: 835911 - protein, 171 aa, Homo sapiens; identical to SEQ ID NO: 835908

SEQ ID NO: 835912 - protein, 171 aa, Homo sapiens; identical to SEQ ID NO: 835908

SEQ ID NO: 835913 - protein, 171 aa, Homo sapiens; identical to SEQ ID NO: 835908

SEQ ID NO: 835914 - protein, 171 aa, Homo sapiens; identical to SEQ ID NO: 835908

SEQ ID NO: 835915 - protein, 171 aa, Homo sapiens; identical to SEQ ID NO: 835908

SEQ ID NO: 835916 - protein, 171 aa, Homo sapiens; identical to SEQ ID NO: 835908

SEQ ID NO: 835917 - protein, 171 aa, Homo sapiens; identical to SEQ ID NO: 835908

SEQ ID NO: 835918 - protein, 171 aa, Homo sapiens; identical to SEQ ID NO: 835908

SEQ ID NO: 835919 - protein, 171 aa, Homo sapiens; identical to SEQ ID NO: 835908

SEQ ID NO: 835920 - protein, 171 aa, Homo sapiens; identical to SEQ ID NO: 835908

SEQ ID NO: 835921 - protein, 171 aa, Homo sapiens; identical to SEQ ID NO: 835908

SEQ ID NO: 835922 - protein, 171 aa, Homo sapiens; identical to SEQ ID NO: 835908

SEQ ID NO: 835923 - protein, 171 aa, Homo sapiens; identical to SEQ ID NO: 835908

SEQ ID NO: 835924 - protein, 171 aa, Homo sapiens; identical to SEQ ID NO: 835908

SEQ ID NO: 835925 - protein, 171 aa, Homo sapiens; identical to SEQ ID NO: 835908

SEQ ID NO: 835926 - protein, 171 aa, Homo sapiens; identical to SEQ ID NO: 835908

SEQ ID NO: 835927 - protein, 171 aa, Homo sapiens; identical to SEQ ID NO: 835908

SEQ ID NO: 835928 - protein, 171 aa, Homo sapiens; identical to SEQ ID NO: 835908

SEQ ID NO: 835929 - protein, 120 aa, Homo sapiens
QRRLDTGGNQRSPSAAPGPRGCRSPRWGYGGRRGRRTVQLLGNPAWTRLSLALLGDYKAGRRAAKGPYVLTLIVYERERRALGSFLAPSARGAASCSSRCCCRCRPESLPAQLRPPGSPY

SEQ ID NO: 835930 - protein, 112 aa, Homo sapiens
MQNPQILAALQERLDGLVETPTGYIESLPRVVKRRVNALKNLQVKCAQIEAKFYEEVHDLERKYAVLYQPLFDKRFEIINAIYEPTEEECEWKPDEEDEISEELKEKAKIER

SEQ ID NO: 835931 - protein, 159 aa, Homo sapiens
HSRPPNTRRTAFESGRGDPFLLMDQKLMGCTWCQIDWKHTGKNVTLKTIKKKQKHKGRGTVRTVTKTVSNDSFFNFFAPPEVPESGDLDDDAEAILAADFEIGHFLRERIIPRSVLYFTGEAIEDDDDDYDEEGEEADEGYQLFEEVKSCSKLFQRWLQ

SEQ ID NO: 835932 - protein, 128 aa, Homo sapiens
TGRLYSTGRGRGTVRTVTKTVSNDSFFNFFAPPEVPESGDLDDDAEAILAADFEIGHFLRERIIPRSVLYFTGEAIEDDDDDYDEEGEEADEEGEEEGDEENDPDYDPKKDQTQQSTAGGVHLPWGRP

SEQ ID NO: 835933 - protein, 171 aa, Homo sapiens; identical to SEQ ID NO: 835908

SEQ ID NO: 835934 - protein, 171 aa, Homo sapiens; identical to SEQ ID NO: 835908

SEQ ID NO: 835935 - protein, 171 aa, Homo sapiens; identical to SEQ ID NO: 835908

SEQ ID NO: 835936 - protein, 171 aa, Homo sapiens; identical to SEQ ID NO: 835908

SEQ ID NO: 835937 - protein, 171 aa, Homo sapiens; identical to SEQ ID NO: 835908

SEQ ID NO: 835938 - protein, 171 aa, Homo sapiens; identical to SEQ ID NO: 835908

SEQ ID NO: 835939 - protein, 171 aa, Homo sapiens; identical to SEQ ID NO: 835908

SEQ ID NO: 835940 - protein, 171 aa, Homo sapiens; identical to SEQ ID NO: 835908

SEQ ID NO: 835941 - protein, 171 aa, Homo sapiens; identical to SEQ ID NO: 835908

SEQ ID NO: 835942 - protein, 171 aa, Homo sapiens; identical to SEQ ID NO: 835908

SEQ ID NO: 835943 - protein, 171 aa, Homo sapiens; identical to SEQ ID NO: 835908

SEQ ID NO: 835944 - protein, 171 aa, Homo sapiens; identical to SEQ ID NO: 835908

SEQ ID NO: 835945 - protein, 171 aa, Homo sapiens; identical to SEQ ID NO: 835908

SEQ ID NO: 835946 - protein, 171 aa, Homo sapiens; identical to SEQ ID NO: 835908

SEQ ID NO: 835947 - protein, 171 aa, Homo sapiens; identical to SEQ ID NO: 835908

SEQ ID NO: 835948 - protein, 171 aa, Homo sapiens; identical to SEQ ID NO: 835908

SEQ ID NO: 835949 - protein, 475 aa, Homo sapiens
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWSKTGPVAKELSGLPSGPSAGSGPPPPPPGPPPPPVSTSSGSDESASRSALFAQINQGESITHALKHVSDDMKTHKNPALKAQSGPVRSGPKPFSAPKPQTSPSPKRATKKEPAVLELEGKKWRVENQENVSNLVIEDTELKQVAYIYKCVNTTLQIKGKINSITVDNCKKLGLVFDDVVGIVEIINSKDVKVQVMGKVPTISINKTDGCHAYLSKNSLDCEIVSAKSSEMNVLIPTEGGDFNEFPVPEQFKTLWNGQKLVTTVTEIAG

SEQ ID NO: 835950 - protein, 317 aa, Homo sapiens
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWSKTRGLWAKRNGTGTGISGNPLPEEGRTSPINRGPVQYPRNLTSEGKKSMDEGSSGSEGRKGGEQKCTKGGDEERKTGKFKRKRRHKYGDTLRRHKENTNGTNEKRRKGK

SEQ ID NO: 835951 - protein, 475 aa, Homo sapiens; identical to SEQ ID NO: 835949

SEQ ID NO: 835952 - protein, 475 aa, Homo sapiens; identical to SEQ ID NO: 835949

SEQ ID NO: 835953 - protein, 475 aa, Homo sapiens; identical to SEQ ID NO: 835949

SEQ ID NO: 835954 - protein, 464 aa, Homo sapiens
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWSKTGPVAKELSGLPSGPSAGSGPPPPSSGSDESASRSALFAQINQGESITHALKHVSDDMKTHKNPALKAQSGPVRSGPKPFSAPKPQTSPSPKRATKKEPAVLELEGKKWRVENQENVSNLVIEDTELKQVAYIYKCVNTTLQIKGKINSITVDNCKKLGLVFDDVVGIVEIINSKDVKVQVMGKVPTISINKTDGCHAYLSKNSLDCEIVSAKSSEMNVLIPTEGGDFNEFPVPEQFKTLWNGQKLVTTVTEIAG

SEQ ID NO: 835955 - protein, 475 aa, Homo sapiens; identical to SEQ ID NO: 835949

SEQ ID NO: 835956 - protein, 475 aa, Homo sapiens; identical to SEQ ID NO: 835949

SEQ ID NO: 835957 - protein, 452 aa, Homo sapiens
MGGTRRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWSKTGPVAKELSGLPSGPSAGSGPPPPPPGPPPPPVSTSSGSDESASRSALFAQINQGESITHALKHVSDDMKTHKNPALKAQSGPVRSGPKPFSAPKPQTSPSPKRATKKEPAVLELEGKKWRVENQENVSNLVIEDTELKQVAYIYKCVNTTLQIKGKINSITVDNCKKLGLVFDDVVGIVEIINSKDVKVQVMGKVPTISINKTDGCHAYLSKNSLDCEIVSAKSSEMNVLIPTEGGDFNEFPVPEQFKTLWNGQKLVTTVTEIAG

SEQ ID NO: 835958 - protein, 490 aa, Homo sapiens
FAAASTEKTTEGGGERLIAVRSRWSIMADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWSKTGPVAKELSGLPSGPSAGSGPPPPSSGSDESASRSALFAQINQGESITHALKHVSDDMKTHKNPALKAQSGPVRSGPKPFSAPKPQTSPSPKRATKKEPAVLELEGKKWRVENQENVSNLVIEDTELKQVAYIYKCVNTTLQIKGKINSITVDNCKKLGLVFDDVVGIVEIINSKDVKVQVMGKVPTISINKTDGCHAYLSKNSLDCEIVSAKSSEMNVLIPTEGGDFNEFPVPEQFKTLWNGQKLVTTVTEIAG

SEQ ID NO: 835959 - protein, 475 aa, Homo sapiens; identical to SEQ ID NO: 835949

SEQ ID NO: 835960 - protein, 211 aa, Homo sapiens
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWSKTP

SEQ ID NO: 835961 - protein, 302 aa, Homo sapiens
MADMQNLVERLERAVGRLEAVSHTSDMHRGYADSPSKAGAAPYVQAFDSLLAGPVAEYLNPPGPPPPPVSTSSGSDESASRSALFAQINQGESITHALKHVSDDMKTHKNPALKAQSGPVRSGPKPFSAPKPQTSPSPKRATKKEPAVLELEGKKWRVENQENVSNLVIEDTELKQVAYIYKCVNTTLQIKGKINSITVDNCKKLGLVFDDVVGIVEIINSKDVKVQVMGKVPTISINKTDGCHAYLSKNSLDCEIVSAKSSEMNVLIPTEGGDFNEFPVPEQFKTLWNGQKLVTTVTEIAG

SEQ ID NO: 835962 - protein, 178 aa, Homo sapiens
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRETSHKEGASCT

SEQ ID NO: 835963 - protein, 475 aa, Homo sapiens; identical to SEQ ID NO: 835949

SEQ ID NO: 835964 - protein, 428 aa, Homo sapiens
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWSKTGPVAKELSGLPSGPSAGSGPPPPPPGPPPPPVSTSSGSDESASRSALFAQINQGESITHALKHVSDDMKTHKNPALKAQSGPVRSGPKPFSAPKPQTSPSPKRATKKEPAVLELEGKKWRVENQENVSNLVIEDTELKQVAYIYKCVNTTLQIKGKINSITVDNCKKLGLVFDDVVGIVEIINSKDVKVQVMGKVPTISINASRHSSEMNCLIPTERP

SEQ ID NO: 835965 - protein, 401 aa, Homo sapiens
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWSKTGPVAKELSGLPSGPSAGSGPPPPPPGPPPPPVSTSSGSDESASRSALFAQINQGESITHALKHVSDDMKTHKNPALKAQSGPVRSGPKPFSAPKPQTSPSPKRATKKEPAVLELEGKKWRVENQENVSNLVIEDTELKQVAYIYKCVNTTLQIKGKINSITVDNCKKLGLELRRVAHAESPDLSSTSTFLP

SEQ ID NO: 835966 - protein, 274 aa, Homo sapiens
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWSKTGPVAKELSGLPSGPSAGSGPPPPFTAYEQRAPVAHTQFVTSFTVQMSLVHRETCPAINKGEHSE

SEQ ID NO: 835967 - protein, 317 aa, Homo sapiens
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWSKTRGLWAKRNGSGTGISGNPLPEEGRTSPINRGPVQYPRNLTSEGKKSMDEGSSGSEGCKGGEQKCTKGGDEERKTGKFKRKRRHKYGDTLRRHKENTNGTNEKRRKGK

SEQ ID NO: 835968 - protein, 274 aa, Homo sapiens; identical to SEQ ID NO: 835966

SEQ ID NO: 835969 - protein, 198 aa, Homo sapiens
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHCSRRIIRGESITHALNMYL

SEQ ID NO: 835970 - protein, 131 aa, Homo sapiens [sequence omitted]

SEQ ID NO: 835971 - protein, 475 aa, Homo sapiens; identical to SEQ ID NO: 835949

SEQ ID NO: 835972 - protein, 475 aa, Homo sapiens; identical to SEQ ID NO: 835949

SEQ ID NO: 835973 - protein, 501 aa, Homo sapiens
FAAASTEKTTEGGGERLIAVRSRWSIMADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWSKTGPVAKELSGLPSGPSAGSGPPPPPPGPPPPPVSTSSGSDESASRSALFAQINQGESITHALKHVSDDMKTHKNPALKAQSGPVRSGPKPFSAPKPQTSPSPKRATKKEPAVLELEGKKWRVENQENVSNLVIEDTELKQVAYIYKCVNTTLQIKGKINSITVDNCKKLGLVFDDVVGIVEIINSKDVKVQVMGKVPTISINKTDGCHAYLSKNSLDCEIVSAKSSEMNVLIPTEGGDFNEFPVPEQFKTLWNGQKLVTTVTEIAG

SEQ ID NO: 835974 - protein, 501 aa, Homo sapiens
VKDEAGVESAPRGEPADLQVRSRWSIMADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWSKTGPVAKELSGLPSGPSAGSGPPPPPPGPPPPPVSTSSGSDESASRSALFAQINQGESITHALKHVSDDMKTHKNPALKAQSGPVRSGPKPFSAPKPQTSPSPKRATKKEPAVLELEGKKWRVENQENVSNLVIEDTELKQVAYIYKCVNTTLQIKGKINSITVDNCKKLGLVFDDVVGIVEIINSKDVKVQVMGKVPTISINKTDGCHAYLSKNSLDCEIVSAKSSEMNVLIPTEGGDFNEFPVPEQFKTLWNGQKLVTTVTEIAG

SEQ ID NO: 835975 - protein, 479 aa, Homo sapiens
VKDEAACSIGTEERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWSKTGPVAKELSGLPSGPSAGSGPPPPPPGPPPPPVSTSSGSDESASRSALFAQINQGESITHALKHVSDDMKTHKNPALKAQSGPVRSGPKPFSAPKPQTSPSPKRATKKEPAVLELEGKKWRVENQENVSNLVIEDTELKQVAYIYKCVNTTLQIKGKINSITVDNCKKLGLVFDDVVGIVEIINSKDVKVQVMGKVPTISINKTDGCHAYLSKNSLDCEIVSAKSSEMNVLIPTEGGDFNEFPVPEQFKTLWNGQKLVTTVTEIAG

SEQ ID NO: 835976 - protein, 463 aa, Homo sapiens
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWSKTGPVAKELSGLPSGPSAGSGPPPPPPGPPPPPVSTSSGSDESASRSALFAQINQGESITHALKHVSDDMKTHKNPALKAQSGPVRSGPKPFSAPKPQTSPSPKRATKKEPAVLELEGKKWRVENQENVSNLVIEDTELKQVAYIYKCVNTTLQIKGKINSITVDNCKKLGLVFDDVVGIVEIINSKDVKVQVMGKVPTISINKTDGCHAYLSKNSLDCEIVSAKSSEMNVLIPTEGGDFNEFPVPEQFKTLWNGQKLVTTVTEIAG

SEQ ID NO: 835977 - protein, 272 aa, Homo sapiens
MQTVLQKGPVAKELSGLPSGPSAGSGPPPPPPGPPPPPVSTSSGSDESASRSALFAQINQGESITHALKHVSDDMKTHKNPALKAQSGPVRSGPKPFSAPKPQTSPSPKRATKKEPAVLELEGKKWRVENQENVSNLVIEDTELKQVAYIYKCVNTTLQIKGKINSITVDNCKKLGLVFDDVVGIVEIINSKDVKVQVMGKVPTISINKTDGCHAYLSKNSLDCEIVSAKSSEMNVLIPTEGGDFNEFPVPEQFKTLWNGQKLVTTVTEIAG

SEQ ID NO: 835978 - protein, 475 aa, Homo sapiens; identical to SEQ ID NO: 835949

SEQ ID NO: 835979 - protein, 232 aa, Homo sapiens
MPPCFIQTESRSALFAQINQGESITHALKHVSDDMKTHKNPALKAQSGPVRSGPKPFSAPKPQTSPSPKRATKKEPAVLELEGKKWRVENQENVSNLVIEDTELKQVAYIYKCVNTTLQIKGKINSITVDNCKKLGLVFDDVVGIVEIINSKDVKVQVMGKVPTISINKTDGCHAYLSKNSLDCEIVSAKSSEMNVLIPTEGGDFNEFPVPEQFKTLWNGQKLVTTVTEIAG

SEQ ID NO: 835980 - protein, 455 aa, Homo sapiens
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWSKTGPVAKELSGLPSGPSAGSGPPPPPPGPPPPPVSTSSGSDESASRSALFAQINQGESITHALKHVSDDMKTHKNPALKAQSGPVRSGPKPFSAPKPQTSPSPKRATKKEPAVLELEGKKWRVENQENVSNLVIEDTELKQVAYIYKCVNTTLQIKGKINSITVDNCKKLGLVFDDVVGIVEIINSKDVKVQVMGKVPTISINKTDGCHAYLSKNSLDCEIVSAKSSEMNVLIPTEGGDFAALRYRL

SEQ ID NO: 835981 - protein, 409 aa, Homo sapiens
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWSKTGPVAKELSGLPSGPSAGSGPPPPPPGPPPPPVSTSSGSDESASRSALFAQINQGESITHALKHVSDDMKTHKNPALKAQSGPVRSGPKPFSAPKPQTSPSPKRATKKEPAVLELEGKKWRVENQENVSNLVIEDTELKQVAYIYKCVNTTLQIKGKINSITVDNCKKLGLVFDDVVGIVEIINSKDVKVQVMVIPGPSS

SEQ ID NO: 835982 - protein, 278 aa, Homo sapiens
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWSKTGPVAKELSGLPSGPSAGSGPPPPRYQKGTRSVAQASQSQAQKSLVPDQHGTSRIKQGARHNKCPEKCS

SEQ ID NO: 835983 - protein, 248 aa, Homo sapiens
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWSKTWALEATNGGLVRYRTWSWTDHLGAFCPDLRVLLSTINK

SEQ ID NO: 835984 - protein, 178 aa, Homo sapiens; identical to SEQ ID NO: 835962

SEQ ID NO: 835985 - protein, 815 aa, Homo sapiens
MGSDKRVSRTERSGRYGSIIDRDDRDERESRSRRRDSDYKRSSDDRRGDRYDDYRDYDSPERERERRNSDRSEDGYHSDGDYGEHDYRHDISDERESKTIMLRGLPITITESDIREMMESFEGPQPADVRLMKRKTGVSRGFAFVEFYHLQDATSWMEANQKKLVIQGKHIAMHYSNPRPKFEDWLCNKCCLNNFRKRLKCFRCGADKFDSEQEVPPGTTESVQSVDYYCDTIILRNIAPHTVVDSIMTALSPYASLAVNNIRLIKDKQTQQNRGFAFVQLSSAMDASQLLQILQSLHPPLKIDGKTIGVDFAKSARKDLVLSDGNRVSAFSVASTAIAAAQWSSTQSQSGEGGSVDYSYLQPGQDGYAQYAQYSQDYQQFYQQQAGGLESDASSASGTAVTTTSAAVVSQSPQLYNQTSNPPGSPTEEAQPSTSTSTQAPAASPTGVVPGTKYAVPDTSTYQYDESSGYYYDPTTGLYYDPNSQYYYNSLTQQYLYWDGEKETYVPAAESSSHQQSGLPPAKEGKEKKEKPKSKTAQQIAKDMERWAKSLNKQKENFKNSFQPVNSLREEERRESAAADAGFALFEKKGALAERQQLIPELVRNGDEENPLKRGLVAAYSGDSDNEEELVERLESEEEKLADWKKMACLLCRRQFPNKDALVRHQQLSDLHKQNMDIYRRSRLSEQELEALELREREMKYRDRAAERREKYGIPEPPEPKRKKQFDAGTVNYEQPTKDGIDHSNIGNKMLQAMGWREGSGLGRKCQGITAPIEAQVRLKGAGLGAKGSAYGLSGADSYKDAVRKAMFARFTEME

SEQ ID NO: 835986 - protein, 867 aa, Homo sapiens
MTWLQLTGKKKSHLVVLELVAFRIVLLRKNCNQIPFKNEFPSLSPQRTHPEAEGVGGRRNVKAFTLHKDGGLEEKGEAKPKDTMLRAKVRDSLRTERIVSSAFSSRLSHSGSLSMLNVRTSVSAGDTAWCKSAFSVVTAFSALPDSVYLYSASHSLTAYLKDWMGRVWWRWLVLPVCCPFNSRALIFPKCALPWENGHMFLTMGITNYFFFLQKKLVIQGKHIAMHYSNPRPKFEDWLCNKCCLNNFRKRLKCFRCGADKFDSEQEVPPGTTESVQSVDYYCDTIILRNIAPHTVVDSIMTALSPYASLAVNNIRLIKDKQTQQNRGFAFVQLSSAMDASQLLQILQSLHPPLKIDGKTIGVDFAKSARKDLVLSDGNRVSAFSVASTAIAAAQWSSTQSQSGEGGSVDYSYLQPGQDGYAQYAQYSQDYQQFYQQQAGGLESDASSASGTAVTTTSAAVVSQSPQLYNQTSNPPGSPTEEAQPSTSTSTQAPAASPTGVVPGTKYAVPDTSTYQYDESSGYYYDPTTGLYYDPNSQYYYNSLTQQYLYWDGEKETYVPAAESSSHQQSGLPPAKEGKEKKEKPKSKTAQQIAKDMERWAKSLNKQKENFKNSFQPVNSLREEERRESAAADAGFALFEKKGALAERQQLIPELVRNGDEENPLKRGLVAAYSGDSDNEEELVERLESEEEKLADWKKMACLLCRRQFPNKDALVRHQQLSDLHKQNMDIYRRSRLSEQELEALELREREMKYRDRAAERREKYGIPEPPEPKRKKQFDAGTVNYEQPTKDGIDHSNIGNKMLQAMGWREGSGLGRKCQGITAPIEAQVRLKGAGLGAKGSAYGLSGADSYKDAVRKAMFARFTEME

SEQ ID NO: 835987 - protein, 867 aa, Homo sapiens; identical to SEQ ID NO: 835986

SEQ ID NO: 835988 - protein, 216 aa, Homo sapiens
MTWLQLTGKKKSHLVVLELVAFRIVLLRKNCNQIPFKNEFPSLSPQRTHPEAEGVGGRRNVKAFTLHKDGGLEEKGEAKPKDTMLRAKVRDSLRTERIVSSAFSSRLSHSGSLSMLNVRTSVSAGDTAWCKSAFSVVTAFSALPDSVYLYSASHSLTAYLKDWMGRVWWRWLVLPVCCPFNSRALIFPKCALPWENGHMFLTMGITNYFFSYRKSW

SEQ ID NO: 835989 - protein, 770 aa, Homo sapiens
MTWLQLTGKKKSHLVVLELVAFRIVLLRKNCNQIPFKNEFPSLSPQRTHPEAEGVGGRRNVKAFTLHKDGGLEEKGEAKPKDTMLRAKVRDSLRTERIVSSAFSSRLSHSGSLSMLNVRTSVSAGDTAWCKSAFSVVTAFSALPDSVYLYSASHSLTAYLKDWMGRVWWRWLVLPVCCPFNSRALIFPKCALPWENGHMFLTMGITNYFFFLQKKLVIQGKHIAMHYSNPRPKFEDWLCNKCCLNNFRKRLKCFRCGADKFGKTGFSCLQYALKPTNWGREQWLTVIPPLCKAKVGRSLEDRSSIPAWQEIARPCLYKKRNFKFLGVVAHTCSPSYSGGLGERIAGVQELKAAVSYGHTTALQPGQQTRPCLSKKTKQKSDKVGLLTVSLRKSIDFSVLKQLVCFLYIFSLRLDNAAHDCESTESSFVFYELSLLTWFAFCICLSLVQGSVSPTVAQSLHSALTKSQLMRFYYRHKCLKKKKTMFCVVKIKTCGDFNVFLWWKYISCLSLIGSLSLLDSEQEVPPGTTESVQSVDYYCDTIILRNIAPHTVVDSIMTALSPYASLAVNNIRLIKDKQTQQNRGFAFVQLSSAMDASQLLQILQSLHPPLKIDGKTIGVDFAKSARKDLVLSDGNRVSAFSVASTAIAAAQWSSTQSQSGEGGSVDYSYLQPGQDGYAQYAQYSQDYQQFYQQQAGGLESDASSASGTAVTTTSAAVVSQSPQLYNQTSNPPGSPQYLTRPLTSMMNLQDITMIRQQGSIMTPTRNTTIIP

SEQ ID NO: 835990 - protein, 892 aa, Homo sapiens
MVAVDRKKKISFSCFRVGGIQNESLLRKNCNQIPFKNEFPSLSPQRTHPEAEGVGGRRNVKAFTLHKDGGTGEKGEAKPKDTMLRAKVRDSLRTERIVSSAFSSRLSHSGSLSMLNVRTSVSAGDTAWCKSAFSVVTAFSALPDSVYLYSASHSLTAYLKDWMGRVWWRWLVLPVCCPFNSRALIFPKCALPWENGHMFLTMGITNYFFFLQKKLVIQGKHIAMHYSNPRPKFEDWLCNKCCLNNFRKRLKCFRCGADKFDSEQEVPPGTTESVQSVDYYCDTIILRNIAPHTVVDSIMTALSPYASLAVNNIRLIKDKQTQQNRGFAFVQLSSAMDASQLLQILQSLHPPLKIDGKTIGVDFAKSARKDLVLSDGNRVSAFSVASTAIAAAQWSSTQSQSGEGGSVDYSYLQPGQDGYAQYAQYSQDYQQFYQQQAGGLESDASSASGTAVTTTSAAVVSQSPQLYNQTSNPPGSPTEEAQPSTSTSTQAPAASPTGVVPGTKYAVPDTSTYQYDESSGYYYDPTTGLYYDPNSQYYYNSLTQQYLYWDGEKETYVPAAESSSHQQSGLPPAKEGKEKKEKPKSKTAQQIAKDMERWAKSLNKQKENFKNSFQPVNSLREEERRESAAADAGFALFEKKGALAERQQLIPELVRNGDEENPLKRGLVAAYSGDSDNEEELVERLESEEEKLADWKKMACLLCRRQFPNKDALVRHQQLSDLHKQNMDIYRRSRLSEQELEALELREREMKYRDRAAERREKYGIPEPPEPKRKKQFDAGTVYVMCTFSSSYAGALAVLSNCVFATGRNYEQPTKDGIDHSNIGNKMLQAMGWREGSGLGRKCQGITAPIEAQVRLKGAGLGAKGSAYGLSGADSYKDAVRKAMFARFTEME

SEQ ID NO: 835991 - protein, 393 aa, Homo sapiens
RIVKMMSVEGRLMVDIARGAASPTGVVPGTKYAVPDTSTYQYDESSGYYYDPTTGLYYDPNSQYYYNSLTQQYLYWDGEKETYVPAAESSSHQQSGLPPAKEGKEKKEKPKSKTAQQIAKDMERWAKSLNKQKENFKNSFQPVNSLREEERRESAAADAGFALFEKKGALAERQQLIPELVRNGDEENPLKRGLVAAYSGDSDNEEELVERLESEEEKLADWKKMACLLCRRQFPNKDALVRHQQLSDLHKQNMDIYRRSRLSEQELEALELREREMKYRDRAAERREKYGIPEPPEPKRKKQFDAGTVNYEQPTKDGIDHSNIGNKMLQAMGWREGSGLGRKCQGITAPIEAQVRLKGAGLGAKGSAYGLSGADSYKDAVRKAMFARFTEME

SEQ ID NO: 835992 - protein, 867 aa, Homo sapiens; identical to SEQ ID NO: 835986

SEQ ID NO: 835993 - protein, 867 aa, Homo sapiens; identical to SEQ ID NO: 835986

SEQ ID NO: 835994 - protein, 143 aa, Homo sapiens
MGSDKRVSRTERSGRYGSIIDRDDRDERESRSRRRDSDYKRSSDDRRGDRYDDYRDYDSPERERERRNSDRSEDGYHSDGDYGEHDYRHDISDERESKTIMLRGLPITITESDIREMMESFEGPQPADVRLMKRKTGESLLSS

SEQ ID NO: 835995 - protein, 143 aa, Homo sapiens; identical to SEQ ID NO: 835994

SEQ ID NO: 835996 - protein, 143 aa, Homo sapiens; identical to SEQ ID NO: 835994

SEQ ID NO: 835997 - protein, 143 aa, Homo sapiens; identical to SEQ ID NO: 835994

SEQ ID NO: 835998 - protein, 143 aa, Homo sapiens; identical to SEQ ID NO: 835994

SEQ ID NO: 835999 - protein, 143 aa, Homo sapiens; identical to SEQ ID NO: 835994

SEQ ID NO: 836000 - protein, 143 aa, Homo sapiens; identical to SEQ ID NO: 835994

SEQ ID NO: 836001 - protein, 143 aa, Homo sapiens
MGSDKRVSRTERSGRYGSIIDRDDRDERESRSRRRDSDYKRSSDDRRGDRYDDYRDYDSPERERERRNSDRSEDGYHSDGDYGEHDYRHDISDERESKTIMLRGLPITITESDVRGNDSYNQQSVGTMNFELLPLFSHAIVLS

SEQ ID NO: 836002 - protein, 134 aa, Homo sapiens
MRHYFIQVHTTAIFLLYISSDLSSFCLQRGLVAAYSGDSDNEEELVERLESEEEKLADWKKMACLLCRRQFPNKDALVRHQQLSDLHKQNMDIYRRSRLSEQELEALELREREVNGKLCHKEEDIGIIAFSFYL

SEQ ID NO: 836003 - protein, 1123 aa, Homo sapiens
MTWLQLTGKKKSHLVVLELVAFRIVLLRKNCNQIPFKNEFPSLSPQRTHPEAEGVGGRRNVKAFTLHKDGGLEEKGEAKPKDTMLRAKVRDSLRTERIVSSAFSSRLSHSGSLSMLNVRTSVSAGDTAWCKSAFSVVTAFSALPDSVYLYSASHSLTAYLKDWMGRVWWRWLVLPVCCPFNSRALIFPKCALPWENGHMFLTMGITNYFFFLQKKLVIQGKHIAMHYSNPRPKFEDWLCNKCCLNNFRKRLKCFRCGADKFGKTGFSCLQYALKPTNWGREQWLTVIPPLCKAKVGRSLEDRSSIPAWQEIARPCLYKKRNFKFLGVVAHTCSPSYSGGLGERIAGVQELKAAVSYGHTTALQPGQQTRPCLSKKTKQKSDKVGLLTVSLRKSIDFSVLKQLVCFLYIFSLRLDNAAHDCESTESSFVFYELSLLTWFAFCICLSLVQGSVSPTVAQSLHSALTKSQLMRFYYRHKCLKKKKTMFCVVKIKTCGDFNVFLWWKYISCLSLIGSLSLLDSEQEVPPGTTESVQSVDYYCDTIILRNIAPHTVVDSIMTALSPYASLAVNNIRLIKDKQTQQNRGFAFVQLSSAMDASQLLQILQSLHPPLKIDGKTIGVDFAKSARKDLVLSDGNRVSAFSVASTAIAAAQWSSTQSQSGEGGSVDYSYLQPGQDGYAQYAQYSQDYQQFYQQQAGGLESDASSASGTAVTTTSAAVVSQSPQLYNQTSNPPGSPTEEAQPSTSTSTQAPAASPTGVVPGTKYAVPDTSTYQYDESSGYYYDPTTGLYYDPNSQYYYNSLTQQYLYWDGEKETYVPAAESSSHQQSGLPPAKEGKEKKEKPKSKTAQQIAKDMERWAKSLNKQKENFKNSFQPVNSLREEERRESAAADAGFALFEKKGALAERQQLIPELVRNGDEENPLKRGLVAAYSGDSDNEEELVERLESEEEKLADWKKMACLLCRRQFPNKDALVRHQQLSDLHKQNMDIYRRSRLSEQELEALELREREMKYRDRAAERREKYGIPEPPEPKRKKQFDAGTVNYEQPTKDGIDHSNIGNKMLQAMGWREGSGLGRKCQGITAPIEAQVRLKGAGLGAKGSAYGLSGADSYKDAVRKAMFARFTEME

SEQ ID NO: 836004 - protein, 1208 aa, Homo sapiens
MTWLQLTGKKKSHLVVLELVAFRIVLLRKNCNQIPFKNEFPSLSPQRTHPEAEGVGGRRNVKAFTLHKDGGLEEKGEAKPKDTMLRAKVRDSLRTERIVSSAFSSRLSHSGSLSMLNVRTSVSAGDTAWCKSAFSVVTAFSALPDSVYLYSASHSLTAYLKDWMGRVWWRWLVLPVCCPFNSRALIFPKCALPWENGHMFLTMGITNYFFFLQKKLVIQGKHIAMHYSNPRPKFEDWLCNKCCLNNFRKRLKCFRCGADKFDSEQEVPPGTTESVQSVDYYCDTIILRNIAPHTVVDSIMTALSPYASLAVNNIRLIKDKQTQQNRGFAFVQLSSAMDASQLLQILQSLHPPLKIDGKTIGVDFAKSARKDLVLSDGNRVSAFSVASTAIAAAQWSSTQSQSGEGGSVDYSYLQPGQDGYAQYAQYSQDYQQFYQQQAGGLESDASSASGTAVTTTSAAVVSQSPQLYNQTSNPPGSPTEEAQPSTSTSTQAPAASPTGVVPGTKYAVPDTSTYQYDESSGYYYDPTTGLYYDPNSQVNVLLSSSISLEVVSLSAFMRHKMKYFLQKNICLRLVLTSSKPPKCNFYMEIVSFNCRVKKCFEVIIYTQKNTQNRNVQFFECLYMSIHLYITCVYTPPCAQPSVLDISYKWSQTIDYLLCPASFTLPPCVFLRVEFEQMYGVMFYFWWHIELLKGKNNFNTPEITLFMTGSCIYRTVISIFNRNLALIGVVSERLKCEAVCDVPKQAKPLHTSSIHFSQFVKPGHLFPCQFFFFFFFFPVQFSLVALEVVSVAGITGMSHCSRLGTKLFKEIIFYFYSSSVTPLCQVVHHLYLYQGVPRVFSGQEISLVHNILYLFFDKICNRLTEQKVCINCFLFVVFYYYYNSLTQQYLYWDGEKETYVPAAESSSHQQSGLPPAKEGKEKKEKPKSKTAQQIAKDMERWAKSLNKQKENFKNSFQPVNSLREEERRESAAADAGFALFEKKGALAERQQLIPELVRNGDEENPLKRGLVAAYSGDSDNEEELVERLESEEEKLADWKKMACLLCRRQFPNKDALVRHQQLSDLHKQNMDIYRRSRLSEQELEALELREREMKYRDRAAERREKYGIPEPPEPKRKKQFDAGTVNYEQPTKDGIDHSNIGNKMLQAMGWREGSGLGRKCQGITAPIEAQVRLKGAGLGAKGSAYGLSGADSYKDAVRKAMFARFTEME

SEQ ID NO: 836005 - protein, 894 aa, Homo sapiens
MTWLQLTGKKKSHLVVLELVAFRIVLLRKNCNQIPFKNEFPSLSPQRTHPEAEGVGGRRNVKAFTLHKDGGLEEKGEAKPKDTMLRAKVRDSLRTERIVSSAFSSRLSHSGSLSMLNVRTSVSAGDTAWCKSAFSVVTAFSALPDSVYLYSASHSLTAYLKDWMGRVWWRWLVLPVCCPFNSRALIFPKCALPWENGHMFLTMGITNYFFFLQKKLVIQGKHIAMHYSNPRPKFEDWLCNKCCLNNFRKRLKCFRCGADKFDSEQEVPPGTTESVQSVDYYCDTIILRNIAPHTVVDSIMTALSPYASLAVNNIRLIKDKQTQQNRGFAFVQLSSAMDASQLLQILQSLHPPLKIDGKTIGVDFAKSARKDLVLSDGNRVSAFSVASTAIAAAQWSSTQSQSGEGGSVDYSYLQPGQDGYAQYAQYSQDYQQFYQQQAGGLESDASSASGTAVTTTSAAVVSQSPQLYNQTSNPPGSPTEEAQPSTSTSTQAPAASPTGVVPGTKYAVPDTSTYQYDESSGYYYDPTTGLYYDPNSQYYYNSLTQQYLYWDGEKETYVPAAESSSHQQSGLPPAKEGKEKKEKPKSKTAQQIAKDMERWAKSLNKQKENFKNSFQPVNSLREEERRESAAADAGFALFEKKVIAGMAKYVMMGTYLKLESHGLSSVSQGALAERQQLIPELVRNGDEENPLKRGLVAAYSGDSDNEEELVERLESEEEKLADWKKMACLLCRRQFPNKDALVRHQQLSDLHKQNMDIYRRSRLSEQELEALELREREMKYRDRAAERREKYGIPEPPEPKRKKQFDAGTVNYEQPTKDGIDHSNIGNKMLQAMGWREGSGLGRKCQGITAPIEAQVRLKGAGLGAKGSAYGLSGADSYKDAVRKAMFARFTEME

SEQ ID NO: 836006 - protein, 643 aa, Homo sapiens [sequence omitted]

SEQ ID NO: 836007 - protein, 568 aa, Homo sapiens
MTALSPYASLAVNNIRLIKDKQTQQNRGFAFVQLSSAMDASQLLQILQSLHPPLKIDGKTIGVDFAKSARKDLVLSDGNRVSAFSVASTAIAAAQWSSTQSQSGEGGSVDYSYLQPGQDGYAQYAQYSQDYQQFYQQQAGGLESDASSASGTAVTTTSAAVVSQSPQLYNQTSNPPGSPTEEAQPSTSTSTQAPAASPTGVVPGTKYAVPDTSTYQYDESSGYYYDPTTGLYYDPNSQYYYNSLTQQYLYWDGEKETYVPAAESSSHQQSGLPPAKEGKEKKEKPKSKTAQQIAKDMERWAKSLNKQKENFKNSFQPVNSLREEERRESAAADAGFALFEKKGALAERQQLIPELVRNGDEENPLKRGLVAAYSGDSDNEEELVERLESEEEKLADWKKMACLLCRRQFPNKDALVRHQQLSDLHKQNMDIYRRSRLSEQELEALELREREMKYRDRAAERREKYGIPEPPEPKRKKQFDAGTVNYEQPTKDGIDHSNIGNKMLQAMGWREGSGLGRKCQGITAPIEAQVRLKGAGLGAKGSAYGLSGADSYKDAVRKAMFARFTEME

SEQ ID NO: 836008 - protein, 395 aa, Homo sapiens
IPKYSLNCVLAGEQEHLQMNLQIGKYCYTTMLGMELQMPVFSHQGHLTRNHNKASFIPTKMVKMKKMDNNTGAHEDLNLRASLMGARCAQSSSHQQSGLPPAKEGKEKKEKPKSKTAQQIAKDMERWAKSLNKQKENFKNSFQPVNSLREEERRESAAADAGFALFEKKGALAERQQLIPELVRNGDEENPLKRGLVAAYSGDSDNEEELVERLESEEEKLADWKKMACLLCRRQFPNKDALVRHQQLSDLHKQNMDIYRRSRLSEQELEALELREREMKYRDRAAERREKYGIPEPPEPKRKKQFDAGTVNYEQPTKDGIDHSNIGNKMLQAMGWREGSGLGRKCQGITAPIEAQVRLKGAGLGAKGSAYGLSGADSYKDAVRKAMFARFTEME

SEQ ID NO: 836009 - protein, 867 aa, Homo sapiens; identical to SEQ ID NO: 835986

SEQ ID NO: 836010 - protein, 235 aa, Homo sapiens
RKCQGITAPIEAQVRLKGAGLGAKGAHMVCRAPIPTKMLSGKPCLPGSELVERLESEEEKLADWKKMACLLCRRQFPNKDALVRHQQLSDLHKQNMDIYRRSRLSEQELEALELREREMKYRDRAAERREKYGIPEPPEPKRKKQFDAGTVNYEQPTKDGIDHSNIGNKMLQAMGWREGSGLGRKCQGITAPIEAQVRLKGAGLGAKGSAYGLSGADSYKDAVRKAMFARFTEME

SEQ ID NO: 836011 - protein, 143 aa, Homo sapiens; identical to SEQ ID NO: 835994

SEQ ID NO: 836012 - protein, 143 aa, Homo sapiens; identical to SEQ ID NO: 835994

SEQ ID NO: 836013 - protein, 143 aa, Homo sapiens; identical to SEQ ID NO: 835994

SEQ ID NO: 836014 - protein, 89 aa, Homo sapiens
MLIVILFIVTQRERERRNSDRSEDGYHSDGDYGEHDYRHDISDERESKTIMLRGLPITITESDVRGNDSYNQQSVGTMNFELLPLFSHA

SEQ ID NO: 836015 - protein, 428 aa, Homo sapiens
QHAPQLEHRPSGWSHCKPPPHAPPPSLGARHAHASVAARPTPDVSPPRRPESVNMANEVIKCKAAVAWEAGKPLSIEEIEVAPPKAHEVRIKIIATAVCHTDAYTLSGADPEGCFPVILGHEGAGIVESVGEGVTKLKAGDTVIPLYIPQCGECKFCLNPKTNLCQKIRVTQGKGLMPDGTSRFTCKGKTILHYMGTSTFSEYTVVADISVAKIDPLAPLDKVCLLGCGISTGYGAAVNTAKLEPGSVCAVFGLGGVGLAVIMGCKVAGASRIIGVDINKDKFARAKEFGATECINPQDFSKPIQEVLIEMTDGGVDYSFECIGNVKVMRAALEACHKGWGVSVVVGVAASGEEIATRPFQLVTGRTWKGTAFGGWKSVESVPKLVSEYMSKKIKVDEFVTHNLSFDEINKAFELMHSGKSIRTVVKI

SEQ ID NO: 836016 - protein, 421 aa, Homo sapiens
QHAPQLEHRPSGWSHCKPPPHAPPPSLGARHAHASVAARPTPDVSPPRRPESVNMANEVIKCKAAVAWEAGKPLSIEEIEVAPPKAHEVRIKIIATAVCHTDAYTLSGADPEGCFPVILGHEGAGIVESVGEGVTKLKAGDTVIPLYIPQCGECKFCLNPKTNLCQKIRVTQGKGLMPDGTSRFTCKGKTILHYMGTSTFSEYTVVADISVAKIDPLAPLDKVCLLGCGISTGYGAAVNTAKLEPGSVCAVFGLGGVGLAVIMGCKVAGASRIIGVDINKDKFARAKEFGATECINPQDFSKPIQEVLIEMTDGGVDYSFECIGNVKVMRAALEACHKGWGVSVVVGVAASGEEIATRPFQLVTGRTWKGTAFGGWKSVESVPKLVSEYMSKKIKVDEFVTHNLSFDEINKAFELMHSGKR

SEQ ID NO: 836017 - protein, 428 aa, Homo sapiens; identical to SEQ ID NO: 836015

SEQ ID NO: 836018 - protein, 428 aa, Homo sapiens; identical to SEQ ID NO: 836015

SEQ ID NO: 836019 - protein, 421 aa, Homo sapiens; identical to SEQ ID NO: 836016

SEQ ID NO: 836020 - protein, 252 aa, Homo sapiens [sequence omitted]

SEQ ID NO: 836021 - protein, 365 aa, Homo sapiens
WPTGKESVYMANEVIKCKAAVAWEAGKPLSIEEIEVAPPKAHEVRIKIIATAVCHTDAYTLSGADPEGCFPVILGHEGAGIVESVGEGVTKLKAGDTVIPLYIPQCGECKFCLNPDGTSRFTCKGKTILHYMGTSTFSEYTVVADISVAKIDPLAPLDKVCLLGCGISTGYGAAVNTAKLEPGSVCAVFGLGGVGLAVIMGCKVAGASRIIGVDINKDKFARAKEFGATECINPQDFSKPIQEVLIEMTDGGVDYSFECIGNVKVMRAALEACHKGWGVSVVVGVAASGEEIATRPFQLVTGRTWKGTAFGGWKSVESVPKLVSEYMSKKIKVDEFVTHNLSFDEINKAFELMHSGKSIRTVVKI

SEQ ID NO: 836022 - protein, 347 aa, Homo sapiens
QHAPQLEHRPSGWSHCKPPPHAPPPSLGARHAHASVAARPTPDVSPPRRPESVNMANEVIKCKAAVAWEAGKPLSIEEIEVAPPKAHEVRIKIIATAVCHTDAYTLSGADPEGCFPVILGHEGAGIVESVGEGVTKLKAGDTVIPLYIPQCGECKFCLNPKTNLCQKIRVTQGKGLMPDGTSRFTCKGKTILHYMGTSTFSEYTVVADISVAKIDPLAPLDKVCLLGCGISTGYGAAVNTAKLEPGSVCAVFGLGGVGLAVIMGCKVAGASRIIGVDINKDKFARAKELGLDVYLRFCIPPGVLDDEGEAILSLEGAKRLGVRGQPWKPGESPPPGGQKGLGEEPPL

SEQ ID NO: 836023 - protein, 428 aa, Homo sapiens; identical to SEQ ID NO: 836015

SEQ ID NO: 836024 - protein, 428 aa, Homo sapiens; identical to SEQ ID NO: 836015

SEQ ID NO: 836025 - protein, 428 aa, Homo sapiens; identical to SEQ ID NO: 836015

SEQ ID NO: 836026 - protein, 421 aa, Homo sapiens; identical to SEQ ID NO: 836016

SEQ ID NO: 836027 - protein, 383 aa, Homo sapiens
WPTGKESVYMANEVIKCKAAVAWEAGKPLSIEEIEVAPPKAHEVRIKIIATAVCHTDAYTLSGADPEGCFPVILGHEGAGIVESVGEGVTKLKAGDTVIPLYIPQCGECKFCLNPKTNLCQKIRVTQGKGLMPDGTSRFTCKGKTILHYMGTSTFSEYTVVADISVAKIDPLAPLDKVCLLGCGISTGYGAAVNTAKLEPGSVCAVFGLGGVGLAVIMGCKVAGASRIIGVDINKDKFARAKEFGATECINPQDFSKPIQEVLIEMTDGGVDYSFECIGNVKVMRAALEACHKGWGVSVVVGVAASGEEIATRPFQLVTGRTWKGTAFGGWKSVESVPKLVSEYMSKKIKVDEFVTHNLSFDEINKAFELMHSGKSIRTVVKI

SEQ ID NO: 836028 - protein, 585 aa, Homo sapiens
WLFWLAFHPCSCTGLHLPAEGAAMNPLFGPNLFLLQQEQQGLAGPLGDSLGGDHFAGGGDLPPAPLSPAGPAAYSPPGPGPAPPAAMALRNDLGSNINVLKTLNLRFRCFLAKVHELERRNRLLEKQLQQALEEGKQGRRGLGRRDQAVQTGFVSPIRPLGLQLGARPAAVCSPSARVLGSPARSPAGPLAPSAASLSSSSTSTSTTYSSSARFMPGTIWSFSHARRLGPGLEPTLVQGPGLSWVHPDGVGVQIDTITPEIRALYNVLAKVKRERDEYKRRWEEEYTVRIQLQDRVNELQEEAQEADACQEELALKVEQLKAELVVFKGLMSNNLSELDTKIQEKAMKVDMDICRRIDITAKLCDVAQQRNCEDMIQMFQKLVPSMGGRKRERKAAVEEDTSLSESEGPRQPDGDEEESTALSINEEMQRMLNQLREYDFEDDCDSLTWEETEETLLLWEDFSGYAMAAAEAQGEQQEDSLEKVIKDTESLFKTREKEYQETIDQIELELATAKNDMNRHLHEYMEMCSMKRGLDVQMETCRRLITQSGDRKSPAFTAVPLSDPPPPPSEAEDSDRDVSSDSSMR

SEQ ID NO: 836029 - protein, 549 aa, Homo sapiens
LALLARLPSLLLHRSASPSRRRSHESVIRPQPLPPAAYSPPGPGPAPPAAMALRNDLGSNINVLKTLNLRFRCFLAKVHELERRNRLLEKQLQQALEEGKQGRRGLGRRDQAVQTGFVSPIRPLGLQLGARPAAVCSPSARVLGSPARSPAGPLAPSAASLSSSSTSTSTTYSSSARFMPGTIWSFSHARRLGPGLEPTLVQGPGLSWVHPDGVGVQIDTITPEIRALYNVLAKVKRERDEYKRRWEEEYTVRIQLQDRVNELQEEAQEADACQEELALKVEQLKAELVVFKGLMSNNLSELDTKIQEKAMKVDMDICRRIDITAKLCDVAQQRNCEDMIQMFQKLVPSMGGRKRERKAAVEEDTSLSESEGPRQPDGDEEESTALSINEEMQRMLNQLREYDFEDDCDSLTWEETEETLLLWEDFSGYAMAAAEAQGEQQEDSLEKVIKDTESLFKTREKEYQETIDQIELELATAKNDMNRHLHEYMEMCSMKRGLDVQMETCRRLITQSGDRKSPAFTAVPLSDPPPPPSEAEDSDRDVSSDSSMR

SEQ ID NO: 836030 - protein, 472 aa, Homo sapiens
WLFWLAFHPCSCTGLHLPAEGAAMNPLFGPNLFLLQQEQQGLAGPLGDSLGGDHFAGGGDLPPAPLSPAGPAAYSPPGPGPAPPAAMALRNDLGSNINVLKTLNLRFRCFLAKVHELERRNRLLEKQLQQALEEGKQGRRGLGRRDQAVQTGFVSPIRPLGLQLGARPAAVCSPSARVLGSPARSPAGPLAPSAASLSSSSTSTSTTYSSSARFMPGTIWSFSHARRLGPGLEPTLVQGPGLSWVHPDGVGVQIDTITPEIRALYNVLAKVKRERDEYKRRWEEEYTVRIQLQDRVNELQEEAQEADACQEELALKVEQLKAELVVFKGLMSNNLSELDTKIQEKAMKVDMDICRRIDITAKLCDVAQQRNCEDMIQMFQKKLVSLISRKLINVPVPVSKLPRPPGPQFGPAGLLSTDFFLPFPFSLLFPLFLSISCSLDCISFSPFSPGFPDLDVIQVLFCTHCTLILLAS

SEQ ID NO: 836031 - protein, 510 aa, Homo sapiens
WLFWLAFHPCSCTGLHLPAEGAAMNPLFGPNLFLLQQEQQGLAGPLGDSLGGDHFAGGGDLPPAPLSPAGPAAYSPPGPGPAPPAAMALRNDLGSNINVLKTLNLRFRCFLAKVHELERRNRLLEKQLQQALEEGKQGRRGLGRRDQAVQTGFVSPIRPLGLQLGARPAAVCSPSARVLGSPARSPAGPLAPSAASLSSSSTSTSTTYSSSARFMPGTIWSFSHARRLGPGLEPTLVQGPGLSWVHPDGVGVQIDTITPEIRALYNVLAKVKRERDEYKRRCFYRVEMIPQEAGQRARRALFWCGQEAGARICATEAGTMEYTGAGSMLQDLCNMSSSEEAQEADACQEELALKVEQLKAELVVFKGLMSNNLSELDTKIQEKAMKVDMDICRRIDITAKLCDVAQQRNCEDMIQMFQKKLVSLISRKLINVPVPVSKLPRPPGPQFGPAGLLSTDFFLPFPFSLLFPLFLSISCSLDCISFSPFSPGFPDLDVIQVLFCTHCTLILLAS

SEQ ID NO: 836032 - protein, 535 aa, Homo sapiens
WLFWLAFHPCSCTGLHLPAEGAAMNPLFGPNLFLLQQEQQGLAGPLGDSLGGDHFAGGGDLPPAPLSPAGPAAYSPPGPGPAPPAAMALRNDLGSNINVLKTLNLRFRCFLAKVHELERRNRLLEKQLQQALEEGKQGRRGLGRRDQAVQTGFVSPIRPLGLQLGARPAAVCSPSARVLGSPARSPAGPLAPSAASLSSSSTSTSTTYSSSARFMPGTIWSFSHARRLGPGLEPTLVQGPGLSWVHPDGVGVQIDTITPEIRALYNVLAKVKRERDEYKRRWEEEYTVRIQLQDRVNELQEEAQEADACQEELALKVEQLKAELVVFKGLMSNNLSELDTKIQEKAMKVDMDICRRIDITAKLCDVAQQRNCEDMIQMFQKLVPSMGGRKRERKAAVEEDTSLSESEGPRQPDGDEEESTALSINEEMQRMLNQLREYDFEDDCDSLTWEETEETLLLWEDFSGYAMAAAEAQGEQQEDSLEKVIKDTESLFKTREKEYQETIDQIELELAGQEEMTGTAEYLGCALNAAGLRWD

SEQ ID NO: 836033 - protein, 533 aa, Homo sapiens
WLFWLAFHPCSCTGLHLPAEGAAMNPLFGPNLFLLQQEQQGLAGPLGDSLGGDHFAGGGDLPPAPLSPAGPAAYSPPGPGPAPPAAMALRNDLGSNINVLKTLNLRFRCFLAKVHELERRNRLLEKQLQQALEEGKQGRRGLGRRDQAVQTGFVSPIRPLGLQLGARPAAVCSPSARVLGSPARSPAGPLAPSAASLSSSSTSTSTTYSSSARFMPGTIWSFSHARRLGPGLEPTLVQGPGLSWVHPDGVGVQIDTITPEIRALYNVLAKVKRERDEYKRRWEEEYTVRIQLQDRVNELQEEAQEADACQEELALKVEQLKAELVVFKGLMSNNLSELDTKIQEKAMKVDMDICRRIDITAKLCDVAQQRNCEDMIQMFQKLVPSMGGRKRERKAAVEEDTSLSESEGPRQPDGDEEESTALSINEEMQRMLNQLREYDFEDDCDSLTWEETEETLLLWEDFSGYAMAAAEAQGEQQEDSLEKVIKDTESLFKTREKEYQETIDQIEAKISRKSRGNNGVFAAFCLGLVYFKI

SEQ ID NO: 836034 - protein, 621 aa, Homo sapiens
WLFWLAFHPCSCTGLHLPAEGAAMNPLFGPNLFLLQQEQQGLAGPLGDSLGGDHFAGGGDLPPAPLSPAGPAAYSPPGPGPAPPAAMALRNDLGSNINVLKTLNLRFRCFLAKVHELERRNRLLEKQLQQALEEGKQGRRGLGRRDQAVQTGFVSPIRPLGLQLGARPAAVCSPSARVLGSPARSPAGPLAPSAASLSSSSTSTSTTYSSSARFMPGTIWSFSHARRLGPGLEPTLVQGPGLSWVHPDGVGVQIDTITPEIRALYNVLAKVKRERDEYKRRCFYRVEMIPQEAGQRARRALFWCGQEAGARICATEWWEEEYTVRIQLQDRVNELQEEAQEADACQEELALKVEQLKAELVVFKGLMSNNLSELDTKIQEKAMKVDMDICRRIDITAKLCDVAQQRNCEDMIQMFQKLVPSMGGRKRERKAAVEEDTSLSESEGPRQPDGDEEESTALSINEEMQRMLNQLREYDFEDDCDSLTWEETEETLLLWEDFSGYAMAAAEAQGEQQEDSLEKVIKDTESLFKTREKEYQETIDQIELELATAKNDMNRHLHEYMEMCSMKRGLDVQMETCRRLITQSGDRKSPAFTAVPLSDPPPPPSEAEDSDRDVSSDSSMR

SEQ ID NO: 836035 - protein, 585 aa, Homo sapiens
LALLARLPSLLLHRSASPSRRRSHESVIRPQPLPPAAYSPPGPGPAPPAAMALRNDLGSNINVLKTLNLRFRCFLAKVHELERRNRLLEKQLQQALEEGKQGRRGLGRRDQAVQTGFVSPIRPLGLQLGARPAAVCSPSARVLGSPARSPAGPLAPSAASLSSSSTSTSTTYSSSARFMPGTIWSFSHARRLGPGLEPTLVQGPGLSWVHPDGVGVQIDTITPEIRALYNVLAKVKRERDEYKRRCFYRVQMIPQEAGQRARRALFWCGQEAGARICATERWEEEYTVRIQLQDRVNELQEEAQEADACQEELALKVEQLKAELVVFKGLMSNNLSELDTKIQEKAMKVDMDICRRIDITAKLCDVAQQRNCEDMIQMFQKLVPSMGGRKRERKAAVEEDTSLSESEGPRQPDGDEEESTALSINEEMQRMLNQLREYDFEDDCDSLTWEETEETLLLWEDFSGYAMAAAEAQGEQQEDSLEKVIKDTESLFKTREKEYQETIDQIELELATAKNDMNRHLHEYMEMCSMKRGLDVQMETCRRLITQSGDRKSPAFTAVPLSDPPPPPSEAEDSDRDVSSDSSMR

SEQ ID NO: 836036 - protein, 383 aa, Homo sapiens
WLFWLAFHPCSCTGLHLPAEGAAMNPLFGPNLFLLQQEQQGLAGPLGDSLGGDHFAGGGDLPPAPLSPAGPAAYSPPGPGPAPPAAMALRNDLGSNINVLKTLNLRFRCFLAKVHELERRNRLLEKQLQQALEEGKQGRRGLGRRDQAVQTGFVSPIRPLGLQLGARPAAVCSPSARVLGSPARSPAGPLAPSAASLSSSSTSTSTTYSSSARFMPGTIWSFSHARRLGPGLEPTLVQGPGLSWVHPDGVGVQIDTITPEIRALYNVLAKVKRERDEYKRRWEEEYTVRIQLQDRVNELQEEAQEADACQEELALKVEQLKAELVVFKGLMSNNLSELDTKIQEKAMKVDMDICRRIDITAKLCDVAQQRNCEDMIQMFQIWM

SEQ ID NO: 836037 - protein, 129 aa, Homo sapiens [sequence omitted]

SEQ ID NO: 836038 - protein, 434 aa, Homo sapiens
MESELDLNDIIQEMHVVATMPDLYHLLVELNAVQSLLGLLGHDNTDILSDLTSVGELDMVDGQVVALLVQNLERLDESVKEEADGVHNTLAIVENMAEFRPEMCTEGAQQGLLQWLLKRLKAKMPFDANKLYCSEVLAILLQDNDENRELLGELDGIDVLLQQLSVFKRHNPSTAEEQEMMENLFDSLCSCLMLSSNRERFLKGEGLQLMNLMLREKKISRSSALKVLDHAMIGPEGTDNCHKFVDILGLRTIFPLFMKSPRKIKKVGTTEKEHEEHVCSILASLLRNLRGQQRTRLLNKFTENDSEKVDRLMELHFKYLGAMQVADKKIEGEKHDMVRRGEIIDNDTEEEFYLRRLDAGLFVLQHICYIMAEICNANVPQIRQRVHQILNMRGSSIKIVRHIIKEYAENIGDGRSPEFRENEQKRILGLLENF

SEQ ID NO: 836039 - protein, 179 aa, Homo sapiens
MRRKQTGTRERGRYREEEMTVVEEADDDKKRLLQIIDRDGEEEEEEEEPLDESSVKKMILTFEKRSYKNQELRIKFPDNPEKFMESELDLNDIIQEMHVVATMPDLYHLLVELNAVQSLLGLLGHDNTDVSIAVVDLLQELTDIDTLHESEEGAEVLIDALGWARWLALVGNRILERLG

SEQ ID NO: 836040 - protein, 59 aa, Homo sapiens
MAEICNANVPQIRQRVHQILNMRGSSIKIVRHIIKEYAENIGDGRKERTAILVRTVTIR

SEQ ID NO: 836041 - protein, 563 aa, Homo sapiens
MDVGELLSYQPNRGTKRPRDDEEEEQKMRRKQTGTRERGRYREEEMTVVEEADDDKKRLLQIIDRDGEEEEEEEEPLDESSVKKMILTFEKRSYKNQELRIKFPDNPEKFMESELDLNDIIQEMHVVATMPDLYHLLVELNAVQSLLGLLGHDNTDVSIAVVDLLQELTDIDTLHESEEGAEVLIDALVDGQVVALLVQNLERLDESVKEEADGVHNTLAIVENMAEFRPEMCTEGAQQGLLQWLLKRLKAKMPFDANKLYCSEVLAILLQDNDENRELLGELDGIDVLLQQLSVFKRHNPSTAEEQEMMENLFDSLCSCLMLSSNRERFLKGEGLQLMNLMLREKKISRSSALKVLDHAMIGPEGTDNCHKFVDILGLRTIFPLFMKSPRKIKKVGTTEKEHEEHVCSILASLLRNLRGQQRTRLLNKFTENDSEKVDRLMELHFKYLGAMQVADKKIEGEKHDMVRRGEIIDNDTEEEFYLRRLDAGLFVLQHICYIMAEICNANVPQIRQRVHQILNMRGSSIKIVRHIIKEYAENIGDGRSPEFRENEQKRILGLLENF

SEQ ID NO: 836042 - protein, 563 aa, Homo sapiens; identical to SEQ ID NO: 836041

SEQ ID NO: 836043 - protein, 563 aa, Homo sapiens; identical to SEQ ID NO: 836041

SEQ ID NO: 836044 - protein, 536 aa, Homo sapiens
MRRKQTGTRERGRYREEEMTVVEEADDDKKRLLQIIDRDGEEEEEEEEPLDESSVKKMILTFEKRSYKNQELRIKFPDNPEKFMESELDLNDIIQEMHVVATMPDLYHLLVELNAVQSLLGLLGHDNTDVSIAVVDLLQELTDIDTLHESEEGAEVLIDALVDGQVVALLVQNLERLDESVKEEADGVHNTLAIVENMAEFRPEMCTEGAQQGLLQWLLKRLKAKMPFDANKLYCSEVLAILLQDNDENRELLGELDGIDVLLQQLSVFKRHNPSTAEEQEMMENLFDSLCSCLMLSSNRERFLKGEGLQLMNLMLREKKISRSSALKVLDHAMIGPEGTDNCHKFVDILGLRTIFPLFMKSPRKIKKVGTTEKEHEEHVCSILASLLRNLRGQQRTRLLNKFTENDSEKVDRLMELHFKYLGAMQVADKKIEGEKHDMVRRGEIIDNDTEEEFYLRRLDAGLFVLQHICYIMAEICNANVPQIRQRVHQILNMRGSSIKIVRHIIKEYAENIGDGRSPEFRENEQKRILGLLENF

SEQ ID NO: 836045 - protein, 473 aa, Homo sapiens
MDVGELLSYQPNRGTKRPRDDEEEEQKMRRKQTGTRERGRYREEEMTVVEEADDDKKRLLQIIDRDGEEEEEEEEPLDESSVKKMILTFEKRSYKNQELRIKFPDNPEKFMESELDLNDIIQEMHVVATMPDLYHLLVELNAVQSLLGLLGHDNTDVSIAVVDLLQELTDIDTLHESEEGAEVLIDALVDGQVVALLVQNLERLDESVKEEADGVHNTLAIVENMAEFRPEMCTEGAQQGLLQWLLKRLKAKMPFDANKLYCSEVLAILLQDNDENRELLGELDGIDVLLQQLSVFKRHNPSTAEEQEMMENLFDSLCSCLMLSSNRERFLKGEGLQLMNLMLREKKISRSSALKVLDHAMIGPEGTDNCHKFVDILGLRTIFPLFMKSPRKIKKVGTTEKEHEEHVCSILASLLRNLRGQQRTRLLNKFTENDSEKVDRLMELHFKYLGAMQVADKKIEGEKHVCIPASLLP

SEQ ID NO: 836046 - protein, 455 aa, Homo sapiens
MFMESELDLNDIIQEMHVVATMPDLYHLLVELNAVQSLLGLLGHDNTDVSIAVVDLLQELTDIDTLHESEEGAEVLIDALVDGQVVALLVQNLERLDESVKEEADGVHNTLAIVENMAEFRPEMCTEGAQQGLLQWLLKRLKAKMPFDANKLYCSEVLAILLQDNDENRELLGELDGIDVLLQQLSVFKRHNPSTAEEQEMMENLFDSLCSCLMLSSNRERFLKGEGLQLMNLMLREKKISRSSALKVLDHAMIGPEGTDNCHKFVDILGLRTIFPLFMKSPRKIKKVGTTEKEHEEHVCSILASLLRNLRGQQRTRLLNKFTENDSEKVDRLMELHFKYLGAMQVADKKIEGEKHDMVRRGEIIDNDTEEEFYLRRLDAGLFVLQHICYIMAEICNANVPQIRQRVHQILNMRGSSIKIVRHIIKEYAENIGDGRSPEFRENEQKRILGLLENF

SEQ ID NO: 836047 - protein, 501 aa, Homo sapiens
MDVGELLSYQPNRGTKRPRDDEEEEQKMRRKQTGTRERGRYREEEMTVVEEADDDKKRLLQIIDRDGEEEEEEEEPLDESSVKKMILTFEKRSYKNQELRIKFPDNPEKFMESELDLNDIIQEMHVVATMPDLYHLLVELNAVQSLLGLLGHDNTDVSIAVVDLLQELTDIDTLHESEEGAEVLIDALAKMPFDANKLYCSEVLAILLQDNDENRELLGELDGIDVLLQQLSVFKRHNPSTAEEQEMMENLFDSLCSCLMLSSNRERFLKGEGLQLMNLMLREKKISRSSALKVLDHAMIGPEGTDNCHKFVDILGLRTIFPLFMKSPRKIKKVGTTEKEHEEHVCSILASLLRNLRGQQRTRLLNKFTENDSEKVDRLMELHFKYLGAMQVADKKIEGEKHDMVRRGEIIDNDTEEEFYLRRLDAGLFVLQHICYIMAEICNANVPQIRQRVHQILNMRGSSIKIVRHIIKEYAENIGDGRSPEFRENEQKRILGLLENF

SEQ ID NO: 836048 - protein, 84 aa, Homo sapiens
MDVGELLSYQPNRGTKRPRDDEEEEQKMRRKQTGTRERGRYREEEMTVVEEADDDKKRLLQIIDRSRAEDVDAAANLVVVVGGR

SEQ ID NO: 836049 - protein, 235 aa, Homo sapiens
MDVGELLSYQPNRGTKRPRDDEEEEQKMRRKQTGTRERGRYREEEMTVVEEADDDKKRLLQIIDRDGEEEEEEEEPLDESSVKKMILTFEKRSYKNQELRIKFPDNPEKFMESELDLNDIIQEMHVVATMPDLYHLLVELNAVQSLLGLLGHDNTDVSIAVVDLLQELTDIDTLHESEEGAEVLIDALVDGQVVALLVQNLERLDESVKEEADGVHNTLAIVGNMAEFRPVLGIL

SEQ ID NO: 836050 - protein, 112 aa, Homo sapiens
MQVADKKIEGEKHDMVRRGEIIDNDTEEEFYLRRLDAGLFVLQHICYIMAEICNANVPQIRQRVHQILNMRGSSIKIVRHIIKEYAENIGDGRSPEFRENEQKRILGLLENF

SEQ ID NO: 836051 - protein, 563 aa, Homo sapiens; identical to SEQ ID NO: 836041

SEQ ID NO: 836052 - protein, 563 aa, Homo sapiens; identical to SEQ ID NO: 836041

SEQ ID NO: 836053 - protein, 536 aa, Homo sapiens; identical to SEQ ID NO: 836044

SEQ ID NO: 836054 - protein, 558 aa, Homo sapiens
MDVGELLSYQPNRGTKRPRDDEEEEQKMRRKQTGTRERGRYREEEMTVVEEADDDKKRLLQIIDRDGEEEEEEEEPLDESSVKKMILTFEKRSYKNQELRIKFPDNPEKFMESELDLNDIIQEMHVVATMPDLYHLLVELNAVQSLLGLLGHDNTDVSIAVVDLLQELTDIDTLHESEEGAEVLIDALVDGQVVALLVQNLERLDESVKEEADGVHNTLAIVENMAEFRPEMCTEGAQQGLLQWLLKRLKAKMPFDANKLYCSEVLAILLQDNDENRELLGELDGIDVLLQQLSVFKRHNPSTAEEQEMMENLFDSLCSCLMLSSNRERFLKGEGLQLMNLMLREKKISRSSALKVLDHAMIGPEGTDNCHKFVDILGLRTIFPLFMKSPRKIKKVGTTEKEHEEHVCSILASLLRNLRGQQRTRLLNKFTENDSEKVDRLMELHFKYLGAMQVADKKIEGEKHDMVRRGEIIDNDTEEEFYLRRLDAGLFVLQHICYIMAEICNANVPQIRQRVHQILNMRGSSIKIVRHIIKEYAENIGDGRKERTAILVRTVTIR

SEQ ID NO: 836055 - protein, 453 aa, Homo sapiens
MESELDLNDIIQEMHVVATMPDLYHLLVELNAVQSLLGLLGHDNTDVSIAVVDLLQELTDIDTLHESEEGAEVLIDALVDGQVVALLVQNLERLDESVKEEADGVHNTLAIVENMAEFRPEMCTEGAQQGLLQWLLKRLKAKMPFDANKLYCSEVLAILLQDNDENRELLGELDGIDVLLQQLSVFKRHNPSTAEEQEMMENLFDSLCSCLMLSSNRERFLKGEGLQLMNLMLREKKISRSSALKVLDHAMIGPEGTDNCHKFVDILGLRTIFPLFMKSPRKIKKVGTTEKEHEEHVCSILASLLRNLRGQQRTRLLNKFTENDSEKVDRLMELHFKYLGAMQVADKKIEGEKHDMVRRGEIIDNDTEEEFYLRRLDAGLFVLQHICYIMAEICNANVPQIRQRVHQILNMRGSSIKIVRHIIKEYAENIGDGRSPEFRENEQKRILGLLENF

SEQ ID NO: 836056 - protein, 337 aa, Homo sapiens
MDVGELLSYQPNRGTKRPRDDEEEEQKMRRKQTGTRERGRYREEEMTVVEEADDDKKRLLQIIDRDGEEEEEEEEPLDESSVKKMILTFEKRSYKNQELRIKFPDNPEKFMESELDLNDIIQEMHVVATMPDLYHLLVELNAVQSLLGLLGHDNTDVSIAVVDLLQELTDIDTLHESEEGAEVLIDALVDGQVVALLVQNLERLDESVKEEADGVHNTLAIVENMAEFRPEMCTEGAQQGLLQWLLKRLKAKMPFDANKLYCSEVLAILLQDNDENRELLGELDGIDVLLQQLSVFKRHNPSTAEEQEMMENLFDSLCSCLMLSSNRERFLKGEGLQ

SEQ ID NO: 836057 - protein, 184 aa, Homo sapiens
SIMCAHFLDLPGRFHKVGTTEKEHEEHVCSILASLLRNLRGQQRTRLLNKFTENDSEKVDRLMELHFKYLGAMQVADKKIEGEKHDMVRRGEIIDNDTEEEFYLRRLDAGLFVLQHICYIMAEICNANVPQIRQRVHQILNMRGSSIKIVRHIIKEYAENIGDGRSPEFRENEQKRILGLLENF

SEQ ID NO: 836058 - protein, 500 aa, Homo sapiens
HGGGALGGTGPQLSGLPGNLAPRAWSRDLVGRSPPLAAAAPDSASAVFSPSGPAAAGNDAGAPTATAPGGEGEPHSRPCDARLGSTDKELKAGAAATGSAPTAPGTPWQREPRVEVMDPAGGPRGVLPRPCRVLVLLNPRGGKGKALQLFRSHVQPLLAEAEISFTLMLTERRNHARELVRSEELGRWDALVVMSGDGLMHEVVNGLMERPDWETAIQKPLCSLPAGSGNALAASLNHYAGYEQVTNEDLLTNCTLLLCRRLLSPMNLLSLHTASGLRLFSVLSLAWGFIADVDLESEKYRRLGEMRFTLGTFLRLAALRTYRGRLAYLPVGRVGSKTPASPVVVQQGPVDAHLVPLEEPVPSHWTVVPDEDFVLVLALLHSHLGSEMFAAPMGRCAAGVMHLFYVRAGVSRAMLLRLFLAMEKGRHMEYECPYLVYVPVVAFRLEPKDGKGVFAVDGELMVSEAVQGQVHPNYFWMVSGCVEPPPSWKPQQMPPPEEPL

SEQ ID NO: 836059 - protein, 398 aa, Homo sapiens
MDPVVGCGRGLFGFVFSAGGPRGVLPRPCRVLVLLNPRGGKGKALQLFRSHVQPLLAEAEISFTLMLTERRNHARELVRSEELGRWDALVVMSGDGLMHEVVNGLMERPDWETAIQKPLCSLPAGSGNALAASLNHYAGYEQVTNEDLLTNCTLLLCRRLLSPMNLLSLHTASGLRLFSVLSLAWGFIADVDLESEKYRRLGEMRFTLGTFLRLAALRTYRGRLAYLPVGRVGSKTPASPVVVQQGPVDAHLVPLEEPVPSHWTVVPDEDFVLVLALLHSHLGSEMFAAPMGRCAAGVMHLFYVRAGVSRAMLLRLFLAMEKGRHMEYECPYLVYVPVVAFRLEPKDGKGVFAVDGELMVSEAVQGQVHPNYFWMVSGCVEPPPSWKPQQMPPPEEPL

SEQ ID NO: 836060 - protein, 384 aa, Homo sapiens
MDPAGGPRGVLPRPCRVLVLLNPRGGKGKALQLFRSHVQPLLAEAEISFTLMLTERRNHARELVRSEELGRWDALVVMSGDGLMHEVVNGLMERPDWETAIQKPLCSLPAGSGNALAASLNHYAGYEQVTNEDLLTNCTLLLCRRLLSPMNLLSLHTASGLRLFSVLSLAWGFIADVDLESEKYRRLGEMRFTLGTFLRLAALRTYRGRLAYLPVGRVGSKTPASPVVVQQGPVDAHLVPLEEPVPSHWTVVPDEDFVLVLALLHSHLGSEMFAAPMGRCAAGVMHLFYVRAGVSRAMLLRLFLAMEKGRHMEYECPYLVYVPVVAFRLEPKDGKGVFAVDGELMVSEAVQGQVHPNYFWMVSGCVEPPPSWKPQQMPPPEEPL

SEQ ID NO: 836061 - protein, 384 aa, Homo sapiens; identical to SEQ ID NO: 836060

SEQ ID NO: 836062 - protein, 195 aa, Homo sapiens
MRFTLGTFLRLAALRTYRGRLAYLPVGRVGSKTPASPVVVQQGPVDAHLVPLEEPVPSHWTVVPDEDFVLVLALLHSHLGSEMFAAPMGRCAAGVMHLFYVRAGVSRAMLLRLFLAMEKGRHMEYECPYLVYVPVVAFRLEPKDGKGVFAVDGELMVSEAVQGQVHPNYFWMVSGCVEPPPSWKPQQMPPPEEPL

SEQ ID NO: 836063 - protein, 384 aa, Homo sapiens; identical to SEQ ID NO: 836060

SEQ ID NO: 836064 - protein, 470 aa, Homo sapiens
MSAQVLGFLRSWTPLPLAAPRGPAAAGNDAGAPTATAPGGEGEPHSRPCDARLGSTDKELKAGAAATGSAPTAPGTPWQREPRVEVMDPAGGPRGVLPRPCRVLVLLNPRGGKGKALQLFRSHVQPLLAEAEISFTLMLTERRNHARELVRSEELGRWDALVVMSGDGLMHEVVNGLMERPDWETAIQKPLCSLPAGSGNALAASLNHYAGYEQVTNEDLLTNCTLLLCRRLLSPMNLLSLHTASGLRLFSVLSLAWGFIADVDLESEKYRRLGEMRFTLGTFLRLAALRTYRGRLAYLPVGRVGSKTPASPVVVQQGPVDAHLVPLEEPVPSHWTVVPDEDFVLVLALLHSHLGSEMFAAPMGRCAAGVMHLFYVRAGVSRAMLLRLFLAMEKGRHMEYECPYLVYVPVVAFRLEPKDGKGVFAVDGELMVSEAVQGQVHPNYFWMVSGCVEPPPSWKPQQMPPPEEPL

SEQ ID NO: 836065 - protein, 384 aa, Homo sapiens; identical to SEQ ID NO: 836060

SEQ ID NO: 836066 - protein, 431 aa, Homo sapiens
MSAQVLGFLRSWTPLPLAAPRGPAAAGNDAGAPTATAPGGEGEPHSRPCDARLGSTDKELKAGAAATGSAPTAPGTPLQLFRSHVQPLLAEAEISFTLMLTERRNHARELVRSEELGRWDALVVMSGDGLMHEVVNGLMERPDWETAIQKPLCSLPAGSGNALAASLNHYAGYEQVTNEDLLTNCTLLLCRRLLSPMNLLSLHTASGLRLFSVLSLAWGFIADVDLESEKYRRLGEMRFTLGTFLRLAALRTYRGRLAYLPVGRVGSKTPASPVVVQQGPVDAHLVPLEEPVPSHWTVVPDEDFVLVLALLHSHLGSEMFAAPMGRCAAGVMHLFYVRAGVSRAMLLRLFLAMEKGRHMEYECPYLVYVPVVAFRLEPKDGKGVFAVDGELMVSEAVQGQVHPNYFWMVSGCVEPPPSWKPQQMPPPEEPL

SEQ ID NO: 836067 - protein, 55 aa, Homo sapiens
SKPIRSQKTVTKPFGGLSDAASLGFLSQRTVGQRTVTHGIEKELSICQSCPYGAL

SEQ ID NO: 836068 - protein, 576 aa, Homo sapiens
MSTSSLRRQMKNIVHNYSEAEIKVREATSNDPWGPSSSLMSEIADLTYNVVAFSEIMSMIWKRLNDHGKNWRHVYKAMTLMEYLIKTGSERVSQQCKENMYAVQTLKDFQYVDRDGKDQGVNVREKAKQLVALLRDEDRLREERAHALKTKEKLAQTATASSAAVGSGPPPEAEQAWPQSSGEEELQLQLALAMSKEEADQPPSCGPEDDAQLQLALSLSREEHDKEERIRRGDDLRLQMAIEESKRETGGKEESSLMDLADVFTAPAPAPTTDPWGGPAPMAAAVPTAAPTSDPWGGPPVPPAADPWGGPAPTPASGDPWRPAAPAGPSVDPWGGTPAPAAGEGPTPDPWGSSDGGVPVSGPSASDPWTPAPAFSDPWGGSPAKPSTNGTTAAGGFDTEPDEFSDFDRLRTALPTSGSSAGELELLAGEVPARSPGAFDMSGVRGSLAEAVGSPPPAATPTPTPPTRKTPESFLGPNAALVDLDSLVSRPGPTPPGAKASNPFLPGGGPATGPSVTNPFQPAPPATLTLNQLRLSPVPPVPGAPPTYISPLGGGPGLPPMMPPGPPAPNTNPFLL

SEQ ID NO: 836069 - protein, 576 aa, Homo sapiens; identical to SEQ ID NO: 836068

SEQ ID NO: 836070 - protein, 576 aa, Homo sapiens; identical to SEQ ID NO: 836068

SEQ ID NO: 836071 - protein, 443 aa, Homo sapiens
MSTSSLRRQMKNIVHNYSEAEIKVREATSNDPWGPSSSLMSEIADLTYNVVAFSEIMSMIWKRLNDHGKNWRHVYKAMTLMEYLIKTGSERVSQQCKENMYAVQTLKDFQYVDRDGKDQGVNVREKAKQLVALLRDEDRLREERAHALKTKEKLAQTATASSAAVGSGPPPEAEQAWPQSSGEEELQLQLALAMSKEEADQPPSCGPEDDAQLQLALSLSREEHDKEERIRRGDDLRLQMAIEESKRETGGKEESSLMDLADVFTAPAPAPTTDPWGGPAPMAAAVPTAAPTSDPWGGPPVPPAADPWGGPAPTPASGDPWRPAAPAGPSVDPWGGTPAPAAGEGPTPDPWGSSDGGVPVSGPSASDPWTPAPAFSDPWGGSPAKPSTNGTTAAGGFDTEPDEFSDFDRLRTALPTSGSSAAYWTRLPPGFYSLNSYRSCFIR

SEQ ID NO: 836072 - protein, 223 aa, Homo sapiens
MSTSSLRRQMKNIVHNYSEAEIKVREATSNDPWGPSSSLMSEIADLTYNVVAFSEIMSMIWKRLNDHGKNWRHVYKAMTLMEYLIKTGSERVSQQCKENMYAVQTLKDFQYVDRDGKDQGVNVREKAKQLVALLRDEDRLREERAHALKTKEKLAQTATASSAVVGSWPHPRRTRLAESTGGRPESSWPGMTGGATTRLWPRKQVKAYAENKREAQEPRKERT

SEQ ID NO: 836073 - protein, 662 aa, Homo sapiens
MGDQSWLWNQAAPGVRSPVFACSVEKGNVPLVLSEHLAHSRDPGSGAVRFLISPEPWASAILGTSGLLASPVLPAALDAVTCQHLPQPSSGSRPISPRIGALCPLLLQPGTMSTSSLRRQMKNIVHNYSEAEIKVREATSNDPWGPSSSLMSEIADLTYNVVAFSEIMSMIWKRLNDHGKNWRHVYKAMTLMEYLIKTGSERVSQQCKENMYAVQTLKDFQYVDRDGKDQGVNVREKAKQLVALLRDEDRLREERAHALKTKEKLAQTATASSAAVGSGPPPEAEQAWPQSSGEEELQLQLALAMSKEEADQEERIRRGDDLRLQMAIEESKRETGGKEESSLMDLADVFTAPAPAPTTDPWGGPAPMAAAVPTAAPTSDPWGGPPVPPAADPWGGPAPTPASGDPWRPAAPAGPSVDPWGGTPAPAAGEGPTPDPWGSSDGGVPVSGPSASDPWTPAPAFSDPWGGSPAKPSTNGTTAAGGFDTEPDEFSDFDRLRTALPTSGSSAGELELLAGEVPARSPGAFDMSGVRGSLAEAVGSPPPAATPTPTPPTRKTPESFLGPNAALVDLDSLVSRPGPTPPGAKASNPFLPGGGPATGPSVTNPFQPAPPATLTLNQLRLSPVPPVPGAPPTYISPLGGGPGLPPMMPPGPPAPNTNPFLL

SEQ ID NO: 836074 - protein, 665 aa, Homo sapiens
MSTSSLRRQMKNIVHNYSEAEIKVREATSNDPWGPSSSLMSEIADLTYNVVAFSEIMSMIWKRLNDHGKNWRHVYKAMTLMEYLIKTGSERVSQQCKENMYAVQTLKDFQYVDRDGKDQGVNVREKAKQLVALLRDEDRLREERAHALKTKEKLAQTATASSAAVGSGPPPEAEQAWPQSSGEEELQLQLALAMSKEEADQPPSCGPEDDAQLQLALSLSREEHDKEERIRRGDDLRLQMAIEESKRETGGKEESSLMDLADVFTAPAPAPTTDPWGGPAPMAAAVPTAAPTSDPWGGPPVPPAADPWGGPAPTPASGDPWRPAAPAGPSVDPWGGTPAPAAGEGPTPDPWGSSDGGVPVSGPSASDPWTPAPAFSDPWGGSPAKPSTNGTTAAGGFDTEPDEFSDFDRLRTALPTSGSSAGELELLAGEVPARSPGAFDMSGVRGSLAEAVGSPPPAATPTPTPPTRKTPESFLGPNAALVDLDSLVSRPGPTPPGAKASNPFLPGGGPATGPSVTNPFQPAPPATLTLNQLRLSPVPPVPGAPPTAEGGLAPSGCPIPAPWEISVVSACEMGDPHPQCPSPSWGPLTLHPLPFPPHLPGEKLDMGPGEGSWPEEDPFPVALEGGGVAGAPTHSPSLQTPNPQSVFEPPRSPHAPAHAPSVNPW

SEQ ID NO: 836075 - protein, 689 aa, Homo sapiens
ASFCCFPSPRRLPSPARLSAPLLGGGAAEPSACGPPCVRACARGPAHVPRHRGRAGQGADRHDPPEPGVRGPRGPLPLADAVTCQHLPQPSSGSRPISPRIGALCPLLLQPGTMSTSSLRRQMKNIVHNYSEAEIKVREATSNDPWGPSSSLMSEIADLTYNVVAFSEIMSMIWKRLNDHGKNWRHVYKAMTLMEYLIKTGSERVSQQCKENMYAVQTLKDFQYVDRDGKDQGVNVREKAKQLVALLRDEDRLREERAHALKTKEKLAQTATASSAAVGSGPPPEAEQAWPQSSGEEELQLQLALAMSKEEADQPPSCGPEDDAQLQLALSLSREEHDKEERIRRGDDLRLQMAIEESKRETGGKEESSLMDLADVFTAPAPAPTTDPWGGPAPMAAAVPTAAPTSDPWGGPPVPPAADPWGGPAPTPASGDPWRPAAPAGPSVDPWGGTPAPAAGEGPTPDPWGSSDGGVPVSGPSASDPWTPAPAFSDPWGGSPAKPSTNGTTAAGGFDTEPDEFSDFDRLRTALPTSGSSAGELELLAGEVPARSPGAFDMSGVRGSLAEAVGSPPPAATPTPTPPTRKTPESFLGPNAALVDLDSLVSRPGPTPPGAKASNPFLPGGGPATGPSVTNPFQPAPPATLTLNQLRLSPVPPVPGAPPTYISPLGGGPGLPPMMPPGPPAPNTNPFLL

SEQ ID NO: 836076 - protein, 260 aa, Homo sapiens
MSTSSLRRQMKNIVHNYSEAEIKVREATSNDPWGPSSSLMSEIADLTYNVVAFSEIMSMIWKRLNDHGKNWRHVYKAMTLMEYLIKTGSERVSQQCKENMYAVQTLKDFQYVDRDGKDQGVNVREKAKQLVALLRDEDRLREERAHALKTKEKLAQTATASSAAVGSGPPPEAEQAWPQSSGEEELQLQLALAMSKEEADQPPSCGPEDDAQLQLALSLSREEHDKGSVPGIDCGLADGTRRKPTGTLGDKKESILMDLD

SEQ ID NO: 836077 - protein, 105 aa, Homo sapiens
FSGCDYSTARTQINPEHPLPPIFTPIHFPQTRHTFLLVISIFFLNGFSSFQGKAYFFPSFNFFSKYNINARGQARWLTSVTPALWEAKAVGSPEVTSSRPAWPTW

SEQ ID NO: 836078 - protein, 128 aa, Homo sapiens
MAGCGWVGQSLQQQQGGCLLRDRLDVGTNTLDLTRSSTLDALLGIDDLETMPDDLLTTLDDTCGSLVAPLVQETNKAGPPPDGEPQSWAISQKSFNEKPDQVCPLHLLTTFFPFPQGSCPPLQIIPLV

SEQ ID NO: 836079 - protein, 171 aa, Homo sapiens
MAGCGWVGQSLQQQQGGCLLRDRLDVGTNTLDLTRSSTLDALLGIDDLETMPDDLLTTLDDTCGSLVAPLVQETNKAGPPPDGEPQSWAISQKSFNELPFNLPSLSQGRSPSQSYFSRMAGMDLRREEAKTCRADTVVGETLYVCFIDFGLASGLKTLVWAPLKKGDRKNV

SEQ ID NO: 836080 - protein, 128 aa, Homo sapiens
MAGCGWVGQSLQQQQGGCLLRDRLDVGTNTLDLTRSSTLDALLGIDDLETMPDDLLTTLDDTCGSLVAPLVQETNKAGPPPDGEPQSWAISQKSFNEFTLTLSFPGSVSIKNLNKLAEGDTEDEQQVV

SEQ ID NO: 836081 - protein, 149 aa, Homo sapiens [sequence omitted]

SEQ ID NO: 836082 - protein, 149 aa, Homo sapiens [sequence omitted]

SEQ ID NO: 836083 - protein, 149 aa, Homo sapiens [sequence omitted]

SEQ ID NO: 836084 - protein, 149 aa, Homo sapiens [sequence omitted]

SEQ ID NO: 836085 - protein, 149 aa, Homo sapiens [sequence omitted]

SEQ ID NO: 836086 - protein, 129 aa, Homo sapiens
MIPQCIKEEDTPSDNDSGICMSPESYLGSPQHSPSTRGSPNRSLPSPGVLCGSARPKPYDPPGEKMVAAKVKGEKLDKKLKKMEQNKTAATRYRQKKRAEQEALTGECKELESRKPAYLDLTLGSDEPS

SEQ ID NO: 836087 - protein, 128 aa, Homo sapiens; identical to SEQ ID NO: 836078

SEQ ID NO: 836088 - protein, 128 aa, Homo sapiens; identical to SEQ ID NO: 836078

SEQ ID NO: 836089 - protein, 149 aa, Homo sapiens [sequence omitted]

SEQ ID NO: 836090 - protein, 128 aa, Homo sapiens; identical to SEQ ID NO: 836078

SEQ ID NO: 836091 - protein, 128 aa, Homo sapiens; identical to SEQ ID NO: 836078

SEQ ID NO: 836092 - protein, 149 aa, Homo sapiens [sequence omitted]

SEQ ID NO: 836093 - protein, 149 aa, Homo sapiens [sequence omitted]

SEQ ID NO: 836094 - protein, 149 aa, Homo sapiens [sequence omitted]

SEQ ID NO: 836095 - protein, 149 aa, Homo sapiens [sequence omitted]

SEQ ID NO: 836096 - protein, 137 aa, Homo sapiens
MAGCGWVGQSLQQQQGGCLLRDRLDVGTNTLDLTRSSTLDALLGIDDLETMPDDLLTTLDDTCGSLVAPLVQETNKAGPPPDGEPQSWAISQKSFNEKPDQVCPLHLLTTFFPLNLQTSPTAACQLSQGSSSRGEVG

SEQ ID NO: 836097 - protein, 111 aa, Homo sapiens
MAGCGWVGQSLQQQQGGCLLRDRLDVGTNTLDLTRSSTLDALLGIDDLETMPDDLLTTLDDTCGSLVAPLVQETNKAGPPPDGEPQSWAISQKSFNEGSGVLCSIHNIFFI

SEQ ID NO: 836098 - protein, 128 aa, Homo sapiens
MAGCGWVGQSLQQQQGGCLLRDRLDVGTNTLDLTRSSTLDALLGIDDLETMPDDLLTTLDDTCGSLVAPLVQETNKAGPPPDGEPQSWAISQKSFNEFTLTLSFPGSVSIKNLNKLAEEDTEDEQQVV

SEQ ID NO: 836099 - protein, 136 aa, Homo sapiens
MAGCGWVGQSLQQQQGGCLLRDRLDVGTNTLDLTRSSTLDALLGIDDLETMPETRPGLPPSPSYNLLPLSPGVLSSTPDHSFSLELKEERGSKREGGFPGQGDPVPERFDRRGPQGKGEEKGPLVEDSQERQCACT

SEQ ID NO: 836100 - protein, 94 aa, Homo sapiens
MALLTAFSSSVAVTDKDTFELSTFLDSSKAPQHDRNELPEQRGVGGGLDYAFLNKLGYHKTVKGRLGFSTEDLSEISDRWLATGVFTDHHLTLW

SEQ ID NO: 836101 - protein, 149 aa, Homo sapiens [sequence omitted]

SEQ ID NO: 836102 - protein, 128 aa, Homo sapiens
MTPRAKVSPQHSPSTRGSPNRSLPSPGVLCGSARPKPYDPPGEKMVAAKVKGEKLDKKLKKMEQNKTAATRYRQKKRAEQEALTGECKELEKKNEALKERADSLAKEIQYLKDLIEEVRKARGKKRVP

SEQ ID NO: 836103 - protein, 149 aa, Homo sapiens [sequence omitted]

SEQ ID NO: 836104 - protein, 149 aa, Homo sapiens [sequence omitted]

SEQ ID NO: 836105 - protein, 149 aa, Homo sapiens [sequence omitted]

SEQ ID NO: 836106 - protein, 149 aa, Homo sapiens [sequence omitted]

SEQ ID NO: 836107 - protein, 149 aa, Homo sapiens [sequence omitted]

SEQ ID NO: 836108 - protein, 143 aa, Homo sapiens
MIPQCIKEEDTPSDNDSGICMSPESYLGSPQHSPSTRGSPNRSLPSPGVLCGSARPKPYDPPGEKMVAAKVKGEKLDKKLKKMEQNKTAATRYRQKKRAEQEALTGECKELEKKNEALKERADSLAKEIQFLTLYFCCYHLLS

SEQ ID NO: 836109 - protein, 128 aa, Homo sapiens; identical to SEQ ID NO: 836078

SEQ ID NO: 836110 - protein, 128 aa, Homo sapiens; identical to SEQ ID NO: 836078

SEQ ID NO: 836111 - protein, 149 aa, Homo sapiens [sequence omitted]

SEQ ID NO: 836112 - protein, 149 aa, Homo sapiens [sequence omitted]

SEQ ID NO: 836113 - protein, 149 aa, Homo sapiens [sequence omitted]

SEQ ID NO: 836114 - protein, 283 aa, Homo sapiens
MAGCGWVGQSLQQQQGGCLLRDRLDVGTNTLDLTRSSTVDALLGIDDLETMPDDLLTTLDDTCGSLVAPLVQETNKAGPPPDGEPQSWAISQKSFNESPGVLSSTPDHSFSLELGSEVDITEGDRKPDYTAYVAMIPQCIKEEDTPSDNDSGICMSPESYLGSPQHSPSTRGSPNRSLPSPGVLCGSARPKPYDPPGEKMVAAKVKGEKLDKKLKKMEQNKTAATRYRQKKRAEQEALTGECKELEKKNEALKERADSLAKEIQYLKDLIEEVRKARGKKRVP

SEQ ID NO: 836115 - protein, 128 aa, Homo sapiens; identical to SEQ ID NO: 836078

SEQ ID NO: 836116 - protein, 151 aa, Homo sapiens
MAGCGWVGQSLQQQQGGCLLRDRLDVGTNTLDLTRSSTLDALLGIDDLETMPDDLLTTLDDTCGSLVAPLVQETNKAGPPPDGEPQSWAISQKSFNEKPDQVCPLHLLTTFFPFGQGDPVPERFDRRGPQGKGEEKGPLVEDSQERQCACT

SEQ ID NO: 836117 - protein, 203 aa, Homo sapiens
MAGCGWVGQSLQQQQGGCLLRDRLDVGTNTLDLTRSSTLDALLGIDDLETMPDDLLTTLDDTCGSLVAPLVQETNKAGPPPDGEPQSWAISQKSFNELPSPGVLCGSARPKPYDPPGEKMVAAKVKGEKLDKKLKKMEQNKTAATRYRQKKRAEQEALTGECKELEKKNEALKERADSLAKEIQYLKDLIEEVRKARGKKRVP

SEQ ID NO: 836118 - protein, 116 aa, Homo sapiens
MAGCGWVGQSLQQQQGGCLLRDRLDVGTNTLDLTRSSTLDALLGIDDLETMPDDLLTTLDDTCGSLVAPLVQETNKAGPPPDGEPQSWAISQKSFNERVNEGPSQLATESLPGNLY

SEQ ID NO: 836119 - protein, 70 aa, Homo sapiens
MAGCGWVGQSLQQQQGGCLLRDRLDVGTNTLDLTRSSTLDALLGIDDLETMPADAFLSMNAFFICPVSPS

SEQ ID NO: 836120 - protein, 160 aa, Homo sapiens
MTLEELVACDNAAQKMQTVTAAVEELLVAAQRQDRLTVGVYESAKLMNVDPDSVVLCLLAIDEEEEDDIALQIHFTLIQSFCCDNDINIVRVSGMQRLAQLLGEPAETQGTTEARDLHCLLVTNPHTDAWKSHGLVEVASYCEESRGNNQWVPYISLQER

SEQ ID NO: 836121 - protein, 160 aa, Homo sapiens; identical to SEQ ID NO: 836120

SEQ ID NO: 836122 - protein, 177 aa, Homo sapiens
MTLEELVACDNAAQKMQTVTAAVEELLVAAQRQDRLTVGVYESAKLMNVDPDSVVLCLLAIDEEEEDDIALQIHFTLIQSFCCDNDINIVRVSGMQRLAQLLGEPAETQGTTEARDLHCLLVTTVSRASALPRHARAPGPVFVNKVGLTGPAQLSAQPRLACPVGSRAGASSPRKLF

SEQ ID NO: 836123 - protein, 292 aa, Homo sapiens
MTLEELVACDNAAQKMQTVTAAVEELLVAAQRQDRLTVGVYESAKLMNVESDPLPGLGAGGTGPPLRSGRFPHACLAWSWDFPKCPPLWMQSFSAVLWIGGCRILMYRLQTPLPPWACLPLPHTLNRVPSPPPTVTSLQRQSPAPLQFLFCSCTLLFCKLPLQVAPPLSPADPSLPFGPLRDPDSVVLCLLAIDEEEEDDIALQIHFTLIQSFCCDNDINIVRVSGMQRLAQLLGEPAETQGTTEARDLHCLLVTNPHTDAWKSHGLVEVASYCEESRGNNQWVPYISLQER

SEQ ID NO: 836124 - protein, 185 aa, Homo sapiens
MTLEELVACDNAAQKMQTVTAAVEELLVAAQRQDRLTVGVYESAKLMNVESDPLPGLGAGGTGPPLRSGRFPHACLAWSWDFPKCPPLWMQSFSAVLWIGGCRILMYRLQTPLPPWACLPLPHTLNRVPSPPPTVTSLQRQSPAPLQFNPHTDAWKSHGLVEVASYCEESRGNNQWVPYISLQER

SEQ ID NO: 836125 - protein, 160 aa, Homo sapiens; identical to SEQ ID NO: 836120

SEQ ID NO: 836126 - protein, 160 aa, Homo sapiens; identical to SEQ ID NO: 836120

SEQ ID NO: 836127 - protein, 145 aa, Homo sapiens [sequence omitted]

SEQ ID NO: 836128 - protein, 309 aa, Homo sapiens
MTLEELVACDNAAQKMQTVTAAVEELLVAAQRQDRLTVGVYESAKLMNVESDPLPGLGAGGTGPPLRSGRFPHACLAWSWDFPKCPPLWMQSFSAVLWIGGCRILMYRLQTPLPPWACLPLPHTLNRVPSPPPTVTSLQRQSPAPLQFLFCSCTLLFCKLPLQVAPPLSPADPSLPFGPLRDPDSVVLCLLAIDEEEEDDIALQIHFTLIQSFCCDNDINIVRVSGMQRLAQLLGEPAETQGTTEARDLHCLLVTTVSRASALPRHARAPGPVFVNKVGLTGPAQLSAQPRLACPVGSRAGASSPRKLF

SEQ ID NO: 836129 - protein, 114 aa, Homo sapiens
KFFRGPRYLGRRDSWAGVCQQSRADWSCTAQRSATFGMSRGQPGWGLLTQEAILSLTVFPTQGPREREAPLNPFFSLNPHTDAWKSHGLVEVASYCEESRGNNQWVPYISLQER

SEQ ID NO: 836130 - protein, 288 aa, Homo sapiens
KIRKRKVTTKINRHDKINGKRKTARKQKMFQRAQELRRRAEDYHKCKIPPSARKPLCNWVRMAAAEHRHSSGLPCWPYLTAETLKNRMGRQPPPPTQQHSITDNSLSLKTPPECLLHPLPPSVDDNIKECPLAPLPPSVDDNLKECLLVPLPPSPLPPSVDDNLKDCLFVPLPPSPLPPSVDDNLKTPPLATQEAEAEKPPKPKRWRVDEVEQSPKPKRRRADEVEQSPKPKRQREAEAQQLPKPKRRRLSKLRTRHCTQAWAIRINPWVEKKKKIKKQNKTHAPKTN

SEQ ID NO: 836131 - protein, 189 aa, Homo sapiens
KIRKRKVTTKINRHDKINGKRKTARKQKMFQRAQELRRRAEDYHKCKIPPSARKPLCNWVRMAAAEHRHSSGLPCWPYLTAETLKNRMGRQPPPPTQQHSITDNSLSLKTPPECLLHPLPPSVDDNIKECPLAPLPPSVDDNLKECLLVPLPPSPLPPSVDDNLKDCLFVPLPPSPLPPSVDDNLKTPE

SEQ ID NO: 836132 - protein, 81 aa, Homo sapiens
KIRKRKVTTKINRHDKINGKKEDRQKTENVSTCARVAAAGRGLPQMQNPPFCKKASLQLGQNGGSGASSFFRIALLALPHS

SEQ ID NO: 836133 - protein, 145 aa, Homo sapiens
KIRKRKVTTKINRHDKINGKRKTARKQKMFQRAQELRRRAEDYHKCKIPPSARKPLCNWVRMAAAEHRHSSGLPCWPYLTAETLKNRMGRQPPPPTQQHSITDNSLSLKTPPECLLHPLPPSVDDNIKECPLAPLPPLSSSTLSG

SEQ ID NO: 836134 - protein, 209 aa, Homo sapiens
MAAAEHRHSSGLPCWPYLTAETLKNRMGRQPPPPTQQHSITDNSLSLKTPPECLLHPLPPSVDDNIKECPLAPLPPSVDDNLKECLLVPLPPSPLPPSVDDNLKDCLFVPLPPSPLPPSVDDNLKTPPLATQEAEAEKPPKPKRWRVDEVEQSPKPKRRRADEVEQSPKPKRQREAEAQQLPKPKRRRLSKLRTRHCTQAWAIRINPWV

SEQ ID NO: 836135 - protein, 332 aa, Homo sapiens
MLLETQDALYVALELVIAALSVAGNVLVCAAVGTANTLQTPTNYFLVSLAAADVAVGLFAIPFAITISLGFCTDFYGCLFLACFVLVLTQSSIFSLLAVAVDRYLAICVPLRYKSLVTGTRARGVIAVLWVLAFGIGLTPFLGWNSKDSATNNCTEPWDGTTNESCCLVKCLFENVVPMSYMVYFNFFGCVLPPLLIMLVIYIKIFLVACRQLQRTELMDHSRTTLQREIHAAKSLAMIVGIFALCWLPVHAVNCVTLFQPAQGKNKPKWAMNMAILLSHANSVVNPIVYAYRNRDFRYTFHKIISRYLLCQADVKSGNGQAGVQPALGVGL

SEQ ID NO: 836136 - protein, 332 aa, Homo sapiens; identical to SEQ ID NO: 836135

SEQ ID NO: 836137 - protein, 94 aa, Homo sapiens
SSSSAVSFLLLLSFFLLLFFFLLLLSSSFVLVLRLPSPDKGSPGIFSAKQMSRVGMVRLGYSLLSVWAYDLGSRLFQEKIQIHKKQRGHGWFSL

SEQ ID NO: 836138 - protein, 285 aa, Homo sapiens
LTEFSRAKLLIPACMSLVLRVKALVPWKVNFEVVKGSWKKEEVGSWIVVAERYKLTVTDGILLNRYKSLVTGTRARGVIAVLWVLAFGIGLTPFLGWNSKDSATNNCTEPWDGTTNESCCLVKCLFENVVPMSYMVYFNFFGCVLPPLLIMLVIYIKIFLVACRQLQRTELMDHSRTTLQREIHAAKSLAMIVGIFALCWLPVHAVNCVTLFQPAQGKNKPKWAMNMAILLSHANSVVNPIVYAYRNRDFRYTFHKIISRYLLCQADVKSGNGQAGVQPALGVGL

SEQ ID NO: 836139 - protein, 477 aa, Homo sapiens
MANMQGLVERLERAVSRLESLSAESHRPPGNCGEVNGVIAGVAPSVEAFDKLMDSMVAEFLKNSRILAGDVETHAEMVHSAFQAQRAFLLMASQYQQPHENDVAALLKPISEKIQEIQTFRERNRGSNMFNHLSAVSESIPALGWIAVSPKPGPYVKEMNDAATFYTNRVLKDYKHSDLRHVDWVKSYLNIWSELQAYIKEHHTTGLTWSKTGPVASTVSAFSVLSSGPGLPPPPPPLPPPGPPPLFENEGKKEESSPSRSALFAQLNQGEAITKGLRHVTDDQKTYKNPSLRAQGGQTQSPTKSHTPSPTSPKSYPSQKHAPVLELEGKKWRVEYQEDRNDLVISETELKQVAYIFKCEKSTIQIKGKVNSIIIDNCKKLGLVFDNVVGIVEVINSQDIQIQVMGRVPTISINKTEGCHIYLSEDALDCEIVSAKSSEMNILIPQDGDYREFPIPEQFKTAWDGSKLITEPAEIMA

SEQ ID NO: 836140 - protein, 504 aa, Homo sapiens
SLGRQLGWCGRPRICIAEDGTPGQRSRMANMQGLVERLERAVSRLESLSAESHRPPGNCGEVNGVIAGVAPSVEAFDKLMDSMVAEFLKNSRILAGDVETHAEMVHSAFQAQRAFLLMASQYQQPHENDVAALLKPISEKIQEIQTFRERNRGSNMFNHLSAVSESIPALGWIAVSPKPGPYVKEMNDAATFYTNRVLKDYKHSDLRHVDWVKSYLNIWSELQAYIKEHHTTGLTWSKTGPVASTVSAFSVLSSGPGLPPPPPPLPPPGPPPLFENEGKKEESSPSRSALFAQLNQGEAITKGLRHVTDDQKTYKNPSLRAQGGQTQSPTKSHTPSPTSPKSYPSQKHAPVLELEGKKWRVEYQEDRNDLVISETELKQVAYIFKCEKSTIQIKGKVNSIIIDNCKKLGLVFDNVVGIVEVINSQDIQIQVMGRVPTISINKTEGCHIYLSEDALDCEIVSAKSSEMNILIPQDGDYREFPIPEQFKTAWDGSKLITEPAEIMA

SEQ ID NO: 836141 - protein, 413 aa, Homo sapiens
MANMQGLVERLERAVSRLESLSAESHRPPGNCGEVNGVIAGVAPSVEAFDKLMDSMVAEFLKNSRILAGDVETHAEMVHSAFQAQRAFLLMASQYQQPHENDVAALLKPISEKIQEIQTFRERNRGSNMFNHLSAVSESIPALGWIAVGPVASTVSAFSVLSSGPGLPPPPPPLPPPGPPPLFENEGKKEESSPSRSALFAQLNQGEAITKGLRHVTDDQKTYKNPSLRAQGGQTQSPTKSHTPSPTSPKSYPSQKHAPVLELEGKKWRVEYQEDRNDLVISETELKQVAYIFKCEKSTIQIKGKVNSIIIDNCKKLGLVFDNVVGIVEVINSQDIQIQVMGRVPTISINKTEGCHIYLSEDALDCEIVSAKSSEMNILIPQDGDYREFPIPEQFKTAWDGSKLITEPAEIMA

SEQ ID NO: 836142 - protein, 477 aa, Homo sapiens; identical to SEQ ID NO: 836139

SEQ ID NO: 836143 - protein, 451 aa, Homo sapiens
MANMQGLVERLERAVSRLESLSAESHRPPGNCGEVNGVIAGVAPSVEAFDKLMDSMVAEFLKNSRILAGDVETHNDVAALLKPISEKIQEIQTFRERNRGSNMFNHLSAVSESIPALGWIAVSPKPGPYVKEMNDAATFYTNRVLKDYKHSDLRHVDWVKSYLNIWSELQAYIKEHHTTGLTWSKTGPVASTVSAFSVLSSGPGLPPPPPPLPPPGPPPLFENEGKKEESSPSRSALFAQLNQGEAITKGLRHVTDDQKTYKNPSLRAQGGQTQSPTKSHTPSPTSPKSYPSQKHAPVLELEGKKWRVEYQEDRNDLVISETELKQVAYIFKCEKSTIQIKGKVNSIIIDNCKKLGLVFDNVVGIVEVINSQDIQIQVMGRVPTISINKTEGCHIYLSEDALDCEIVSAKSSEMNILIPQDGDYREFPIPEQFKTAWDGSKLITEPAEIMA

SEQ ID NO: 836144 - protein, 477 aa, Homo sapiens; identical to SEQ ID NO: 836139

SEQ ID NO: 836145 - protein, 360 aa, Homo sapiens
MANMQGLVERLERAVSRLESLSAESHRPPGNCGEVNGVIAGVAPSVEAFDKLMDSMVAEFLKNSRILAGDVETHAEMVHSAFQAQRAFLLMASQYQQPHENDVAALLKPISEKIQEIQTFRERNRGSNMFNHLSAVSESIPALGWIAVSPKPGPYVKEMNDAATFYTNRVLKDYKHSDLRHVDWVKSYLNIWSELQAYIKEHHTTGLTWSKTGPVASTVSAFSVLSSGPGLPPPPPPLPPPGPPPLFENEGKKEESSPSRSALFAQLNQGEAITKGLRHVTDDQKTYKNPSLRAQGGQTQSPTKSHTPSPTSPKSYPSQKHAPVLELEGKKWRVEYQRKDYLVIQRLAEQCFISIEITFS

SEQ ID NO: 836146 - protein, 44 aa, Homo sapiens
MSRFCLEEKRLAAREQEAVGTGHAGEDKAMAVGTKGVRTAPKGL

SEQ ID NO: 836147 - protein, 81 aa, Homo sapiens
PGVCCVEVKRITISQETAYDPGTPKLGTRYGSLGMMTSVLVCPDGKTVEAEAAHGTVTRHYRMYQKGQETSTNPIAPPGLA

SEQ ID NO: 836148 - protein, 414 aa, Homo sapiens
MSKKISGGSVVEMQGDEMTRIIWELIKEKLIFPYVELDLHSYDLGIENRDATNDQVTKDAAEAIKKHNVGVKCATITPDEKRVEEFKLKQMWKSPNGTIRNILGGTVFREAIICKNIPRLVSGWVKPIIIGRHAYGDQYRATDFVVPGPGKVEITYTPSDGTQKVTYLVHNFEEGGGVAMGMYNQDKSIEDFAHSSFQMALSKGWPLYLSTKNTILKKYDGRFKDIFQEIYDKQYKSQFEAQKIWYEHRLIDDMVAQAMKSEGGFIWACKNYDGDVQSDSVAQGYGSLGMMTSVLVCPDGKTVEAEAAHGTVTRHYRMYQKGQETSTNPIASIFAWTRGLAHRAKLDNNKELAFFANALEEVSIETIEAGFMTKDLAACIKGLPNVQRSDYLNTFEFMDKLGENLKIKLAQAKL

SEQ ID NO: 836149 - protein, 173 aa, Homo sapiens
MSKKISGGSVVEMQGDEMTRIIWELIKEKLIFPYVELDLHSYDLGIENRDATNDQVTKDAAEAIKKHNVGVKCATITPDEKRVEEFKLKQMWKSPNGTIRNILGGTVFREAIICKNIPRLVSGWVKPIIIGRHAYGDQVSHVGNNVILHVFFSWPRNFQLVCVPFLSFGIYTH

SEQ ID NO: 836150 - protein, 73 aa, Homo sapiens
KDLSHGTQMYSSSQNVAHLGTFNEQVLGHEASLNCHNKELAFFANALEEVSIETIEAGFMTKDLAACIKGLPK

SEQ ID NO: 836151 - protein, 414 aa, Homo sapiens; identical to SEQ ID NO: 836148

SEQ ID NO: 836152 - protein, 414 aa, Homo sapiens; identical to SEQ ID NO: 836148

SEQ ID NO: 836153 - protein, 239 aa, Homo sapiens
MSKKISGGSVVEMQGDEMTRIIWELIKEKLIFPYVELDLHSYDLGIENRDATNDQVTKDAAEAIKKHNVGVKCATITPDEKRVEEFKLKQMWKSPNGTIRNILGGTVFREAIICKNIPRLVSGWVKPIIIGRHAYGDQYRATDFVVPGPGKVEITYTPSDGTQKVTYLVHNFEEGGGVAMGMYNQDKSIEDFAHSSFQMALSKGWPLYLSTKNSSTSPSLKLKRSGMSIGSSTTWWPKL

SEQ ID NO: 836154 - protein, 409 aa, Homo sapiens
MSKKISGGSVVEMQGDEMTRIIWELIKEKLIFPYVELDLHSYDLGIENRDATNDQVTKDAAEAIKKHNVGVKCATITPDEKRVEEFKLKQMWKSPNGTIRNILGGTVFREAIICKNIPRLVSGWVKPIIIGRHAYGDQYRATDFVVPGPGKVEITYTPSDGTQKVTYLVHNFEEGGGVAMGMYNQDKSIEDFAHSSFQMALSKGWPLYLSTKNTILKKYDGRFKDIFQEIYDKQYKSQFEAQKIWYEHRLIDDMVAQAMKSEGGFIWACKNYDGDVQSDSVAQGYGSLGMMTSVLVCPDGKTVEAEAAHGTVTRHYRMYQKGQETSTNPIASIFAWTRGLAHRAKLDNNKELAFFANALEEVSIETIEAGFMTKDLAACIKGLPNVQRSDYLNTFEFMDKLGEKIIVFW

SEQ ID NO: 836155 - protein, 414 aa, Homo sapiens; identical to SEQ ID NO: 836148

SEQ ID NO: 836156 - protein, 414 aa, Homo sapiens; identical to SEQ ID NO: 836148

SEQ ID NO: 836157 - protein, 336 aa, Homo sapiens
MSKKISGGSVVEMQGDEMTRIIWELIKEKLIFPYVELDLHSYDLGIENRDATNDQVTKDAAEAIKKHNVGVKCATITPDEKRVEEFKLKQMWKSPNGTIRNILGGTVFREAIICKNIPRLVSGWVKPIIIGRHAYGDQYRATDFVVPGPGKVEITYTPSDGTQKVTYLVHNFEEGGGVAMGMYNQDKSIEDFAHSSFQMALSKGWPLYLSTKNTILKKYDGRFKDIFQEIYDKQYKSQFEAQKIWYEHRLIDDMVAQAMKSEGGFIWACKNYDGDVQSDSVAQGYGSLGMMTSVLVCPDGKTVEAEAAHGTVTRHYRMYQKGQETSTNPIAPPGLA

SEQ ID NO: 836158 - protein, 414 aa, Homo sapiens; identical to SEQ ID NO: 836148

SEQ ID NO: 836159 - protein, 414 aa, Homo sapiens; identical to SEQ ID NO: 836148

SEQ ID NO: 836160 - protein, 136 aa, Homo sapiens
MSKKISGGSVVEMQGDEMTRIIWELIKEKLIFPYVELDLHSYDLGIENRDATNDQVTKDAAEAIKKHNVGVKCATITPDEKRVEEFKLKQMWKSPNGTIRNILGGTVFREAIICKNIPRLVSGWVFVVPGPWVEIL

SEQ ID NO: 836161 - protein, 400 aa, Homo sapiens
MSKKISGGSVVEMQGDEMTRIIWELIKEKLIFPYVELDLHSYDLGIENRDATNDQVTKDAAEAIKKHNVGVKCATITPDEKRVEEFKLKQMWKSPNGTIRNILGGTVFREAIICKNIPRLVSGWVKPIIIGRHAYGDQYRATDFVVPGPGKVEITYTPSDGTQKVTYLVHNFEEGGGVAMGMYNQDKSIEDFAHSSFQMALSKGWPLYLSTKNTILKKYDGRFKDIFQEIYDKQYKSQFEAQKIWYEHRLIDDMVAQAMKSEGGFIWACRYGSLGMMTSVLVCPDGKTVEAEAAHGTVTRHYRMYQKGQETSTNPIASIFAWTRGLAHRAKLDNNKELAFFANALEEVSIETIEAGFMTKDLAACIKGLPNVQRSDYLNTFEFMDKLGENLKIKLAQAKL

SEQ ID NO: 836162 - protein, 414 aa, Homo sapiens; identical to SEQ ID NO: 836148

SEQ ID NO: 836163 - protein, 295 aa, Homo sapiens
MSKKISGGSVVEMQGDEMTRIIWELIKEKLIFPYVELDLHSYDLGIENRDATNDQVTKDAAEAIKKHNVGVKCATITPDEKRVEEFKLKQMWKSPNGTIRNILGGTVFREAIICKNIPRLVSGWVKPIIIGRHAYGDQYRATDFVVPGPGKVEITYTPSDGTQKVTYLVHNFEEGGGVAMGMYNQDKSIEDFAHSSFQMALSKGWPLYLSTKNTILKKYDGRFKDIFQEIYDKVWLSRHDDQRAGLSRWQDSRSRGCPRDCNPSLPHVPERTGDVHQSHCFHFCLDQRVSPQSKA

SEQ ID NO: 836164 - protein, 396 aa, Homo sapiens
MSKKISGGSVVEMQGDEMTRIIWELIKEKLIFPYVELDLHSYDLGIENRDATNDQVTKDAAEAIKKHNVGVKCATITPDEKRVEEFKLKQMWKSPNGTIRNILGGTVFREAIICKNIPRLVSGWVKPIIIGRHAYGDQYRATDFVVPGPGKVEITYTPSDGTRMYNQDKSIEDFAHSSFQMALSKGWPLYLSTKNTILKKYDGRFKDIFQEIYDKQYKSQFEAQKIWYEHRLIDDMVAQAMKSEGGFIWACKNYDGDVQSDSVAQGYGSLGMMTSVLVCPDGKTVEAEAAHGTVTRHYRMYQKGQETSTNPIASIFAWTRGLAHRAKLDNNKELAFFANALEEVSIETIEAGFMTKDLAACIKGLPNVQRSDYLNTFEFMDKLGENLKIKLAQAKL

SEQ ID NO: 836165 - protein, 414 aa, Homo sapiens; identical to SEQ ID NO: 836148

SEQ ID NO: 836166 - protein, 396 aa, Homo sapiens
MSKIWELIKEKLIFPYVELDLHSYDLGIENRDATNDQVTKDAAEAIKKHNVGVKCATITPDEKRVEEFKLKQMWKSPNGTIRNILGGTVFREAIICKNIPRLVSGWVKPIIIGRHAYGDQYRATDFVVPGPGKVEITYTPSDGTQKVTYLVHNFEEGGGVAMGMYNQDKSIEDFAHSSFQMALSKGWPLYLSTKNTILKKYDGRFKDIFQEIYDKQYKSQFEAQKIWYEHRLIDDMVAQAMKSEGGFIWACKNYDGDVQSDSVAQGYGSLGMMTSVLVCPDGKTVEAEAAHGTVTRHYRMYQKGQETSTNPIASIFAWTRGLAHRAKLDNNKELAFFANALEEVSIETIEAGFMTKDLAACIKGLPNVQRSDYLNTFEFMDKLGENLKIKLAQAKL

SEQ ID NO: 836167 - protein, 526 aa, Homo sapiens
WEGTKRGKRKSSDLPCGPGFLQSLLQKRRHWESGLGLPGCGCESELVSGCGAPTLRQHIIPAGDKLHSVESARLGGTGVIRNLFTVKLLKSKCPKEISCAVLGTSTATDDLKHWDRDTSGGTLTLQRSKHPSKFSFCSAAVNRMGQTLGILHSYDLGIENRDATNDQVTKDAAEAIKKHNVGVKCATITPDEKRVEEFKLKQMWKSPNGTIRNILGGTVFREAIICKNIPRLVSGWVKPIIIGRHAYGDQYRATDFVVPGPGKVEITYTPSDGTQKVTYLVHNFEEGGGVAMGMYNQDKSIEDFAHSSFQMALSKGWPLYLSTKNTILKKYDGRFKDIFQEIYDKQYKSQFEAQKIWYEHRLIDDMVAQAMKSEGGFIWACKNYDGDVQSDSVAQGYGSLGMMTSVLVCPDGKTVEAEAAHGTVTRHYRMYQKGQETSTNPIASIFAWTRGLAHRAKLDNNKELAFFANALEEVSIETIEAGFMTKDLAACIKGLPNVQRSDYLNTFEFMDKLGENLKIKLAQAKL

SEQ ID NO: 836168 - protein, 235 aa, Homo sapiens
MGMYNQDKSIEDFAHSSFQMALSKGWPLYLSTKNTILKKYDGRFKDIFQEIYDKQYKSQFEAQKIWYEHRLIDDMVAQAMKSEGGFIWACKNYDGDVQSDSVAQGYGSLGMMTSVLVCPDGKTVEAEAAHGTVTRHYRMYQKGQETSTNPIASIFAWTRGLAHRAKLDNNKELAFFANALEEVSIETIEAGFMTKDLAACIKGLPNVQRSDYLNTFEFMDKLGENLKIKLAQAKL

SEQ ID NO: 836169 - protein, 269 aa, Homo sapiens
MSKKISGGSVVEMQGDEMTRIIWELIKEKLIFPYVELDLHSYDLGIENRDATNDQVTKDAAEAIKKHNVGVKCATITPDEKRVEEFKLKQMWKSPNGTIRNILGGTVFREAIICKNIPRLVSGWVKPIIIGRHAYGDQYRATALVFLGLEKKKKNKKKKIWGGLGGERVFKTLWWGGGAMGYAHIAQSAAPEETCGPELRWWVFSTQIKKRRGNTGCFWNNSRVGCRGHDPVLSKGSKECQFYAPPRGGGHVQKKRNPRKQKIQQKEGP

SEQ ID NO: 836170 - protein, 355 aa, Homo sapiens
MALRLLKLAATSASARVVAAGAQRVRGIHSSVQCKLRYGMWHFLLGDKASKRLTERSRVITVDGNICTGKGKLAKEIAEKLGFKHFPEAGIHYPDSTTGDGKPLATDYNGNCSLEKFYDDPRSNDGNSYRLQSWLYSSRLLQYSDALEHLLTTGQGVVLERSIFSDFVFLEAMYNQGFIRKQCVDHYNEVKSVTICDYLPPHLVIYIDVPVPEVQRRIQKKGDPHEMKITSAYLQDIENAYKKTFLPEMSEKCEVLQYSAREAQDSKKVVEDIEYLKFDKGPWLKQDNRTLYHLRLLVQDKFEVLNYTSIPIFLPEVTIGAHQTDRVLHQFRELPGRKYSPGYNTEVGDKWIWLK

SEQ ID NO: 836171 - protein, 355 aa, Homo sapiens; identical to SEQ ID NO: 836170

SEQ ID NO: 836172 - protein, 355 aa, Homo sapiens; identical to SEQ ID NO: 836170

SEQ ID NO: 836173 - protein, 355 aa, Homo sapiens; identical to SEQ ID NO: 836170

SEQ ID NO: 836174 - protein, 355 aa, Homo sapiens; identical to SEQ ID NO: 836170

SEQ ID NO: 836175 - protein, 297 aa, Homo sapiens
MALRLLKLAATSASARVVAAGAQRVRGIHSSVQCKLRYGMWHFLLGDKASKRLTERSRVITVDGNICTGKGKLAKEIAEKLGFKHFPEAGIHYPDSTTGDGKPLATDYNGNCSLEKFYDDPRSNDGNSYRLQSWLYSSRLLQYSDALEHLLTTGQGVVLERSIFSDFVFLEAMYNQGFIRKQCVDHYNEVKSVTICDYLPPHLVIYIDVPVPEVQRRIQKKGDPHEMKITSAYLQDIENAYKKTFLPEMSEKCEVLQYSAREAQDSKKVVEDIEYLKFDKGPWLKQDNRTLYHLRLL

SEQ ID NO: 836176 - protein, 353 aa, Homo sapiens
EDKTRSKETSAFARVVSGGEKSVRGIHSSVQCKLRYGMWHFLLGDKASKRLTERSRVITVDGNICTGKGKLAKEIAEKLGFKHFPEAGIHYPDSTTGDGKPLATDYNGNCSLEKFYDDPRSNDGNSYRLQSWLYSSRLLQYSDALEHLLTTGQGVVLERSIFSDFVFLEAMYNQGFIRKQCVDHYNEVKSVTICDYLPPHLVIYIDVPVPEVQRRIQKKGDPHEMKITSAYLQDIENAYKKTFLPEMSEKCEVLQYSAREAQDSKKVVEDIEYLKFDKGPWLKQDNRTLYHLRLLVQDKFEVLNYTSIPIFLPEVTIGAHQTDRVLHQFRELPGRKYSPGYNTEVGDKWIWLK

SEQ ID NO: 836177 - protein, 236 aa, Homo sapiens
MALRLLKLAATSASARVVAAGAQRVRGIHSSVQCKLRYGMWHFLLGDKASKRLTERSRVITVDGNICTGKGKLAKEIAEKLGFKHFPEAGIHYPDSTTGDGKPLATDYNGNCSLEKFYDDPRSNDGNSYRLQSWLYSSRLLQYSDALEHLLTTGQGVVLERSIFSDFVFLEAMYNQGFIRKQCVDHYNEVKSVTICDYLPPHLVIYIDVPVPEVQRRIQKKGDVMQFSIKGQASLF

SEQ ID NO: 836178 - protein, 183 aa, Homo sapiens
MYNQGFIRKQCVDHYNEVKSVTICDYLPPHLVIYIDVPVPEVQRRIQKKGDPHEMKITSAYLQDIENAYKKTFLPEMSEKCEVLQYSAREAQDSKKVVEDIEYLKFDKGPWLKQDNRTLYHLRLLVQDKFEVLNYTSIPIFLPEVTIGAHQTDRVLHQFRELPGRKYSPGYNTEVGDKWIWLK

SEQ ID NO: 836179 - protein, 236 aa, Homo sapiens; identical to SEQ ID NO: 836177

SEQ ID NO: 836180 - protein, 203 aa, Homo sapiens
MALRLLKLAATSASARVVAAGAQRVRGIHSSVQCKLRYGMWPICDYLPPHLVIYIDVPVPEVQRRIQKKGDPHEMKITSAYLQDIENAYKKTFLPEMSEKCEVLQYSAREAQDSKKVVEDIEYLKFDKGPWLKQDNRTLYHLRLLVQDKFEVLNYTSIPIFLPEVTIGAHQTDRVLHQFRELPGRKYSPGYNTEVGDKWIWLK

SEQ ID NO: 836181 - protein, 129 aa, Homo sapiens [sequence omitted]

SEQ ID NO: 836182 - protein, 129 aa, Homo sapiens [sequence omitted]

SEQ ID NO: 836183 - protein, 355 aa, Homo sapiens; identical to SEQ ID NO: 836170

SEQ ID NO: 836184 - protein, 348 aa, Homo sapiens
MALRLLKLAATSASARVVRGIHSSVQCKLRYGMWHFLLGDKASKRLTERSRVITVDGNICTGKGKLAKEIAEKLGFKHFPEAGIHYPDSTTGDGKPLATDYNGNCSLEKFYDDPRSNDGNSYRLQSWLYSSRLLQYSDALEHLLTTGQGVVLERSIFSDFVFLEAMYNQGFIRKQCVDHYNEVKSVTICDYLPPHLVIYIDVPVPEVQRRIQKKGDPHEMKITSAYLQDIENAYKKTFLPEMSEKCEVLQYSAREAQDSKKVVEDIEYLKFDKGPWLKQDNRTLYHLRLLVQDKFEVLNYTSIPIFLPEVTIGAHQTDRVLHQFRELPGRKYSPGYNTEVGDKWIWLK

SEQ ID NO: 836185 - protein, 236 aa, Homo sapiens; identical to SEQ ID NO: 836177

SEQ ID NO: 836186 - protein, 201 aa, Homo sapiens
MALRLLKLAATSASARVVAAGAQRVRGIHSSVQCKLRYGMWHFLLGDKASKRLTERSRVITVDGNICTGKGKLAKEIAEKLGFKHFPEAGIHYPDSTTGDGKPLATDYNGNCSLEKFYDDPRSNDGNSYRLQSWLYSSRLLQYSDALEHLLTTGQGVVLERSIFSDFVFLEAMYNQGFIRKQCESALQTHFWVCGATLQGL

SEQ ID NO: 836187 - protein, 151 aa, Homo sapiens
APFLPILHNTIPCCDLCLMSVSPTNNPHSSHGVCCGQVKASHRVGRCSRAHRDCPSSGSGPSGDWAQKNLEPQASYTMGTDLARIGTLDTRPGFCPLYPLSHEAAKDGSSSWQVIRISSWKDSWLENWPLPRLGFFDALKLLGTWGMGGRG

SEQ ID NO: 836188 - protein, 83 aa, Homo sapiens
EEQVSTLYQNINLVEPRLIQPYEHVIKNFIREIRLQSTEMENLAIAVKRAQDKAAMQLSELEEEMDQRIQAAEHKTRKDVSFW

SEQ ID NO: 836189 - protein, 177 aa, Homo sapiens
RPALGAPYQCLTSPSHQPKWAAGTAKSNYFRLLIVWRCQWPEESTPLGLRSQGRGRVLGICALADTEPELWAPIRIQILACHVPGESQAHLSYLFAVSSGPTLLGASRTLASRLLPPWWRQINAMSKTKVLGSNGSASEAWLPSTSCVTLGQSLGVSEPPYTEIIQDLASRVAVETE

SEQ ID NO: 836190 - protein, 216 aa, Homo sapiens
FFFFFWAQKKIASLSHSGFLHWFLLFEAVSSNGVLLFFSRFRWRRRLLVISAPNDEDWAYSQQLSALSGQACNFGLRHITILKLLGVGEEVGGVLELFPINGSSVVEREDVPAHLVKDIRNYFQVSPEYFSMLLVGKDGNVKSWYPSPMWSMVIVYDLIDSMQLRRQEMAIQQSLGMRCPEDEYAGYGYHSYHQGYQDGYQDDYRHHESYHHGYPY

SEQ ID NO: 836191 - protein, 205 aa, Homo sapiens
KCQSRKTVKLQQKNYRSVAMQFNGFEKQWFRWRRRLLVISAPNDEDWAYSQQLSALSGQACNFGLRHITILKLLGVGEEVGGVLELFPINGSSVVEREDVPAHLVKDIRNYFQVSPEYFSMLLVGKDGNVKSWYPSPMWSMVIVYDLIDSMQLRRQEMAIQQSLGMRCPEDEYAGYGYHSYHQGYQDGYQDDYRHHESYHHGYPY

SEQ ID NO: 836192 - protein, 950 aa, Homo sapiens
MTWRMGPRFTMLLAMWLVCGSEPHPHATIRGSHGGRKVPLVSPDSSRPARFLRHTGRSRGIERSTLEEPNLQPLQRRRSVPVLRLARPTEPPARSDINGAAVRPEQRPAARGSPREMIRDEGSSARSRMLRFPSGSSSPNILASFAGKNRVWVISAPHASEGYYRLMMSLLKDDVYCELAERHIQQIVLFHQAGEEGGKVRRITSEGQILEQPLDPSLIPKLMSFLKLEKGKFGMVLLKKTLQVEERYPYPVRLEAMYEVIDQGPIRRIEKIRQKGFVQKCKASGVEGQVVAEGNDGGGGAGRPSLGSEKKKEDPRRAQVPPTRESRVKVLRKLAATAPALPQPPSTPRATTLPPAPATTVTRSTSRAVTVAARPMTTTAFPTTQRPWTPSPSHRPPTTTEVITARRPSVSENLYPPSRKDQHRERPQTTRRPSKATSLESFTNAPPTTISEPSTRAAGPGRFRDNRMDRREHGHRDPNVVPGPPKPAKEKPPKKKAQDKILSNEYEEKYDLSRPTASQLEDELQVGNVPLKKAKESKKHEKLEKPEKEKKKKMKNENADKLLKSEKQMKKSEKKSKQEKEKSKKKKGGKTEQDGYQKPTNKHFTQSPKKSVADLLGSFEGKRRLLLITAPKAENNMYVQQRDEYLESFCKMATRKISVITIFGPVNNSTMKIDHFQLDNEKPMRVVDDEDLVDQRLISELRKEYGMTYNDFFMVLTDVDLRVKQYYEVPITMKSVFDLIDTFQSRIKDMEKQKKEGIVCKEDKKQSLENFLSRFRWRRRLLVISAPNDEDWAYSQQLSALSGQACNFGLRHITILKLLGVGEEVGGVLELFPINGSSVVEREDVPAHLVKDIRNYFQVSPEYFSMLLVGKDGNVKSWYPSPMWSMVIVYDLIDSMQLRRQEMAIQQSLGMRCPEDEYAGYGYHSYHQGYQDGYQDDYRHHESYHHGYPY

SEQ ID NO: 836193 - protein, 950 aa, Homo sapiens; identical to SEQ ID NO: 836192

SEQ ID NO: 836194 - protein, 950 aa, Homo sapiens; identical to SEQ ID NO: 836192

SEQ ID NO: 836195 - protein, 923 aa, Homo sapiens
MTWRMGPRFTMLLAMWLVCGSEPHPHATIRGSHGGRKVPLVSPDSSRPARFLRHTGRSRGIERSTLEEPNLQPLQRRRSVPVLRLARPTEPPARSDINGAAVRPEQRPAARGSPREMIRDEGSSARSRMLRFPSGSSSPNILASFAGKNRVWVISAPHASEGYYRLMMSLLKDDVYCELAERHIQQIVLFHQAGEEGGKVRRITSEGQILEQPLDPSLIPKLMSFLKLEKGKFGMVLLKKTLQVEERYPYPVRLEAMYEVIDQGPIRRIEKIRQKGFVQKCKASGVEGQVVAEGNDGGGGAGRPSLGSEKKKEDPRRAQVPPTRESRVKVLRKLAATAPALPQPPSTPRATTLPPAPATTVTRSTSRAVTVAARPMTTTAFPTTQRPWTPSPSHRPPTTTEVITARRPSVSENLYPPSRKDQHRERPQTTRRPSKATSLESFTNAPPTTISEPSTRAAGPGRFRDNRMDRREHGHRDPNVVPGPPKPAKEKPPKKKAQDKILSNEYEEKYDLSRPTASQLEDELQVGNVPLKKAKESKKHEKLEKPEKEKKKKMKNENADKLLKSEKQMKKSEKKSKQEKEKSKKKKGGKTEQDGYQKPTNKHFTQSPKKSVADLLGSFEGKRRLLLITAPKAENNMYVQQRDEYLESFCKMATRKISVITIFGPVNNSTMKIDHFQLDNEKPMRVVDDEDLVDQRLISELRKEYGMTYNDFFMVLTDVDLRVKQYYEVPITMKSVFDLIDTFQSRIKDMEKQKKEGIVCKEDKKQSLENFLSRFRWRRRLLVISAPNDEDWAYSQQLSALSGQACNFGSSVVEREDVPAHLVKDIRNYFQVSPEYFSMLLVGKDGNVKSWYPSPMWSMVIVYDLIDSMQLRRQEMAIQQSLGMRCPEDEYAGYGYHSYHQGYQDGYQDDYRHHESYHHGYPY

SEQ ID NO: 836196 - protein, 950 aa, Homo sapiens; identical to SEQ ID NO: 836192

SEQ ID NO: 836197 - protein, 892 aa, Homo sapiens
MTWRMGPRFTMLLAMWLVCGSEPHPHATIRGSHGGRKVPLVSPDSSRPARFLRHTGRSRGIERSTLEEPNLQPLQRRRSVPVLRLARPTEPPARSDINGAAVRPEQRPAARGSPREMIRDEGSSARSRMLRFPSGSSSPNILASFAGKNRVWVISAPHASEGYYRLMMSLLKDDVYCELAERHIQQIVLFHQAGEEGGKVRRITSEGQILEQPLDPSLIPKLMSFLKLEKGKFGMVLLKKTLQVEERYPYPVRLEAMYEVIDQGPIRRIEKIRQKGFVQKCKASGVEGQVVAEGNDGGGGAGRPSLGSEKKKEDPRRAQVPPTRESRVKVLRKLAATAPALPQPPSTPRATTLPPAPATTVTRSTSRAVTVAARPMTTTAFPTTQRPWTPSPSHRPPTTTEVITARRPSVSENLYPPSRKDQHRERPQTTRRPSKATSLESFTNAPPTTISEPSTRAAGPGRFRDNRMDRREHGHRDPNVVPGPPKPAKEKPPKKKAQDKILSNEYEEKYDLSRPTASQLEDELQVGNVPLKKAKESKKHEKLEKPEKEKKKKMKNENADKLLKSEKQMKKSEKKSKQEKEKSKKKKGGKTEQDGYQKPTNKHFTQSPKKSVADLLGSFEGKRRLLLITAPKAENNMYVQQRDEYLESFCKMATRKISVITIFGPVNNSTMKIDHFQLDNEKPMRVVDDEDLVDQRLISELRKEYGMTYNDFFMVLTDVDLRVKQYYEVPITMKSVFDLIDTFQSRIKDMEKQKKEGIVCKEDKKQSLENFLSRFRWRRRLLVISAPNDEDWAYSQQLSALSGQACNFGLRHITILKLLGVGEEVGGVLELFPINGSSVVEREDVPAHLVKDIRNYFQVSPEYFSMLLVGKDGNVKSWYPSPMWSMPGWLPG

SEQ ID NO: 836198 - protein, 702 aa, Homo sapiens
MTWRMGPRFTMLLAMWLVCGSEPHPHATIRGSHGGRKVPLVSPDSSRPARFLRHTGRSRGIERSTLEEPNLQPLQRRRSVPVLRLARPTEPPARSDINGAAVRPEQRPAARGSPREMIRDEGSSARSRMLRFPSGSSSPNILASFAGKNRVWVISAPHASEGYYRLMMSLLKDDVYCELAERHIQQIVLFHQAGEEGGKVRRITSEGQILEQPLDPSLIPKLMSFLKLEKGKFGMVLLKKTLQVEERYPYPVRLEAMYEVIDQGPIRRIEKIRQKGFVQKCKASGVEGQVVAEGNDGGGGAGRPSLGSEKKKEDPRRAQVPPTRESRVKVLRKLAATAPALPQPPSTPRATTLPPAPATTVTRSTSRAVTVAARPMTTTAFPTTQRPWTPSPSHRPPTTTEVITARRPSVSENLYPPSRKDQHRERPQTTRRPSKATSLESFTNAPPTTISEPSTRAAGPGRFRDNRMDRREHGHRDPNVVPGPPKPAKEKPPKKKAQDKILSNEYEEKYDLSRPTASQLEDELQVGNVPLKKAKESKKHEKLEKPEKEKKKKMKNENADKLLKSEKQMKKSEKKSKQEKEKSKKKKGGKTEQDGYQKPTNKHFTQSPKKSVADLLGSFEGKRRLLLITAPKAENNMYVQQRDEYLESFCKMATRKWKKLEKPEKEKKKKMKNENADKLLKSEKQMKKSEKKSKPEKEKSKK

SEQ ID NO: 836199 - protein, 68 aa, Homo sapiens
EMSKESEHDSDESSDDDSDSEEPSKYINASFIMSYWKPEVMIAAQGPLQDGYQDDYRHHESYHHGYPY

SEQ ID NO: 836200 - protein, 950 aa, Homo sapiens; identical to SEQ ID NO: 836192

SEQ ID NO: 836201 - protein, 483 aa, Homo sapiens [sequence omitted]

SEQ ID NO: 836202 - protein, 950 aa, Homo sapiens; identical to SEQ ID NO: 836192

SEQ ID NO: 836203 - protein, 700 aa, Homo sapiens
MTWRMGPRFTMLLAMWLVCGSEPHPHATIRGSHGGRKVPLVSPDSSRPARFLRHTGRSRGIERSTLEEPNLQPLQRRRSVPVLRLARPTEPPARSDINGAAVRPEQRPAARGSPREMIRDEGSSARSRMLRFPSGSSSPNILASFAGKNRVWVISAPHASEGYYRLMMSLLKDDVYCELAERHIQQIVLFHQAGEEGGKVRRITSEGQILEQPLDPSLIPKLMSFLKLEKGKFGMVLLKKTLQVEERYPYPVRLEAMYEVIDQGPIRRIEKIRQKGFVQKCKASGVEGQVVAEGNDGGGGAGRPSLGSEKKKEDPRRAQVPPTRESRVKVLRKLAATAPALPQPPSTPRATTLPPAPATTVTRSTSRAVTVAARPMTTTAFPTTQRPWTPSPSHRPPTTTEVITARRPSVSENLYPPSRKDQHRERPQTTRRPSKATSLESFTNAPPTTISEPSTRAAGPGRFRDNRMDRREHGHRDPNVVPGPPKPAKEKPPKKKAQDKILSNEYEEKYDLSRPTASQLEDELQVGNVPLKKAKESKKHEKLEKPEKEKKKKMKNENADKLLKSEKQMKKSEKKSKQEKEKSKKKKGGKTEQDGYQKPTNKHFTQSPKKSVADLLGSFEGKRRLLLITAPKAENNMYVQQRDEYLESFCKMATRKISVITIFGPVNNSTMKIDHFQLGSLKHFNYIIVFLISKVGQTLW

SEQ ID NO: 836204 - protein, 321 aa, Homo sapiens
MSGPSLVGQGISQGEHVRGHAGTARVNGFNRMPPTPQSPRRLGGPHRRWVQRHSGCEASQAFPDLAGLGWAAPEIDRNRDYEKIVEQSRSQLKSGGSRAISSWAVPEIDWNRDYEKIVGQRRSKLKSGVSKPFQPSRPSQSKQWRGASQAQEPEMEEVVEELGLPLQLSTLGGGNLPGGVLEVRNLRPRNGLQLDVIAKTLLGCFQKRGGWGAVRTGEHMRGHAGTTGANGFNPTPPTPHFTVAMKTGRSAKAAGTSHGGQEASQAFLDLAQLSWAALEIDRNRNYEKIVGQMRSKLKSVGSRAISSRAAPEIDQNRDYEK

SEQ ID NO: 836205 - protein, 119 aa, Homo sapiens
MATVKCGVGGVGLKPFAPVVPACPLMCSPVRTAPQPPRFWKQPRRVLAITSSCKPFRGLRLRTSARPLAGSLRLGWKAAKAAPTLPPPPPSPAPGLGRPRATASTGWGGKVEMALRLHF

SEQ ID NO: 836206 - protein, 265 aa, Homo sapiens
EAARNRRTSESSGGVCFTAWKCECAKMRKVVLITGASSGIGLALCKRLLAEDDELHLCLACRNMSKAEAVCAALLASHPTAEVTIVQVDVSNLQSFFRASKELKQRMIKKWLYVIRVEDHCRFQRLDRIYLNAGIMPNPQLNIKALLFGLFSRKVIHMFSTAEGLLTQGDKITADGLQEVFETDVFGHFILIRELEPLLCHSDNPSQLIWTSSRNARKSNFSLEDFQHSKGKEPYSSSKYATDLLSVALNRNFQPAGAVFVCVCH

SEQ ID NO: 836207 - protein, 251 aa, Homo sapiens
EAARNRRTSESSGGVCFTAWKCECAKMRKVVLITGASSGIGLALCKRLLAEDDELHLCLACRNMSKAEAVCAALLASHPTAEVTIVQVDVSNLQSFFRASKELKQSCRFQRLDRIYLNAGIMPNPQLNIKALLFGLFSRKVIHMFSTAEGLLTQGDKITADGLQEVFETDVFGHFILIRELEPLLCHSDNPSQLIWTSSRNARKSNFSLEDFQHSKGKEPYSSSKYATDLLSVALNRNFQPAGAVFVCVCH

SEQ ID NO: 836208 - protein, 134 aa, Homo sapiens
MPNPQLNIKALLFGLFSRKVIHMFSTAEGLLTQGDKITADGLQEVFETDVFGHFILIRELEPLLCHSDNPSQLIWTSSRNARKSNFSLEDFQHSKGKEPYSSSKYATDLLSVALNRNFQPAASLFCKCIHFDTI

SEQ ID NO: 836209 - protein, 110 aa, Homo sapiens
EAARNRRTSESSGGVCFTAWKCECAKMRKVVLITGASSGIGLALCKRLLAEDDELHLCLACRNMSKAEAVCAALLASHPTAEVTIVQVDVSNLQSFFRASKELKQRYISC

SEQ ID NO: 836210 - protein, 255 aa, Homo sapiens
EAARNRRTSESSGGVCFTAWKCECAKMRKVVLITGASSGIGLALCKRLLAEDDELHLCLACRNMSKAEAVCAALLASHPTAEVTIVQVDVSNLQSFFRASKELKQSCRFQRLDRIYLNAGIMPNPQLNIKALLFGLFSRKVIHMFSTAEGLLTQGDKITADGLQEVFETDVFGHFILIRELEPLLCHSDNPSQLIWTSSRNARKSNFSLEDFQHSKGKEPYSSSKYATDLLSVALNRNFQPAASLFCKCIHFDTI

SEQ ID NO: 836211 - protein, 183 aa, Homo sapiens
EAARNRRTSESSGGVCFTAWKCECAKMRKVVLITGASSGIGLALCKRLLAEDDELHLCLACRNMSKAEAVCAALLASHPTAEVTIVQVDVSNLQSFFRASKELKQSCRFQRLDRIYLNAGIMPNPQLNIKALLFGLFSRKVIHMFSTAEGLLTQGDKITADGLQEVFETDVFGHFILVKKLWA

SEQ ID NO: 836212 - protein, 523 aa, Homo sapiens
MTQNKLKLCSKANVYTEVPDGGWGWAVAVSFFFVEVFTYGIIKTFGVFFNDLMDSFNESNSRISWIISICVFVLTFSAPLATVLSNRFGHRLVVMLGGLLVSTGMVAASFSQEVSHMYVAIGIISGLGYCFSFLPTVTILSQYFGKRRSIVTAVASTGECFAVFAFAPAIMALKERIGWRYSLLFVGLLQLNIVIFGALLRPIFIRGPASPKIVIQENRKEAQYMLENEKTRTSIDSIDSGVELTTSPKNVPTHTNLELEPKADMQQVLVKTSPRPSEKKAPLLDFSILKEKSFICYALFGLFATLGFFAPSLYIIPLGISLGIDQDRAAFLLSTMAIAEVFGRIGAGFVLNREPIRKIYIELICVILLTVSLFAFTFATEFWGLMSCSIFFGFMVGTIGGLTFHCLLKMMSWALQKMSSAAGVYIFIQSIAGLAGPPLAGLLVDQSKIYSRAFYSCAAGMALAAVCLALVRPCKMGLCQRHHSGETKVVSHRGKTLQDIPEDFLEMDLAKNEHRVHVQMEPV

SEQ ID NO: 836213 - protein, 523 aa, Homo sapiens; identical to SEQ ID NO: 836212

SEQ ID NO: 836214 - protein, 523 aa, Homo sapiens; identical to SEQ ID NO: 836212

SEQ ID NO: 836215 - protein, 463 aa, Homo sapiens
QVGIPLLDNLQPVFVTSAPLATVLSNRFGHRLVVMLGGLLVSTGMVAASFSQEVSHMYVAIGIISGLGYCFSFLPTVTILSQYFGKRRSIVTAVASTGECFAVFAFAPAIMALKERIGWRYSLLFVGLLQLNIVIFGALLRPIFIRGPASPKIVIQENRKEAQYMLENEKTRTSIDSIDSGVELTTSPKNVPTHTNLELEPKADMQQVLVKTSPRPSEKKAPLLDFSILKEKSFICYALFGLFATLGFFAPSLYIIPLGISLGIDQDRAAFLLSTMAIAEVFGRIGAGFVLNREPIRKIYIELICVILLTVSLFAFTFATEFWGLMSCSIFFGFMVGTIGGLTFHCLLKMMSWALQKMSSAAGVYIFIQSIAGLAGPPLAGLLVDQSKIYSRAFYSCAAGMALAAVCLALVRPCKMGLCQRHHSGETKVVSHRGKTLQDIPEDFLEMDLAKNEHRVHVQMEPV

SEQ ID NO: 836216 - protein, 182 aa, Homo sapiens
HSCLSPTVALDFLPEWYSELALGFLALPSFAFSVPTGALATCAGHEDKAGCPPRPHPPPAPPARSRPYACSVCGKRFSLKHQMETHYRVHTGEKPFSCSLCPQRSRDFSAMTKHLRTHGAAPYRCSLCGAGCPSLASMQAHMRGHSPSQLPPGWTIRSTFLYSSSRPSRPSTSPCCPSSSTT

SEQ ID NO: 836217 - protein, 487 aa, Homo sapiens
MSLPPIRLPSPYGSDRLVQLAARLRPALCDTLITVGSQEFPAHSLVLAGVSQQLGRRGQWALGEGISPSTFAQLLNFVYGESVELQPGELRPLQEAARALGVQSLEEACWRARGDRAKKPDPGLKKHQEEPEKPSRNPERELGDPGEKQKPEQVSRTGGREQEMLHKHSPPRGRPEMAGATQEAQQEQTRSKEKRLQAPVGQRGADGKHGVLTWLRENPGGSEESLRKLPGPLPPAGSLQTSVTPRPSWAEAPWLVGGQPALWSILLMPPRYGIPFYHSTPTTGAWQEVWREQRIPLSLNAPKGLWSQNQLASSSPTPGSLPQGPAQLSPGEMEESDQGHTGALATCAGHEDKAGCPPRPHPPPAPPARSRPYACSVCGKRFSLKHQMETHYRVHTGEKPFSCSLCPQRSRDFSAMTKHLRTHGAAPYRCSLCGAGCPSLASMQAHMRGHSPSQLPPGWTIRSTFLYSSSRPSRPSTSPCCPSSSTT

SEQ ID NO: 836218 - protein, 487 aa, Homo sapiens; identical to SEQ ID NO: 836217

SEQ ID NO: 836219 - protein, 1474 aa, Homo sapiens
PVTAAVTTTTPQVFLENTTAVTPMTAISDVETKETTYSSGATTTGVVEVSETNTSTSVTSTQSTATVNLTKTTGITTPVASVAFPKSLVASPSTITLPVASTASTSLVVVTAAASSSMVTTPTSSLGSVPIILSGINGSPPVSQRPENAAQIPVATPQVSPNTVKRAGPRLLLIPVQQGSPTLRPVSNTQLQGHRMVLQPVRSPSGMNLFRHPNGQIVQLLPLHQLRGSNTQPNLQPVMFRNPGSVMGIRLPAPSKPSETPPSSTSSSAFSVMNPVIQAVGSSSAVNVITQAPSLLSSGASFVSQAGTLTLRISPPEPQSFASKTGSETKITYSSGGQPVGTASLIPLQSGSFALLQLPGQKPVPSSILQHVASLQMKRESQNPDQKDETNSIKREQETKKVLQSEGEAVDPEANVIKQNSGAATSEETLNDSLEDRGDHLDEECLPEEGCATVKPSEHSCITGSHTDQDYKDVNEEYGARNRKSSKEKVAVLEVRTISEKASNKTVQNLSKVQHQKLGDVKVEQQKGFDNPEENSSEFPVTFKEESKFELSGSKVMEQQSNLQPEAKEKECGDSLEKDRERWRKHLKGPLTRKCVGASQECKKEADEQLIKETKTCQENSDVFQQEQGISDLLGKSGITEDARVLKTECDSWSRISNPSAFSIVPRRAAKSSRGNGHFQGHLLLPGEQIQPKQEKKGGRSSADFTVLDLEEDDEDDNEKTDDSIDEIVDVVSDYQSEEVDDVEKNNCVEYIEDDEEHVDIETVEELSEEINVAHLKTTAAHTQSFKQPSCTHISADEKAAERSRKAPPIPLKLKPDYWSDKLQKEAEAFAYYRRTHTANERRRRGEMRDLFEKLKITLGLLHSSKVSKSLILTRAFSEIQGLTDQADKLIGQKNLLTRKRNILIRKVSSLSGKTEEVVLKKLEYIYAKQQALEAQKRKKKMGSDEFDISPRISKQQEGSSASSVDLGQMFINNRRGKPLILSRKKDQATENTSPLNTPHTSANLVMTPQGQLLTLKGPLFSGPVVAVSPDLLESDLKPQVAGSAVALPENDDLFMMPRIVNVTSLATEGGLVDMGGSKYPHEVPDSKPSDHLKDTVRNEDNSLEDKGRISSRGNRDGRVTLGPTQVFLANKDSGYPQIVDVSNMQKAQEFLPKKISGDMRGIQYKWKESESRGERVKSKDSSFHKLKMKDLKDSSIEMELRKVTSAIEEAALDSSELLTNMEDEDDTDETLTSLLNEIAFLNQQLNDDSVGLAELPSSMDTEFPGDARRAFISKVPPGSRATFQVEHLGTGLKELPDVQGESDSISPLLLHLEDDDFSENEKQLAEPASEPDVLKIVIDSEIKDSLLSNKKAIDGGKNTSGLPAEPESVSSPPTLHMKTGLENSNSTDTLWRPMPKLAPLGLKVANPSSDADGQSLKVMPCLAPIAAKVGSVGHKMNLTGNDQEGRESKVMPTLAPVVAKLGNSGASPSSAGK

SEQ ID NO: 836220 - protein, 1279 aa, Homo sapiens
MVLQPVRSPSGMNLFRHPNGQIVQLLPLHQLRGSNTQPNLQPVMFRNPGSVMGIRLPAPSKPSETPPSSTSSSAFSVMNPVIQAVGSSSAVNVITQAPSLLSSGASFVSQAGTLTLRISPPEPQSFASKTGSETKITYSSGGQPVGTASLIPLQSGSFALLQLPGQKPVPSSILQHVASLQMKRESQNPDQKDETNSIKREQETKKVLQSEGEAVDPEANVIKQNSGAATSEETLNDSLEDRGDHLDEECLPEEGCATVKPSEHSCITGSHTDQDYKDVNEEYGARNRKSSKEKVAVLEVRTISEKASNKTVQNLSKVQHQKLGDVKVEQQKGFDNPEENSSEFPVTFKEESKFELSGSKVMEQQSNLQPEAKEKECGDSLEKDRERWRKHLKGPLTRKCVGASQECKKEADEQLIKETKTCQENSDVFQQEQGISDLLGKSGITEDARVLKTECDSWSRISNPSAFSIVPRRAAKSSRGNGHFQGHLLLPGEQIQPKQEKKGGRSSADFTVLDLEEDDEDDNEKTDDSIDEIVDVVSDYQSEEVDDVEKNNCVEYIEDDEEHVDIETVEELSEEINVAHLKTTAAHTQSFKQPSCTHISADEKAAERSRKAPPIPLKLKPDYWSDKLQKEAEAFAYYRRTHTANERRRRGEMRDLFEKLKITLGLLHSSKVSKSLILTRAFSEIQGLTDQADKLIGQKNLLTRKRNILIRKVSSLSGKTEEVVLKKLEYIYAKQQALEAQKRKKKMGSDEFDISPRISKQQEGSSASSVDLGQMFINNRRGKPLILSRKKDQATENTSPLNTPHTSANLVMTPQGQLLTLKGPLFSGPVVAVSPDLLESDLKPQVAGSAVALPENDDLFMMPRIVNVTSLATEGGLVDMGGSKYPHEVPDSKPSDHLKDTVRNEDNSLEDKGRISSRGNRDGRVTLGPTQVFLANKDSGYPQIVDVSNMQKAQEFLPKKISGDMRGIQYKWKESESRGERVKSKDSSFHKLKMKDLKDSSIEMELRKVTSAIEEAALDSSELLTNMEDEDDTDETLTSLLNEIAFLNQQLNDDSVGLAELPSSMDTEFPGDARRAFISKVPPGSRATFQVEHLGTGLKELPDVQGESDSISPLLLHLEDDDFSENEKQLAEPASEPDVLKIVIDSEIKDSLLSNKKAIDGGKNTSGLPAEPESVSSPPTLHMKTGLENSNSTDTLWRPMPKLAPLGLKVANPSSDADGQSLKVMPCLAPIAAKVGSVGHKMNLTGNDQEGRESKVMPTLAPVVAKLGNSGASPSSAGK

SEQ ID NO: 836221 - protein, 1279 aa, Homo sapiens; identical to SEQ ID NO: 836220

SEQ ID NO: 836222 - protein, 1279 aa, Homo sapiens; identical to SEQ ID NO: 836220

SEQ ID NO: 836223 - protein, 102 aa, Homo sapiens
YEGRINETFCLQSKFGLGPQNMKVKGRGRTDCPCPLLQNQVTWRERSMEQIASFVHALGPCSAGLREAEVLASRLQRLPATKGGGSNYPWGWTALGRARRQA

SEQ ID NO: 836224 - protein, 102 aa, Homo sapiens; identical to SEQ ID NO: 836223

SEQ ID NO: 836225 - protein, 102 aa, Homo sapiens; identical to SEQ ID NO: 836223

SEQ ID NO: 836226 - protein, 129 aa, Homo sapiens
MGAPALPSPSLKQLGSKSHVCRVPVSRLSKWHPAEAAPGSDACEILYWFPFWSNASVQCLGSSECQAQALAQWVEVSFRGQDYKSLFWSPRGFSLTVSPHQEPLPTLSRFPAGQAASNPLLTSHVSHIF

SEQ ID NO: 836227 - protein, 937 aa, Homo sapiens
TESHHVGQAGLKLPNSEIIHLPPPPKVPGLKAGANAHGLLGCWDYRREPRRLAFLLYFLNFPIVCMYDFYNHKVKNENAFLKINVKFENIVSFVLNDIESHAENKSAIDENQLSRLHMILKPFMLRRIKKDVENELSDKIEILMYCQLTSRQKLLYQALKNKISIEDLLQSSMGSTQQAQNTTSSLMNLVMQFRKVCNHPELFERQETWSPFHISLKPYHISKFIYRHGQIRVFNHSRDRWLRVLSPFAPDYIQRSLFHRKGINEESCFSFLRFIDISPAEMANLMLQGLLARWLALFLSLKASYRLHQLRSWGAPEGESHQRYLRNKDFLLGVNFPLSFPNLCSCPLLKSLVFSSHCKAVSGYSDQVVHQRRSATSSLRRCLLTELPSFLCVASPRVTAVPLDSYCNDRSAEYERRVLKEGGSLAAKQCLLNGAPELAADWLNRRSQFFPEPAGGLWSIRPQNGWSFIRIPGKESLITDSGKLYALDVLLTRLKSQGHRVLIYSQMTRMIDLLEEYMVYRKHTYMRLDGSSKISERRDMVADFQNRNDIFVFLLSTRAGGLGINLTAADTVIFYDSDWNPTVDQQAMDRAHRLGQTKQVTVYRLICKGTIEERILQRAKEKSEIQRMVISGGNFKPDTLKPKEVVSLLLDDEELEKKLRLRQEEKRQQEETNRVKERKRKREKYAEKKKKEDELDGKRRKEGVNLVIPFVPSADNSNLSADGDDSFISVDSAMPSPFSEISISSELHTGSIPLDESSSDMLVIVDDPASSAPQSRATNSPASITGSVSDTVNGISIQEMPAAGRGHSARSRGRPKGSGSTAKGAGKGRSRKSTAGSAAAMAGAKAGAAAASAAAYAAYGYNVSKGISASSPLQTSLVRPAGLADFGPSSASSPLSSPLSKGNNVPGNPKNLHMTSSLAPDSLVRKQGKGTNPSGGR

SEQ ID NO: 836228 - protein, 896 aa, Homo sapiens
NSVRWKILLQFQCRNRLLLTGTPIQNTMAELWALLHFIMPTLFDSHEEFNEWFSKDIESHAENKSAIDENQLSRLHMILKPFMLRRIKKDVENELSDKIEILMYCQLTSRQKLLYQALKNKISIEDLLQSSMGSTQQAQNTTSSLMNLVMQFRKVCNHPELFERQETWSPFHISLKPYHISKFIYRHGQIRVFNHSRDRWLRVLSPFAPDYIQRSLFHRKGINEESCFSFLRFIDISPAEMANLMLQGLLARWLALFLSLKASYRLHQLRSWGAPEGESHQRYLRNKDFLLGVNFPLSFPNLCSCPLLKSLVFSSHCKAVSGYSDQVVHQRRSATSSLRRCLLTELPSFLCVASPRVTAVPLDSYCNDRSAEYERRVLKEGGSLAAKQCLLNGAPELAADWLNRRSQFFPEPAGGLWSIRPQNGWSFIRIPGKESLITDSGKLYALDVLLTRLKSQGHRVLIYSQMTRMIDLLEEYMVYRKHTYMRLDGSSKISERRDMVADFQNRNDIFVFLLSTRAGGLGINLTAADTVIFYDSDWNPTVDQQAMDRAHRLGQTKQVTVYRLICKGTIEERILQRAKEKSEIQRMVISGGNFKPDTLKPKEVVSLLLDDEELEKKLRLRQEEKRQQEETNRVKERKRKREKYAEKKKKEDELDGKRRKEGVNLVIPFVPSADNSNLSADGDDSFISVDSAMPSPFSEISISSELHTGSIPLDESSSDMLVIVDDPASSAPQSRATNSPASITGSVSDTVNGISIQEMPAAGRGHSARSRGRPKGSGSTAKGAGKGRSRKSTAGSAAAMAGAKAGAAAASAAAYAAYGYNVSKGISASSPLQTSLVRPAGLADFGPSSASSPLSSPLSKGNNVPGNPKNLHMTSSLAPDSLVRKQGKGTNPSGGR

SEQ ID NO: 836229 - protein, 325 aa, Homo sapiens
EHKQNTADKILPKDQIFQFSLKIEKISMHVPEKYKHHDASRGYKNVKNAHKANRKTEETAKREEKQAGRTQKKNRKKKKEDELDGKRRKEGVNLVIPFVPSADNSNLSADGDDSFISVDSAMPSPFSEISISSELHTGSIPLDESSSDMLVIVDDPASSAPQSRATNSPASITGSVSDTVNGISIQEMPAAGRGHSARSRGRPKGSGSTAKGAGKGRSRKSTAGSAAAMAGAKAGAAAASAAAYAAYGYNVSKGISASSPLQTSLVRPAGLADFGPSSASSPLSSPLSKGNNVPGNPKNLHMTSSLAPDSLVRKQGKGTNPSGGR

SEQ ID NO: 836230 - protein, 109 aa, Homo sapiens
VTAVPLDSYCNDRSAEYERRVLKEGGSLAAKQCLLNGAPELAADWLNRRSQFFPEPAGGLWSIRPQNGWSFIRIPGEFSILLECVPRFGKGRTRVIFMWSFQIFGIYCS

SEQ ID NO: 836231 - protein, 896 aa, Homo sapiens; identical to SEQ ID NO: 836228

SEQ ID NO: 836232 - protein, 896 aa, Homo sapiens; identical to SEQ ID NO: 836228

SEQ ID NO: 836233 - protein, 292 aa, Homo sapiens
RAVTRRRAARRISASGEWLVCSARRGPSCDPGPAPGTPAMDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKVSPWNSSTCQIQTIVTGLRRNVKGHMRPSRAS

SEQ ID NO: 836234 - protein, 126 aa, Homo sapiens
ESGPPSLPSLLVAPPPTPQEDPYELGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISS

SEQ ID NO: 836235 - protein, 88 aa, Homo sapiens
RSSSLVFTASGAPNTAELKICRVNRNSGSCLGGDEIFLLCDKVQKGIHQEAGVGSWEQGVKLSREVECQVTGFGYFLLCLGGLRWAEG

SEQ ID NO: 836236 - protein, 590 aa, Homo sapiens
RAVTRRRAARRISASGEWLVCSARRGPSCDPGPAPGTPAMDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKEDIEVYFTGPGWEARGSFSQADVHRQVAIVFRTPPYADPSLQAPVRVSMQLRRPSDRELSEPMEFQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISS

SEQ ID NO: 836237 - protein, 590 aa, Homo sapiens; identical to SEQ ID NO: 836236

SEQ ID NO: 836238 - protein, 590 aa, Homo sapiens; identical to SEQ ID NO: 836236

SEQ ID NO: 836239 - protein, 581 aa, Homo sapiens
RAVTRRRAARRISASGEWLVCSARRGPSCDPGPAPGTPAMDEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKEDIEVYFTGPGWEARGSFSQADVHRQVAIVFRTPPYADPSLQAPVRVSMQLRRPSDRELSEPMEFQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISS

SEQ ID NO: 836240 - protein, 557 aa, Homo sapiens
RAVSDGGPRGAFPPLANGSSVVHAAGPAATPAPPPGPRPWTNCSPSSSRQSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKEDIEVYFTGPGWEARGSFSQADVHRQVAIVFRTPPYADPSLQAPVRVSMQLRRPSDRELSEPMEFQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISS

SEQ ID NO: 836241 - protein, 500 aa, Homo sapiens
LAEYQGAKLPSINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKEDIEVYFTGPGWEARGSFSQADVHRQVAIVFRTPPYADPSLQAPVRVSMQLRRPSDRELSEPMEFQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISS

SEQ ID NO: 836242 - protein, 475 aa, Homo sapiens
MGDDLGVGRVGRSRLGKAGRSGLCERQWDRRLGALSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKEDIEVYFTGPGWEARGSFSQADVHRQVAIVFRTPPYADPSLQAPVRVSMQLRRPSDRELSEPMEFQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISS

SEQ ID NO: 836243 - protein, 463 aa, Homo sapiens
MTFRPQWSQCWVLPPLGLVFHTRTSGPPSAELPAPTDSTYIPTSPALLIACFLAVPIEEQRGDYDLNAVRLCFQVTVRDPSGRPLRLPPVLSHPIFDNRAPNTAELKICRVNRNSGSCLGGDEIFLLCDKVQKEDIEVYFTGPGWEARGSFSQADVHRQVAIVFRTPPYADPSLQAPVRVSMQLRRPSDRELSEPMEFQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISS

SEQ ID NO: 836244 - protein, 282 aa, Homo sapiens
MQLRRPSDRELSEPMEFQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISS

SEQ ID NO: 836245 - protein, 235 aa, Homo sapiens
RAVTRRRAARRISASGEWLVCSARRGPSCDPGPAPGTPAMDELFPLIFPAEPAQASGPYVEIIEQPKQRGMRFRYKCEGRSAGSIPGERSTDTTKTHPTIKINGYTGPGTVRISLVTKDPPHRPSDRELSEPMEFQYLPDTDDRHRIEEKRKRTYETFKSIMKKSPFSGPTDPRPPPRRIAVPSRSSASVPKPGPGPSPCPSPSPRPSSGCGPTCPQAHPGWGRNAVRGPAAAAV

SEQ ID NO: 836246 - protein, 366 aa, Homo sapiens
MGDDLGVGRVGRSRLGKAGRSGLCERQWDRRLGALSFQNLGIQCVKKRDLEQAISQRIQTNNNPFQVPIEEQRGDYDLNAVRVSMQLRRPSDRELSEPMEFQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISS

SEQ ID NO: 836247 - protein, 416 aa, Homo sapiens
RAVTRRRAARRISASGEWLVCSARRGPSCDPGPAPGTPAMDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKEDIEVYFTGPGWEARGSFSQADVHRQVAIVFRTPPYADPSLQAPVRVSMQLRRPSDRELSEPMEFQYLPDTDDRHRIEEKRKRTYETFKSIMKKSPFSGPTDPRPPPRRIAVPSRSSASVPKPGKDFLLSHWNDRFSSVQLRSSGDEDSWAPLQTY

SEQ ID NO: 836248 - protein, 386 aa, Homo sapiens
RAVTRRRAARRISASGEWLVCSARRGPSCDPGPAPGTPAMDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKEDIEVYFTGPGWEARGSFSQADVHRQVAIVFRTPPYADPSLQAPVRVSMQLRRPSDRELSEPMEFQYLPDTDDRHRIEEKRKRTYETFKSIMKKSPFSGTTCPTCGTSYCRNRNSIQAHAVSALPV

SEQ ID NO: 836249 - protein, 550 aa, Homo sapiens
HEAGPGRSWARGMDELFPLIFPAEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKEDIEVYFTGPGWEARGSFSQADVHRQVAIVFRTPPYADPSLQAPVRVSMQLRRPSDRELSEPMEFQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISS

SEQ ID NO: 836250 - protein, 467 aa, Homo sapiens
RAVTRRRAARRISASGEWLVCSARRGPSCDPGPAPGTPAMDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISS

SEQ ID NO: 836251 - protein, 285 aa, Homo sapiens
RAVSDGGPRGAFPPLANGSSVVHAAGPAATPAPPPGPRPWTNCSPSSSRQINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKEDIEVYFTGPGWEARGSFSQADVHRQVAIVFRTPPYADPSLQAPVRVSMQLRRPSDRELSEPMEFQYLPDTDDRPA

SEQ ID NO: 836252 - protein, 590 aa, Homo sapiens; identical to SEQ ID NO: 836236

SEQ ID NO: 836253 - protein, 663 aa, Homo sapiens
RAVTRRRAARRISASGEWLVCSARRGPSCDPGPAPGTPAMDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKGIHQEAGVGSWEQGVKLSREVECQVTGFGYFLLCLGGLRWAEGRCIRRQASEVEGETMEGYDTLTHTATASPAEDIEVYFTGPGWEARGSFSQADVHRQVAIVFRTPPYADPSLQAPVRVSMQLRRPSDRELSEPMEFQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISS

SEQ ID NO: 836254 - protein, 590 aa, Homo sapiens; identical to SEQ ID NO: 836236

SEQ ID NO: 836255 - protein, 590 aa, Homo sapiens
AGAARLCGAARAAFPPHSRRRSCAGSGRPAGWWRGAGQAGRELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKEDIEVYFTGPGWEARGSFSQADVHRQVAIVFRTPPYADPSLQAPVRVSMQLRRPSDRELSEPMEFQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISS

SEQ ID NO: 836256 - protein, 539 aa, Homo sapiens
RAVSDGGPRGAFPPLANGSSVVHAAGPAATPAPPPGPRPWTNCSPSSSRQINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKEDIEVYFTGPGWEARGSFSQADVHRQVAIVFRTPPYADPSLQAPVRVSMQLRRPSDRELSEPMEFQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISS

SEQ ID NO: 836257 - protein, 463 aa, Homo sapiens; identical to SEQ ID NO: 836243

SEQ ID NO: 836258 - protein, 484 aa, Homo sapiens
RAVTRRRAARRISASGEWLVCSARRGPSCDPGPAPGTPAMDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNHDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISS

SEQ ID NO: 836259 - protein, 400 aa, Homo sapiens
RAVTRRRAARRISASGEWLVCSARRGPSCDPGPAPGTPAMDELFPLIFPAEPAQASGPYVEIIEQPKQRGMRFRYKCEGRSAGSIPGERSTDTTKTHPTIKINGYTGPGTVRISLVTKDPPHRPSDRELSEPMEFQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISS

SEQ ID NO: 836260 - protein, 239 aa, Homo sapiens
MKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISS

SEQ ID NO: 836261 - protein, 399 aa, Homo sapiens
RAVTRRRAARRISASGEWLVCSARRGPSCDPGPAPGTPAMDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKEDIEVYFTGPGWEARGSFSQADVHRQVAIVFRTPPYADPSLQAPVRVSMQLRRPSDRELSEPMEFQYLPDTDDRHRIEEKRKRTYETFKSIMKKSPFSGPTDPRPPPRRIAVPSRSSASVPKPAPQPSSAYPMGRAEVT

SEQ ID NO: 836262 - protein, 336 aa, Homo sapiens
RAVTRRRAARRISASGEWLVCSARRGPSCDPGPAPGTPAMDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKEDIEVYFTGPGWEARGSFSQADVHRQVAIVFRTPPYADPSLQAPVRVSMQLRRPSDRELSEPMEFQYLPDTDDRPA

SEQ ID NO: 836263 - protein, 284 aa, Homo sapiens
MSMLPSFGFTQEQVACVCEVLQQGGNLERLGRFLWSLPACDHLHKNESVLKAKAVVAFHRGNFRELYKILESHQFSPHNHPKLQQLWLKAHYVEAEKLRGRPLGAVGKYRVRRKFPLPRTIWDGEETSYCFKEKSRGVLREWYAHNPYPSPREKRELAEATGLTTTQVSNWFKNRRQRDRAAEAKERENTENNNSSSNKQNQLSPLEGGKPLMSSSEEEFSPPQSPDQNSVLLLQGNMGHARSSNYSLPGLTASQPSHGLQTHQHQLQDSLLGPLTSSLVDLGS

SEQ ID NO: 836264 - protein, 173 aa, Homo sapiens
MSMLPSFGFTQEQVACVCEVLQQGGNLERLGRFLWSLPACDHLHKNESVLKAKAVVAFHRGNFRELYKILESHQFSPHNHPKLQQLWLKAHYVEAEKLRGRPLGAVGKYRVRRKFPLPRTIWDGEETSYCFKEKSRGVLREWYAHNPYPSPREKRELAEATGLTTTQGEHRKQ

SEQ ID NO: 836265 - protein, 251 aa, Homo sapiens
RDLFFRTASGWERTLTTQNSFTNGLVLGFSSLSPQISLPEPQAYSDLAGSGVPQEQVGCCSGATPAIGAGVPKGRGHPEFPTKQRKKNFGTSAGFGESPHCPRAMTRIIEETPLYALPFQIFVGRVESSPSFWMVKEFQESGPGAPNYLATSQKGNKWVPARGVCIKACQPSRETLATANAVPLNAFSSTKAHAAVTCTEEALESRNLASGAPCQRCSLPSRAAARAAAGWLELLISFKSPTHLCFSCDLH

SEQ ID NO: 836266 - protein, 284 aa, Homo sapiens; identical to SEQ ID NO: 836263

SEQ ID NO: 836267 - protein, 251 aa, Homo sapiens; identical to SEQ ID NO: 836265

SEQ ID NO: 836268 - protein, 1122 aa, Homo sapiens
MVEEAIVSMTAVAWYINDMKRKQEHAARLQEVQRRLGGWTGPELSAFGELVLEGAFRGGGGGGPRLRGGERLLFLFSRMLLVAKRRGLEYTYKGHIFCCNLSVSESPRDPLGFKVSDLTIPKHRHLLQAKNQEEKRLWIHCLQRLFFENHPASIPAKAKQVLLENSLHCAPKSKPVLEPLTPPLGSPRPRDARSFTPGRRNTAPSPGPSVIRRGRRQSEPVKDPYVMFPQNAKPGFKHAGSEGELYPPESQPPVSGSAPPEDLEDAGPPTLDPSGTSITEEILELLNQRGLRDPGPSTHDIPKFPGDSQVPGDSETLTFQALPSRDSSEEEEEEEEGLEMDERGPSPLHVLEGLESSIAAEMPSIPCLTKIPDVPNLPEIPSRCEIPEGSRLPSLSDISDVFEMPCLPAIPSVPNTPSLSSTPTLSCDSWLQGPLQEPAEAPATRRELFSGSNPGKLGEPPSGGKAGPEEDEEGVSFTDFQPQDVTQHQGFPDELAFRSCSEIRSAWQALEQGQLARPGFPEPLLILEDSDLGGDSGSGKAGAPSSERTASRVRELARLYSERIQQMQRAETRASANAPRRRPRVLAQPQPSPCLPQEQAEPGLLPAFGHVLVCELAFPLTCAQESVPLGPAVWVQAAIPLSKQGGSPDGQGLHVSNLPKQDLPGIHVSAATLLPEQGGSRHVQAPAATPLPKQEGPLHLQVPALTTFSDQGHPEIQVPATTPLPEHRSHMVIPAPSTAFCPEQGHCADIHVPTTPALPKEICSDFTVSVTTPVPKQEGHLDSESPTNIPLTKQGGSRDVQGPDPVCSQPIQPLSWHGSSLDPQGPGDTLPPLPCHLPDLQIPGTSPLPAHGSHLDHRIPANAPLSLSQELPDTQVPATTPLPLPQVLTDIWVQALPTSPKQGSLPDIQGPAAAPPLPEPSLTDTQVQKLTPSLEQKSLIDAHVPAATPLPERGGSLDIQGLSPTPVQTTMVLSKPGGSLASHVARLESSDLTPPHSPPPSSRQLLGPNAAALSRYLAASYISQSLARRQGPGGGAPAASRGSWSSAPTSRASSPPPQPQPPPPPARRLSYATTVNIHVGGGGRLRPAKAQVRLNHPALLASTQESMGLHRAQGAPDAPFHM

SEQ ID NO: 836269 - protein, 1122 aa, Homo sapiens; identical to SEQ ID NO: 836268

SEQ ID NO: 836270 - protein, 1032 aa, Homo sapiens
MVEEAIVSMTAVAWYINDMKRKQEHAARLQEVQRRLGGWTGPELSAFGELVLEGAFRGGGGGGPRLRGGERLLFLFSRMLLVAKRRGLEYTYKGHIFCCNLSVSESPRDPLGFKVSDLTIPKHRHLLQAKNQEEKRLWIHCLQRLFFENHPASIPAKAKQVLLENSLHCAPKSKPVLEPLTPPLGSPRPRDARSFTPGRRNTAPSPGPSVIRRGRRQSEPVKDPYVMFPQNAKPGFKHAGSEGELYPPESQPPVSGSAPPEDLEDAGPPTLDPSGTSITEEILELLNQRGLRDPGPSTHDIPKFPGDSQVPGDSETLTFQALPSRDSSEEEEEEEEGLEMDERGPSPLHVLEGLESSIAAEMPSIPCLTKIPDVPNLPEIPSRCEIPEGSRLPSLSDISDVFEMPCLPAIPSVPNTPSLSSTPTLSCDSWLQGPLQEPAEAPATRRELFSGSNPGKLGEPPSGGKAGPEEDEEGVSFTDFQPQDVTQHQGFPDELAFRSCSEIRSAWQALEQGQLARPGFPEPLLILEDSDLGGDSGSGKAGAPSSERTASRVRELARLYSERIQQMQRAETRASANAPRRRPRVLAQPQPSPCLPQEQAEPGLLPAFGHVLVCELAFPLTCAQESVPLGPAVWVQAAIPLSKQGGSPDGQGLHVSNLPKQDLPGIHVSAATLLPEQGGSRHVQAPAATPLPKQEGPLHLQVPALTTFSDQGHPEIQVPATTPLPEHRSHMVIPAPSTAFCPEQGHCADIHVPTTPALPKEICSDFTVSVTTPVPKQEGHLDSESPTNIPLTKQGGSRDVQGPDPVCSQPIQPLSWHGSSLDPQGPGDTLPPLPCHLPDLQIPGTSPLPAHGSHLDHRIPANAPLSLSQELPDTQVPATTPLPLPQVLTDIWVQALPTSPKQGSLPDIQGPAAAPPLPEPSLTDTQVQKLTPSLEQKSLIDAHVPAATPLPERGGSLDIQGLSPTPVQTTMVLSKPGGSLASHVARNLWAFTGPRGLLMPPSTCEPGHEASLKQGFQPDAIDPQNLTWKSRH

SEQ ID NO: 836271 - protein, 577 aa, Homo sapiens
MPEGAQGLSLSKPSPSLGCGRRGEVCDCGTVCETRTAPAAPTMASPRGSGSSTSLSTVGSEGDPAPGPTPACSASRPEPLPGPPIRLHLSPVGIPGSARPSRLERVAREIVETERAYVRDLRSIVEDYLGPLLDGGVLGLSVEQVGTLFANIEDIYEFSSELLEDLENSSSAGGIAECFVQRSEDFDIYTLYCMNYPSSLALLRELSLSPPAALWLQERQAQLRHSLPLQSFLLKPVQRILKYHLLLQELGKHWAEGPGTGGREMVEEAIVSMTAVAWYINDMKRKQEHAARLQEVQRRLGGWTGPELSAFGELVLEGAFRGGGGGGPRLRGGERLLFLFSRMLLVAKRRGLEYTYKGHIFCCNLSVSESPRDPLGFKVSDLTIPKHRHLLQAKNQEEKRLWIHCLQRLFFENHPASIPAKAKQVLLENSLHCAPKSKPVLEPLTPPLGSPRPRDARSFTPGRRNTAPSPGPSVIRRGRRQSEPVKDPYVMFPQNAKPGFKHAGSEGELYPPESQPPVSGSAPPEDLEDAGPPTLDPSGTSITEEILELLNQRGLRDPGESMGLHRAQGAPDAPFHM

SEQ ID NO: 836272 - protein, 534 aa, Homo sapiens
RWSSGPDSILFSHSGLLPAFGHVLVCELAFPLTCAQESVPLGPAVWVQAAIPLSKQGGSPDGQGLHVSNLPKQDLPGIHVSAATLLPEQGGSRHVQAPAATPLPKQEGPLHLQVPALTTFSDQGHPEIQVPATTPLPEHRSHMVIPAPSTAFCPEQGHCADIHVPTTPALPKEICSDFTVSVTTPVPKQEGHLDSESPTNIPLTKQGGSRDVQGPDPVCSQPIQPLSWHGSSLDPQGPGDTLPPLPCHLPDLQIPGTSPLPAHGSHLDHRIPANAPLSLSQELPDTQVPATTPLPLPQVLTDIWVQALPTSPKQGSLPDIQGPAAAPPLPEPSLTDTQVQKLTPSLEQKSLIDAHVPAATPLPERGGSLDIQGLSPTPVQTTMVLSKPGGSLASHVARLESSDLTPPHSPPPSSRQLLGPNAAALSRYLAASYISQSLARRQGPGGGAPAASRGSWSSAPTSRASSPPPQPQPPPPPARRLSYATTVNIHVGGGGRLRPAKAQVRLNHPALLASTQESMGLHRAQGAPDAPFHM

SEQ ID NO: 836273 - protein, 437 aa, Homo sapiens
MVEEAIVSMTAVAWYINDMKRKQEHAARLQEVQRRLGGWTGPELSAFGELVLEGAFRGGGGGGPRLRGGERLLFLFSRMLLVAKRRGLEYTYKGHIFCCNLSVSESPRDPLGFKVSDLTIPKHRHLLQAKNQEEKRLWIHCLQRLFFENHPASIPAKAKQVLLENSLHCAPKSKPVLEPLTPPLGSPRPRDARSFTPGRRNTAPSPGPSVIRRGRRQSEPVKDPYVMFPQNAKPGFKHAGSEGELYPPESQPPVSGSAPPEDLEDAGPPTLDPSGTSITEEILELLNQRGLRDPGPSTHDIPKFPGDSQVPGDSETLTFQALPSRDSSEEEEEEEEGLEMDERGPSPLHVLEGLESSIAAEMPSIPCLTKIPDVPNLPEIPSRCEIPEGSRLPSLSDISDVFEMPCLPAIPSVPNTPSLSSTPTLSCDSWLQGPLWG

SEQ ID NO: 836274 - protein, 97 aa, Homo sapiens
SGYVVGRGGPRWSSGPDSILFSHSGLLPAFGHVLVCELAFPLTCAQESVPLGPAVWVQAAIPLSKQGGSPDGQGLHVSNLPKQDLPGIHVSAATLLP

SEQ ID NO: 836275 - protein, 1386 aa, Homo sapiens
MPEGAQGLSLSKPSPSLGCGRRGEVCDCGTVCETRTAPAAPTMASPRGSGSSTSLSTVGSEGDPAPGPTPACSASRPEPLPGPPIRLHLSPVGIPGSARPSRLERVAREIVETERAYVRDLRSIVEDYLGPLLDGGVLGLSVEQVGTLFANIEDIYEFSSELLEDLENSSSAGGIAECFVQRSEDFDIYTLYCMNYPSSLALLRELSLSPPAALWLQERQAQLRHSLPLQSFLLKPVQRILKYHLLLQELGKHWAEGPGTGGREMVEEAIVSMTAVAWYINDMKRKQEHAARLQEVQRRLGGWTGPELSAFGELVLEGAFRGGGGGGPRLRGGERLLFLFSRMLLVAKRRGLEYTYKGHIFCCNLSVSESPRDPLGFKVSDLTIPKHRHLLQAKNQEEKRLWIHCLQRLFFENHPASIPAKAKQVLLENSLHCAPKSKPVLEPLTPPLGSPRPRDARSFTPGRRNTAPSPGPSVIRRGRRQSEPVKDPYVMFPQNAKPGFKHAGSEGELYPPESQPPVSGSAPPEDLEDAGPPTLDPSGTSITEEILELLNQRGLRDPGPSTHDIPKFPGDSQVPGDSETLTFQALPSRDSSEEEEEEEEGLEMDERGPSPLHVLEGLESSIAAEMPSIPCLTKIPDVPNLPEIPSRCEIPEGSRLPSLSDISDVFEMPCLPAIPSVPNTPSLSSTPTLSCDSWLQGPLQEPAEAPATRRELFSGSNPGKLGEPPSGGKAGPEEDEEGVSFTDFQPQDVTQHQGFPDELAFRSCSEIRSAWQALEQGQLARPGFPEPLLILEDSDLGGDSGSGKAGAPSSERTASRVRELARLYSERIQQMQRAETRASANAPRRRPRVLAQPQPSPCLPQEQAEPGLLPAFGHVLVCELAFPLTCAQESVPLGPAVWVQAAIPLSKQGGSPDGQGLHVSNLPKQDLPGIHVSAATLLPEQGGSRHVQAPAATPLPKQEGPLHLQVPALTTFSDQGHPEIQVPATTPLPEHRSHMVIPAPSTAFCPEQGHCADIHVPTTPALPKEICSDFTVSVTTPVPKQEGHLDSESPTNIPLTKQGGSRDVQGPDPVCSQPIQPLSWHGSSLDPQGPGDTLPPLPCHLPDLQIPGTSPLPAHGSHLDHRIPANAPLSLSQELPDTQVPATTPLPLPQVLTDIWVQALPTSPKQGSLPDIQGPAAAPPLPEPSLTDTQVQKLTPSLEQKSLIDAHVPAATPLPERGGSLDIQGLSPTPVQTTMVLSKPGGSLASHVARLESSDLTPPHSPPPSSRQLLGPNAAALSRYLAASYISQSLARRQGPGGGAPAASRGSWSSAPTSRASSPPPQPQPPPPPARRLSYATTVNIHVGGGGRLRPAKAQVRLNHPALLASTQESMGLHRAQGAPDAPFHM

SEQ ID NO: 836276 - protein, 896 aa, Homo sapiens [sequence omitted]

SEQ ID NO: 836277 - protein, 732 aa, Homo sapiens
MVEEAIVSMTAVAWYINDMKRKQEHAARLQEVQRRLGGWTGPELSAFGELVLEGAFRGGGGGGPRLRGGERLLFLFSRMLLVAKRRGLEYTYKGHIFCCNLSVSESPRDPLGFKVSDLTIPKHRHLLQAKNQEEKRLWIHCLQRLFFENHPASIPAKAKQVLLENSLHCAPKSKPVLEPLTPPLGSPRPRDARSFTPGRRNTAPSPGPSVIRRGRRQSEPVKDPYVMFPQNAKPGFKHAGSEGELYPPESQPPVSGSAPPEDLEDAGPPTLDPSGTSITEEILELLNQRGLRDPGPSTHDIPKFPGDSQVPGDSETLTFQALPSRDSSEEEEEEEEGLEMDERGPSPLHVLEGLESSIAAEMPSIPCLTKIPDVPNLPEIPSRCEIPEGSRLPSLSDISDVFEMPCLPAIPSVPNTPSLSSTPTLSCDSWLQGPLQEPAEAPATRRELFSGSNPGKLGEPPSGGKAGPEEDEEGVSFTDFQPQDVTQHQGFPDELAFRSCSEIRSAWQALEQGHLPDIQGPAAAPPLPEPSLTDTQVQKLTPSLEQKSLIDAHVPAATPLPERGGSLDIQGLSPTPVQTTMVLSKPGGSLASHVARLESSDLTPPHSPPPSSRQLLGPNAAALSRYLAASYISQSLARRQGPGGGAPAASRGSWSSAPTSRASSPPPQPQPPPPPARRLSYATTVNIHVGGGGRLRPAKAQVRLNHPALLASTQESMGLHRAQGAPDAPFHM

SEQ ID NO: 836278 - protein, 102 aa, Homo sapiens
SYHADMFGLFSCAHYSRPPMTFPSSPETPRCLATAKPSHSKPCPAGTLQKRRRRKRKGWRWMNGGLPHSTSWKGSKVPLQLKCPAFPALPKFLTCPTFLKFP

SEQ ID NO: 836279 - protein, 157 aa, Homo sapiens
TLEDTLRLWDQSDCGQPGPCRQSSGKVGAQCWLLHLYPALPSSPELGGKKRAAGGSTARVCWGLHTCPFLWLCVPRSLHSWGGGEYPVLSQTPARPEFSDSSTSSACLHWVLSLRGNKPREPRELQGGERAERAPGSSALAGAPSWEADCRKKAQPC

SEQ ID NO: 836280 - protein, 856 aa, Homo sapiens
TSVGTRSPFIHQNTVYFGAPGAYNWKGNSYMIQRKEWDLSEYSYKDPEDQGNLYIGYTMQVGSFILHPKNITIVTGAPRHRHMGAVFLLSQEAGGDLRRRQVLEGSQVGAYFGSAIALADLNNDGWQDLLVGAPYYFERKEEVGGAIYVFMNQAGTSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIELWLVLVAVGAGLLLLGLIILLLWKCGFFKRARTRALYEAKRQKAEMKSQPSETERLTDDY

SEQ ID NO: 836281 - protein, 507 aa, Homo sapiens
MPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIELWLVLVAVGAGLLLLGLIILLLWKCGFFKRARTRALYEAKRQKAEMKSQPSETERLTDDY

SEQ ID NO: 836282 - protein, 916 aa, Homo sapiens
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGNSYMIQRKEWDLSEYSYKDPEDQGNLYIDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIELWLVLVAVGAGLLLLGLIILLLWKCGFFKRARTRALYEAKRQKAEMKSQPSETERLTDDY

SEQ ID NO: 836283 - protein, 585 aa, Homo sapiens
KVPASRAAVIGRGLDPALCTGTSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIELWLVLVAVGAGLLLLGLIILLLWKCGFFKRARTRALYEAKRQKAEMKSQPSETERLTDDY

SEQ ID NO: 836284 - protein, 1051 aa, Homo sapiens
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGNSYMIQRKEWDLSEYSYKDPEDQGNLYIGYTMQVGSFILHPKNITIVTGAPRHRHMGAVFLLSQEAGGDLRRRQVLEGSQVGAYFGSAIALADLNNDGWQDLLVGAPYYFERKEEVGGAIYVFMNQAGTSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIELWLVLVAVGAGLLLLGLIILLLWKCGFFKRARTRALYEAKRQKAEMKSQPSETERLTDDY

SEQ ID NO: 836285 - protein, 1066 aa, Homo sapiens
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGNSYMIQRKEWDLSEYSYKDPEDQGNLYIGYTMQVGSFILHPKNITIVTGAPRHRHMGAVFLLSQEAGGDLRRRQVLEGSQVGAYFGSAIALADLNNDGWQDLLVGAPYYFERKEEVGGAIYVFMNQAGTSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIELWLVLVAVGAGLLLLGLIILLLWKCDFFKRTRYYQIMPKYHAVRIREEERYPPPGSTLPTKKHWVTSWQTRDQYY

SEQ ID NO: 836286 - protein, 375 aa, Homo sapiens
TGKENRQGPCPTHPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIELWLVLVAVGAGLLLLGLIILLLWKCGFFKRARTRALYEAKRQKAEMKSQPSETERLTDDY

SEQ ID NO: 836287 - protein, 1051 aa, Homo sapiens; identical to SEQ ID NO: 836284

SEQ ID NO: 836288 - protein, 201 aa, Homo sapiens
MLGTRLVHRRDDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIELWLVLVAVGAGLLLLGLIILLLWKCGFFKRARTRALYEAKRQKAEMKSQPSETERLTDDY

SEQ ID NO: 836289 - protein, 1051 aa, Homo sapiens; identical to SEQ ID NO: 836284

SEQ ID NO: 836290 - protein, 1051 aa, Homo sapiens; identical to SEQ ID NO: 836284

SEQ ID NO: 836291 - protein, 128 aa, Homo sapiens
MGPGPSRAPRAPRLMLCALALMVAAGGCVVSAFNLDTRFLVVKEAGNPGSLFGYSVALHRQTERQQRYLLLAGAPRELVSKLLTGSSPRAAGWWAPNDTHAREVGILPKVVYGGTWRTWRAQTQQQRN

SEQ ID NO: 836292 - protein, 1007 aa, Homo sapiens
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGNSYMIQRKEWDLSEYSYKDPEDQGNLYIGYTMQVGSFILHPKNITIVTGAPRHRHMGAVFLLSQEAGGDLRRRQVLEGSQVGAYFGSAIALADLNNDGWQDLLVGAPYYFERKEEVGGAIYVFMNQAGTSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEEEEGSPASYPDSFKVSVSSLSHA

SEQ ID NO: 836293 - protein, 844 aa, Homo sapiens
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGNSYMIQRKEWDLSEYSYKDPEDQGNLYIGYTMQVGSFILHPKNITIVTGAPRHRHMGAVFLLSQEAGGDLRRRQVLEGSQVGAYFGSAIALADLNNDGWQDLLVGAPYYFERKEEVGGAIYVFMNQAGTSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQIQPDPTLTMRQGPRGGVLSYPWLSEPAWLCPLPHGLCPKAHLRS

SEQ ID NO: 836294 - protein, 248 aa, Homo sapiens
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDYDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGGDHGAMGEERKSRDHPPLVSHGDSWPRPSTLETGP

SEQ ID NO: 836295 - protein, 34 aa, Homo sapiens
GAGLLAESWAPALRLQYSRDVRKLLLSINVTNTR

SEQ ID NO: 836296 - protein, 82 aa, Homo sapiens
MILPVPTDDPGHHIIEDMWLGVTVASQGPAGRVLVSGCSVLAPPPLPGSPLISRAGRKEEGSRGVHGACVLGPAHMSLPVAV

SEQ ID NO: 836297 - protein, 1051 aa, Homo sapiens; identical to SEQ ID NO: 836284

SEQ ID NO: 836298 - protein, 732 aa, Homo sapiens
SENAAQSDVESGKLIIKKSKDGSEESSTATRNSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIELWLVLVAVGAGLLLLGLIILLLWKCGFFKRARTRALYEAKRQKAEMKSQPSETERLTDDY

SEQ ID NO: 836299 - protein, 1050 aa, Homo sapiens
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGNSYMIQRKEWDLSEYSYKDPEDQGNLYIGYTMQVGSFILHPKNITIVTGAPRHRHMGAVFLLSQEAGGDLRRRQVLEGSQVGAYFGSAIALADLNNDGWQDLLVGAPYYFERKEEVGGAIYVFMNQAGTSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCGQVTVLWLTPECRDPIYGQNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIELWLVLVAVGAGLLLLGLIILLLWKCGFFKRARTRALYEAKRQKAEMKSQPSETERLTDDY

SEQ ID NO: 836300 - protein, 1051 aa, Homo sapiens; identical to SEQ ID NO: 836284

SEQ ID NO: 836301 - protein, 886 aa, Homo sapiens
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGNSYMIQRKEWDLSEYSYKDPEDQGNLYIGYTMQVGSFILHPKNITIVTGAPRHRHMGAVFLLSQEAGGDLRRRQVLEGSQVGAYFGSAIALADLNNDGWQDLLVGAPYYFERKEEVGGAIYVFMNQAGTSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRPPTCHSGCCQKSQV

SEQ ID NO: 836302 - protein, 294 aa, Homo sapiens
DSSILLTPRVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIELWLVLVAVGAGLLLLGLIILLLWKCGFFKRARTRALYEAKRQKAEMKSQPSETERLTDDY

SEQ ID NO: 836303 - protein, 1084 aa, Homo sapiens
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGNSYMIQRKEWDLSEYSYKDPEDQGNLYIGYTMQVGSFILHPKNITIVTGAPRHRHMGAVFLLSQEAGGDLRRRQVLEGSQVGAYFGSAIALADLNNDGWQDLLVGAPYYFERKEEVGGAIYVFMNQAGTSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEHPAQDLTAEMNEQINEVMRICVWRGGLADRSFGDYRDFDRVRVNGWATLFLRTSIPTINMENKTTWFSVDIDSELVEELPAEIELWLVLVAVGAGLLLLGLIILLLWKCGFFKRARTRALYEAKRQKAEMKSQPSETERLTDDY

SEQ ID NO: 836304 - protein, 1051 aa, Homo sapiens; identical to SEQ ID NO: 836284

SEQ ID NO: 836305 - protein, 143 aa, Homo sapiens [sequence omitted]

SEQ ID NO: 836306 - protein, 134 aa, Homo sapiens [sequence omitted]

SEQ ID NO: 836307 - protein, 1036 aa, Homo sapiens
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGNSYMIQRKEWDLSEYSYKDPEDQGNLYIGYTMQVGSFILHPKNITIVTGAPRHRHMGAVFLLSQEAGGDLRRRQVLEGSQVGAYFGSAIALADLNNDGWQDLLVGAPYYFERKEEVGGAIYVFMNQAGTSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIELWLVLVAVGAGLLLLGLIILLLWKCGFFKRARTRATLQDHGGSDT

SEQ ID NO: 836308 - protein, 257 aa, Homo sapiens
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGGDHGAMGEERKSRDHPPLVSHGDSWPRPSTLETGP

SEQ ID NO: 836309 - protein, 297 aa, Homo sapiens
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVRWVLSVGSSTSTRLSPHLQSWEERRGQQGGPRRVCAGACTHVPSCGCVSLALCTPGEGVSILCSPKPPHGLSSLTHPLPPHAYTGCSAFVGTSRGSRGNCKEEKGQRGPQAAQRWLALLPGRLTAGRRPSPADPGSPSSGLGANQMCHLLPTFYSGSS

SEQ ID NO: 836310 - protein, 113 aa, Homo sapiens
INVTNTRTSERSGEDAHEALLTLVVPPALLLSSVRPVSARRPAQSPSRAPRVFASPYPCPVQVLSSATCPPPLVWAFLGALASLLLGESGSQALGLLTLHHRGGRTSPTLTRP

SEQ ID NO: 836311 - protein, 73 aa, Homo sapiens
QTPPCLPSLASSDLVPRSPASAGDEEEHAGVRLGFWLLFEPPASQPFRKPVKNVIPGPHQDPPKPSLGLGAGL

SEQ ID NO: 836312 - protein, 183 aa, Homo sapiens
MSRYLRPPNTSLFVRNVADDTRSEDLRREFGRYGPIVDVYVPLDFYTRRPRGFAYVQFEDVRDAEDALHNLDRKWICGRQIEIQFAQGDRKTPNQMKAKEGRNVYSSSRYDDYDRYRRSRSRSYERRRSRSRSFDYNYRRSYSPRNSRPTGRPRRSRSHSDNDRPNCSWNTQYSSAYYTSRKI

SEQ ID NO: 836313 - protein, 233 aa, Homo sapiens
MSRYLRPPNTSLFVRNVADDTRSEDLRREFGRYGPIVDVYVPLDFYTRRPRGFAYVQFEDVRDAEDALHNLDRKWICGRQIEIQFAQGDRKTPNQMKAKEGRNVYSSSRYDDYDRYRRSRSRSYERRRSRSRSFDYNYRRSYSPRNSRPTGRPRRSRSHSDNDRFKHRNRSFSRSKSNSRSRSKSQPKKEMKAKSRSRSASHTKTRGTSKTDSKPLVGQIGGRKDPTIKKRSR

SEQ ID NO: 836314 - protein, 173 aa, Homo sapiens
MSRYLRPPNTSLFVRNVADDTRSEDLRREFGRYGPIVDVYVPLDFYTRRPRGFAYVQFEDVRDAEDALHNLDRKWICGRQIEIQFAQGDRKTPNQMKAKEGRNVYSSSRYDDYDRYRRSRSRSYERRRSRSRSFDYNYRRSYSPRNSRPTGRPRRSRSHSDNDSQVSKKKNER

SEQ ID NO: 836315 - protein, 120 aa, Homo sapiens
MLFSSRPTGRPRRSRSHSDNDRFKHRNRSFSRSKSNSRSRSKSQPKKEMKAKSRSRSASHTKTRGTSKTDSKTHYKSGSRYEKESRKKEPPRSKSQSRSQSRSRSKSRSRSWTSPKSSGH

SEQ ID NO: 836316 - protein, 262 aa, Homo sapiens
MSRYLRPPNTSLFVRNVADDTRSEDLRREFGRYGPIVDVYVPLDFYTRRPRGFAYVQFEDVRDAEDALHNLDRKWICGRQIEIQFAQGDRKTPNQMKAKEGRNVYSSSRYDDYDRYRRSRSRSYERRRSRSRSFDYNYRRSYSPRNSRPTGRPRRSRSHSDNDRFKHRNRSFSRSKSNSRSRSKSQPKKEMKAKSRSRSASHTKTRGTSKTDSKTHYKSGSRYEKESRKKEPPRSKSQSRSQSRSRSKSRSRSWTSPKSSGH

SEQ ID NO: 836317 - protein, 262 aa, Homo sapiens; identical to SEQ ID NO: 836316

SEQ ID NO: 836318 - protein, 183 aa, Homo sapiens; identical to SEQ ID NO: 836312

SEQ ID NO: 836319 - protein, 183 aa, Homo sapiens; identical to SEQ ID NO: 836312

SEQ ID NO: 836320 - protein, 104 aa, Homo sapiens
TPGVLAGKNRCARLCAEVGGGSGGGSEVSREESVAVAEPSSCVCLRLGRLSRGRFAEPVSAPGRDTPPPCPATCVPPTRLCSSGTWPTTPGLKTCGVNLVVMVL

SEQ ID NO: 836321 - protein, 167 aa, Homo sapiens
MKAKEGRNVYSSSRYDDYDRYRRSRSRSYERRRSRSRSFDYNYRRSYSPRNSRPTGRPRRSRSHSDNDRFKHRNRSFSRSKSNSRSRSKSQPKKEMKAKSRSRSASHTKTRGTSKTDSKTHYKSGSRYEKESRKKEPPRSKSQSRSQSRSRSKSRSRSWTSPKSSGH

SEQ ID NO: 836322 - protein, 167 aa, Homo sapiens; identical to SEQ ID NO: 836321

SEQ ID NO: 836323 - protein, 104 aa, Homo sapiens; identical to SEQ ID NO: 836320

SEQ ID NO: 836324 - protein, 165 aa, Homo sapiens
MSRYLRPPNTSLFVRNVADDTRSEDLRREFGRYGPIVDVYVPLDFYTRRPRGFAYVQFEDVRDAEDALHNLDRKWICGRQIEIQFAQGDRKTPNQMKAKEGRNVYSSSRYDDYDRYRRSRSRSYERRRSRSRSFDYNYRRSYSPRKPNCSWNTQYSSAYYTSRKI

SEQ ID NO: 836325 - protein, 262 aa, Homo sapiens; identical to SEQ ID NO: 836316

SEQ ID NO: 836326 - protein, 104 aa, Homo sapiens; identical to SEQ ID NO: 836320

SEQ ID NO: 836327 - protein, 104 aa, Homo sapiens; identical to SEQ ID NO: 836320

SEQ ID NO: 836328 - protein, 262 aa, Homo sapiens; identical to SEQ ID NO: 836316

SEQ ID NO: 836329 - protein, 183 aa, Homo sapiens; identical to SEQ ID NO: 836312

SEQ ID NO: 836330 - protein, 114 aa, Homo sapiens
IPEAVLRRHFLWLIDMSCERGHKSQCRSLEQCVVTTGSRKGEEGRQRNDATLLWLPLPGSQWFPQRHLPLPEMLQPTKCNEGILELENLPQHFRKWKVSCYLPFKSIQYLITLL

SEQ ID NO: 836331 - protein, 262 aa, Homo sapiens; identical to SEQ ID NO: 836316

SEQ ID NO: 836332 - protein, 262 aa, Homo sapiens; identical to SEQ ID NO: 836316

SEQ ID NO: 836333 - protein, 183 aa, Homo sapiens; identical to SEQ ID NO: 836312

SEQ ID NO: 836334 - protein, 167 aa, Homo sapiens; identical to SEQ ID NO: 836321

SEQ ID NO: 836335 - protein, 164 aa, Homo sapiens
MSRYLRPPNTSLFVRNVADDTRSEDLRREFGRYGPIVDVYVPLDFYTRRPRGFAYVQFEDVRDAEDALHNLDRKWICGRQIEIQFAQGDRKTPNQMKAKEGRNVYSSSRYDDYDRYRRSRSRSYERRRSRSRSFDYNYRRSYSPRNSRPTGRPRRSRSHSDNDR

SEQ ID NO: 836336 - protein, 104 aa, Homo sapiens; identical to SEQ ID NO: 836320

SEQ ID NO: 836337 - protein, 272 aa, Homo sapiens
MSRYLRPPNTSLFVRNVADDTRSEDLRREFGRYGPIVDVYVPLDFYTRRPRGFAYVQFEDVRDAEDALHNLDRKWICGRQIEIQFAQGDRKTPNQMKAKEGRNVYSSSRYDDYDRYRRSRSRSYERRRSTKAALFEIHTHYTKIAIVLENYAFLRSRPQLKNTGSRKPLPDHDRFKHRNRSFSRSKSNSRSRSKSQPKKEMKAKSRSRSASHTKTRGTSKTDSKTHYKSGSRYEKESRKKEPPRSKSQSRSQSRSRSKSRSRSWTSPKSSGH

SEQ ID NO: 836338 - protein, 173 aa, Homo sapiens; identical to SEQ ID NO: 836314

SEQ ID NO: 836339 - protein, 201 aa, Homo sapiens
EGMQGFFSLFIEGFNTVFNIFKYFCSLYFLAPNQMKAKEGRNVYSSSRYDDYDRYRRSRSRSYERRRSRSRSFDYNYRRSYSPRNSRPTGRPRRSRSHSDNDRFKHRNRSFSRSKSNSRSRSKSQPKKEMKAKSRSRSASHTKTRGTSKTDSKTHYKSGSRYEKESRKKEPPRSKSQSRSQSRSRSKSRSRSWTSPKSSGH

SEQ ID NO: 836340 - protein, 217 aa, Homo sapiens
MSRYLRPPNTSLFVRNVADDTRSEDLRREFGRYGPIVDVYVPLDFYTRRPRGFAYVQFEDVRDAEDALHNLDRKWICGRQIEIQFAQGDRKTPNQMKAKEGRNVYSSSRYDDYDRYRRSRSRSYERRRSRSRSFDYNYRRSYSPRNSRPTGRPRRSRSHSDNDRFKHRNRSFSRSKSNSRSRSKSQPKKEMKAKSRSRPNCSWNTQYSSAYYTSRKI

SEQ ID NO: 836341 - protein, 183 aa, Homo sapiens; identical to SEQ ID NO: 836312

SEQ ID NO: 836342 - protein, 182 aa, Homo sapiens
TPGVLAGKNRCARLCAEVGGGSGGGSEVSREESVAVAEPSSCVCLRLGRLSRGRFAEPVSAPGRDTPPPCPATCVPPTRLCSSGTWPTTPAPNQMKAKEGRNVYSSSRYDDYDRYRRSRSRSYERRRSRSRSFDYNYRRSYSPRNSRPTGRPRRSRSHSDNDRPNCSWNTQYSSAYYTSRKI

SEQ ID NO: 836343 - protein, 262 aa, Homo sapiens; identical to SEQ ID NO: 836316

SEQ ID NO: 836344 - protein, 104 aa, Homo sapiens; identical to SEQ ID NO: 836320

SEQ ID NO: 836345 - protein, 82 aa, Homo sapiens
MVRSRSGVEDIPRQEQAGRRSAGGSTDIAPRSTESIRGGERERGYSDSRARRKHRKARYKQSRAKGEEQSTYQTKRCVVHAQ

SEQ ID NO: 836346 - protein, 459 aa, Homo sapiens
RPRSHASAGALRRALASAAPPPGPANREPRRPARGRCRAEGLGRCAGAGEVAPPARGGGVAGAGSCGRAELRRGKEPLGADRAAAGAAPAQARGGRRRASGCCAPLGVRASGRAVPRAVFAGMKRPCEETTSESDMDETIDVGSENNYSGQSTSSVIRLNSPTTTSQIMARKKRRGIIEKRRRDRINNSLSELRRLVPTAFEKQGSAKLEKAEILQMTVDHLKMLQATGGKGYFDAHALAMDFMSIGFRECLTEVARYLSSVEGLDSSDPLRVRLVSHLSTCATQREAAAMTSSMAHHHHPLHPHHWAAAFHHLPAALLQPNGLHASESTPCRLSTTSEVPPAHGSALLTATFAHADSALRMPSTGSVAPCVPPLSTSLLSLSATVHAAAAAATAAAHSFPLSFAGAFPMLPPNAAAAVAAATAISPPLSVSATSSPQQTSSGTNNKPYRPWGTEVGAF

SEQ ID NO: 836347 - protein, 459 aa, Homo sapiens; identical to SEQ ID NO: 836346

SEQ ID NO: 836348 - protein, 291 aa, Homo sapiens
MARKKRRGIIEKRRRDRINNSLSELRRLVPTAFEKQGSAKLEKAEILQMTVDHLKMLQATGGKGYFDAHALAMDFMSIGFRECLTEVARYLSSVEGLDSSDPLRVRLVSHLSTCATQREAAAMTSSMAHHHHPLHPHHWAAAFHHLPAALLQPNGLHASESTPCRLSTTSEVPPAHGSALLTATFAHADSALRMPSTGSVAPCVPPLSTSLLSLSATVHAAAAAATAAAHSFPLSFAGAFPMLPPNAAAAVAAATAISPPLSVSATSSPQQTSSGTNNKPYRPWGTEVGAF

SEQ ID NO: 836349 - protein, 765 aa, Homo sapiens
MSGDHLHNDSQIEADFRLNDSHKHKDKHKDREHRHKEHKKEKDREKSKHSNSEHKDSEKKHKEKEKTKHKDGSSEKHKDKHKDRDKEKRKEEKVRASGDAKIKKEKENGFSSPPQIKDEPEDDGYFVPPKEDIKPLKRPRDEDDADYKPKKIKTEDTKKEKKRKLEEEEDGKLKKPKNKDKDKKVPEPDNKKKKPKKEEEQKWKWWEEERYPEGIKWKFLEHKGPVFAPPYEPLPENVKFYYDGKVMKLSPKAEEVATFFAKMLDHEYTTKEIFRKNFFKDWRKEMTNEEKNIITNLSKCDFTQMSQYFKAQTEARKQMSKEEKLKIKEENEKLLKEYGFCIMDNHKERIANFKIEPPGLFRGRGNHPKMGMLKRRIMPEDIIINCSKDAKVPSPPPGHKWKEVRHDNKVTWLVSWTENIQGSIKYIMLNPSSRIKGEKDWQKYETARRLKKCVDKIRNQYREDWKSKEMKVRQRAVALYFIDKLALRAGNEKEEGETADTVGCCSLRVEHINLHPELDGQEYVVEFDFLGKDSIRYYNKVPVEKRVFKNLQLFMENKQPEDDLFDRLNTGILNKHLQDLMEGLTAKVFRTYNASITLQQQLKELTAPDENIPAKILSYNRANRAVAILCNHQRAPPKTFEKSMMNLQTKIDAKKEQLADARRDLKSAKADAKVMKDAKTKKVVESKKKAVQRLEEQLMKLEVQATDREENKQIALGTSKLNYLDPRITVAWCKKWGVPIEKIYNKTQREKFAWAIDMADEDYEF

SEQ ID NO: 836350 - protein, 82 aa, Homo sapiens
KCELRLLHNCWGLFSPPARQSGSVAAVVAASAVSGVSGPQSPPLTCASSSLRSPRPPAQAGSPSASPPRRLACRRARPSGPT

SEQ ID NO: 836351 - protein, 313 aa, Homo sapiens
MSGDHLHNDSQIEADFRLNDSHKHKDKHKDREHRHKEHKKEKDREKSKHSNSEHKDSEKKHKEKEKTKHKDGSSEKHKDKHKDRDKEKRKEEKVRASGDAKIKKEKENGFSSPPQIKDEPEDDGYFVPPKEDIKPLKRPRDEDDADYKPKKIKTEDTKKEKKRKLEEEEGGSAEKKFFKNNCVWGGGPQVLWEQWAKAADHKEDAGPRTGGPGSPPIKKSARRHRGALETTRTRGSGAISGPTPGEPSGDNNGRAAECNKRRHEDEDTTTPTEKNKHRDDEKNTRDSTSKTQKQTHIDTTDRHRSERRARREN

SEQ ID NO: 836352 - protein, 751 aa, Homo sapiens
DEGIRLNILKHKMTRVGGGGEMTTKKEKDREKSKHSNSEHKDSEKKHKEKEKTKHKDGSSEKHKDKHKDRDKEKRKEEKVRASGDAKIKKEKENGFSSPPQIKDEPEDDGYFVPPKEDIKPLKRPRDEDDADYKPKKIKTEDTKKEKKRKLEEEEDGKLKKPKNKDKDKKVPEPDNKKKKPKKEEEQKWKWWEEERYPEGIKWKFLEHKGPVFAPPYEPLPENVKFYYDGKVMKLSPKAEEVATFFAKMLDHEYTTKEIFRKNFFKDWRKEMTNEEKNIITNLSKCDFTQMSQYFKAQTEARKQMSKEEKLKIKEENEKLLKEYGFCIMDNHKERIANFKIEPPGLFRGRGNHPKMGMLKRRIMPEDIIINCSKDAKVPSPPPGHKWKEVRHDNKVTWLVSWTENIQGSIKYIMLNPSSRIKGEKDWQKYETARRLKKCVDKIRNQYREDWKSKEMKVRQRAVALYFIDKLALRAGNEKEEGETADTVGCCSLRVEHINLHPELDGQEYVVEFDFLGKDSIRYYNKVPVEKRVFKNLQLFMENKQPEDDLFDRLNTGILNKHLQDLMEGLTAKVFRTYNASITLQQQLKELTAPDENIPAKILSYNRANRAVAILCNHQRAPPKTFEKSMMNLQTKIDAKKEQLADARRDLKSAKADAKVMKDAKTKKVVESKKKAVQRLEEQLMKLEVQATDREENKQIALGTSKLNYLDPRITVAWCKKWGVPIEKIYNKTQREKFAWAIDMADEDYEF

SEQ ID NO: 836353 - protein, 752 aa, Homo sapiens
MRQWSSEDRIYIGFEKFRNSNYLIHTLLKKFKNAKHSSSEHKDSEKKHKEKEKTKHKDGSSEKHKDKHKDRDKEKRKEEKVRASGDAKIKKEKENGFSSPPQIKDEPEDDGYFVPPKEDIKPLKRPRDEDDADYKPKKIKTEDTKKEKKRKLEEEEDGKLKKPKNKDKDKKVPEPDNKKKKPKKEEEQKWKWWEEERYPEGIKWKFLEHKGPVFAPPYEPLPENVKFYYDGKVMKLSPKAEEVATFFAKMLDHEYTTKEIFRKNFFKDWRKEMTNEEKNIITNLSKCDFTQMSQYFKAQTEARKQMSKEEKLKIKEENEKLLKEYGFCIMDNHKERIANFKIEPPGLFRGRGNHPKMGMLKRRIMPEDIIINCSKDAKVPSPPPGHKWKEVRHDNKVTWLVSWTENIQGSIKYIMLNPSSRIKGEKDWQKYETARRLKKCVDKIRNQYREDWKSKEMKVRQRAVALYFIDKLALRAGNEKEEGETADTVGCCSLRVEHINLHPELDGQEYVVEFDFLGKDSIRYYNKVPVEKRVFKNLQLFMENKQPEDDLFDRLNTGILNKHLQDLMEGLTAKVFRTYNASITLQQQLKELTAPDENIPAKILSYNRANRAVAILCNHQRAPPKTFEKSMMNLQTKIDAKKEQLADARRDLKSAKADAKVMKDAKTKKVVESKKKAVQRLEEQLMKLEVQATDREENKQIALGTSKLNYLDPRITVAWCKKWGVPIEKIYNKTQREKFAWAIDMADEDYEF

SEQ ID NO: 836354 - protein, 519 aa, Homo sapiens
MKLSPKAEEVATFFAKMLDHEYTTKEIFRKNFFKDWRKEMTNEEKNIITNLSKCDFTQMSQYFKAQTEARKQMSKEEKLKIKEENEKLLKEYGFCIMDNHKERIANFKIEPPGLFRGRGNHPKMGMLKRRIMPEDIIINCSKDAKVPSPPPGHKWKEVRHDNKVTWLVSWTENIQGSIKYIMLNPSSRIKGEKDWQKYETARRLKKCVDKIRNQYREDWKSKEMKVRQRAVALYFIDKLALRAGNEKEEGETADTVGCCSLRVEHINLHPELDGQEYVVEFDFLGKDSIRYYNKVPVEKRVFKNLQLFMENKQPEDDLFDRLNTGILNKHLQDLMEGLTAKVFRTYNASITLQQQLKELTAPDENIPAKILSYNRANRAVAILCNHQRAPPKTFEKSMMNLQTKIDAKKEQLADARRDLKSAKADAKVMKDAKTKKVVESKKKAVQRLEEQLMKLEVQATDREENKQIALGTSKLNYLDPRITVAWCKKWGVPIEKIYNKTQREKFAWAIDMADEDYEF

SEQ ID NO: 836355 - protein, 296 aa, Homo sapiens
MKVRQRAVALYFIDKLALRAGNEKEEGETADTVGCCSLRVEHINLHPELDGQEYVVEFDFLGKDSIRYYNKVPVEKRVFKNLQLFMENKQPEDDLFDRLNTGILNKHLQDLMEGLTAKVFRTYNASITLQQQLKELTAPDENIPAKILSYNRANRAVAILCNHQRAPPKTFEKSMMNLQTKIDAKKEQLADARRDLKSAKADAKVMKDAKTKKVVESKKKAVQRLEEQLMKLEVQATDREENKQIALGTSKLNYLDPRITVAWCKKWGVPIEKIYNKTQREKFAWAIDMADEDYEF

SEQ ID NO: 836356 - protein, 765 aa, Homo sapiens; identical to SEQ ID NO: 836349

SEQ ID NO: 836357 - protein, 765 aa, Homo sapiens; identical to SEQ ID NO: 836349

SEQ ID NO: 836358 - protein, 765 aa, Homo sapiens; identical to SEQ ID NO: 836349

SEQ ID NO: 836359 - protein, 765 aa, Homo sapiens; identical to SEQ ID NO: 836349

SEQ ID NO: 836360 - protein, 339 aa, Homo sapiens
MSGDHLHNDSQIEADFRLNDSHKHKDKHKDREHRHKEHKKEKDREKSKHSNSEHKDSEKKHKEKEKTKHKDGSSEKHKDKHKDRDKEKRKEEKVRASGDAKIKKEKENGFSSPPQIKDEPEDDGYFVPPKEDIKPLKRPRDEDDADYKPKKIKTEDTKKEKKRKLEEEEDGKLKKPKNKDKDKKVPEPDNKKKKPKKEEEQKWKWWEEERYPEGIKWKFLEHKGPVFAPPYEPLPENVKFYYDGKVMKLSPKAEEVATFFAKMLDHEYTTKEIFRKNFFKDWRKEMTNEEKNIITNLSKCDFTQMSQYFKAQTEARKQMSKEEKLVLQNLLNLWRILEL

SEQ ID NO: 836361 - protein, 205 aa, Homo sapiens [sequence omitted]

SEQ ID NO: 836362 - protein, 629 aa, Homo sapiens
SSQKRYEEIVTEVDYIKKMAKPDTVALCQFLVGMVTNAGAKNKDKDKKVPEPDNKKKKPKKEEEQKWKWWEEERYPEGIKWKFLEHKGPVFAPPYEPLPENVKFYYDGKVMKLSPKAEEVATFFAKMLDHEYTTKEIFRKNFFKDWRKEMTNEEKNIITNLSKCDFTQMSQYFKAQTEARKQMSKEEKLKIKEENEKLLKEYGFCIMDNHKERIANFKIEPPGLFRGRGNHPKMGMLKRRIMPEDIIINCSKDAKVPSPPPGHKWKEVRHDNKVTWLVSWTENIQGSIKYIMLNPSSRIKGEKDWQKYETARRLKKCVDKIRNQYREDWKSKEMKVRQRAVALYFIDKLALRAGNEKEEGETADTVGCCSLRVEHINLHPELDGQEYVVEFDFLGKDSIRYYNKVPVEKRVFKNLQLFMENKQPEDDLFDRLNTGILNKHLQDLMEGLTAKVFRTYNASITLQQQLKELTAPDENIPAKILSYNRANRAVAILCNHQRAPPKTFEKSMMNLQTKIDAKKEQLADARRDLKSAKADAKVMKDAKTKKVVESKKKAVQRLEEQLMKLEVQATDREENKQIALGTSKLNYLDPRITVAWCKKWGVPIEKIYNKTQREKFAWAIDMADEDYEF

SEQ ID NO: 836363 - protein, 480 aa, Homo sapiens [sequence omitted]

SEQ ID NO: 836364 - protein, 178 aa, Homo sapiens
KSGINAESPLRPGQLKELTAPDENIPAKILSYNRANRAVAILCNHQRAPPKTFEKSMMNLQTKIDAKKEQLADARRDLKSAKADAKVMKDAKTKKVVESKKKAVQRLEEQLMKLEVQATDREENKQIALGTSKLNYLDPRITVAWCKKWGVPIEKIYNKTQREKFAWAIDMADEDYEF

SEQ ID NO: 836365 - protein, 765 aa, Homo sapiens; identical to SEQ ID NO: 836349

SEQ ID NO: 836366 - protein, 765 aa, Homo sapiens; identical to SEQ ID NO: 836349

SEQ ID NO: 836367 - protein, 548 aa, Homo sapiens
MSGDHLHNDSQIEADFRLNDSHKHKDKHKDREHRHKEHKKEKDREKSKHSNSEHKDSEKKHKEKEKTKHKDGSSEKHKDKHKDRDKEKRKEEKVRASGDAKIKKEKENGFSSPPQIKDEPEDDGYFVPPKEDIKPLKRPRDEDDADYKPKKIKTEDTKKEKKRKLEEEEDGKLKKPKNKDKDKKVPEPDNKKKKPKKEEEQKWKWWEEERYPEGIKWKFLEHKGPVFAPPYEPLPENVKFYYDGKVMKLSPKAEEVATFFAKMLDHEYTTKEIFRKNFFKDWRKEMTNEEKNIITNLSKCDFTQMSQYFKAQTEARKQMSKEEKLKIKEENEKLLKEYGFCIMDNHKERIANFKIEPPGLFRGRGNHPKMGMLKRRIMPEDIIINCSKDAKVPSPPPGHKWKEVRHDNKVTWLVSWTENIQGSIKYIMLNPSSRIKGEKDWQKYETARRLKKCVDKIRNQYREDWKSKEMKVRQRAVALYFIDKLALRAGNEKEEGETADTVGCCSLRVEHINLHPELDGQEYVVEFDFLGKDSIRYYNKVPVEKRVS

SEQ ID NO: 836368 - protein, 306 aa, Homo sapiens
KLSSSLGCQLADDKALPYNEPGILSSSFTICNCTFLPFTIKKYTISFHHPHPPKIPPHSNTPHEESEKAQNWAPHHNRTPTNLSYIHKTPGPSEHPRRTAAKPPPPSQAAAPTCATSYITSPNATDLMRNRAHSPVLGPAAPPQPATLLPLAHHTKIARPNAPTPHHTPHHPHPARPACVTTPYPHPEYHETDRLTTRSTSPTRPNAIHGPVSANSRLHPHSSPQWSARPPHTNRDHYRNMPPTPPTLNSPLHTQQCHSAPRLSRCDRSSPRCRIGLLTTSPLTKEYTLHNHRPPPKAPPARPAHV

SEQ ID NO: 836369 - protein, 104 aa, Homo sapiens
MNPCCLGFIAFAYSVKSRDRKMVGDVTGAQAYASTAKCLNIWALILGILMTISAHHHPSVGRPGPCDRSGGIIEARSSARDLYPTYSIFHSSPCPRRPSPASAL

SEQ ID NO: 836370 - protein, 103 aa, Homo sapiens
MNPCCLGFIAFAYSVKSRDRKMVGDVTGAQAYASTAKCLNIWALILGILMTISAHHHPSVGRPGPCDRSGGIIEARSSARDLYPTYSIFHSSPCPRRGQELCP

SEQ ID NO: 836371 - protein, 184 aa, Homo sapiens
KGHEITPPPGYRDYTVQTFLLSTAASLPTTRCSRCSRRSRKWLCWGAPHNPAPPTSTVIHIRSETSVPDHVVWSLFNTLFMNPCCLGFIAFAYSVKSRDRKMVGDVTGAQAYASTAKCLNIWALILGILMTISAHHHPSVGRPGPCDRSGGIIEARSSARDLYPTYSIFHSSPCPRRPSPASAL

SEQ ID NO: 836372 - protein, 154 aa, Homo sapiens
SARTQAARQQKTTLLKPSLNTSFPKARRRCSRRSRKWLCWGAPHNPAPPTSTVIHIRSETSVPDHVVWSLFNTLFMNPCCLGFIAFAYSVKSRDRKMVGDVTGAQAYASTAKCLNIWALILGILMTIGFILLLVFGSVTVYHIMLQIIQEKRGY

SEQ ID NO: 836373 - protein, 103 aa, Homo sapiens; identical to SEQ ID NO: 836370

SEQ ID NO: 836374 - protein, 103 aa, Homo sapiens; identical to SEQ ID NO: 836370

SEQ ID NO: 836375 - protein, 103 aa, Homo sapiens; identical to SEQ ID NO: 836370

SEQ ID NO: 836376 - protein, 103 aa, Homo sapiens; identical to SEQ ID NO: 836370

SEQ ID NO: 836377 - protein, 103 aa, Homo sapiens; identical to SEQ ID NO: 836370

SEQ ID NO: 836378 - protein, 104 aa, Homo sapiens; identical to SEQ ID NO: 836369

SEQ ID NO: 836379 - protein, 104 aa, Homo sapiens; identical to SEQ ID NO: 836369

SEQ ID NO: 836380 - protein, 103 aa, Homo sapiens; identical to SEQ ID NO: 836370

SEQ ID NO: 836381 - protein, 133 aa, Homo sapiens
MNPCCLGFIAFAYSVKSRDRKMVGDVTGAQAYASTAKCLNIWALILGILMTISAHHHPSVGRPGPCDRSGGIIEARSSARDLYPTYSIFHSSPCPRRPSPASALLSSHAFLPMAFNKGVYVSGKTEKQRTTKG

SEQ ID NO: 836382 - protein, 104 aa, Homo sapiens; identical to SEQ ID NO: 836369

SEQ ID NO: 836383 - protein, 104 aa, Homo sapiens; identical to SEQ ID NO: 836369

SEQ ID NO: 836384 - protein, 104 aa, Homo sapiens; identical to SEQ ID NO: 836369

SEQ ID NO: 836385 - protein, 110 aa, Homo sapiens
MNPCCLGFIAFAYSVKSRDRKMVGDVTGAQAYASTAKCLNIWALILGILMTISAHHHPSVGRPGPCDRSGGIIEARSSARDLYPTYSIFHSSPCPRRFDAAANLVVVVGG

SEQ ID NO: 836386 - protein, 161 aa, Homo sapiens
EATLEAPPAQRRCSRRSRKWLCWGAPHNPAPPTSTVIHIRSETSVPDHVVWSLFNTLFMNPCCLGFIAFAYSVKSRDRKMVGDVTGAQAYASTAKCLNIWALILGILMTISAHHHPSVGRPGPCDRSGGIIEARSSARDLYPTYSIFHSSPCPRRGQELCP

SEQ ID NO: 836387 - protein, 103 aa, Homo sapiens; identical to SEQ ID NO: 836370

SEQ ID NO: 836388 - protein, 119 aa, Homo sapiens
MNHIVQTFFFSPVNSGQPPNYEMLEMLKEEQEVAMLGRAPQPCSPDVHRDPHPQRDLRARPCRLVPVQHPLHEPLLPGLHSIRLLREGAYGPGGNPGGAGEPGAPPAHMLPGVGTCVSL

SEQ ID NO: 836389 - protein, 165 aa, Homo sapiens
GGDRVVGPPQHHVLLLSISLFGGLATVDRERRRFGQFDMVSSRSETSVPDHVVWSLFNTLFMNPCCLGFIAFAYSVKSRDRKMVGDVTGAQAYASTAKCLNIWALILGILMTISAHHHPSVGRPGPCDRSGGIIEARSSARDLYPTYSIFHSSPCPRRPSPASAL

SEQ ID NO: 836390 - protein, 119 aa, Homo sapiens; identical to SEQ ID NO: 836388

SEQ ID NO: 836391 - protein, 107 aa, Homo sapiens
ELEDPPTLCVGFIAFAYSVKSRDRKMVGDVTGAQAYASTAKCLNIWALILGILMTISAHHHPSVGRPGPCDRSGGIIEARSSARDLYPTYSIFHSSPCPRRGQELCP

SEQ ID NO: 836392 - protein, 93 aa, Homo sapiens
RPLQHQNGHEDAQNQGPDVQALGGGGICLNIWALILGILMTISAHHHPSVGRPGPCDRSGGIIEARSSARDLYPTYSIFHSSPCPRRGQELCP

SEQ ID NO: 836393 - protein, 93 aa, Homo sapiens
RPPTTTKFAAASTFLNWCCLGFIAFAYSVKSRDRKMVGDVTGAQAYASTAKCLNIWALILGILMTIGFILLLVFGSVTVYHIMLQIIQEKRGY

SEQ ID NO: 836394 - protein, 48 aa, Homo sapiens
MNHIVQTFFFSPVNSGQPPNYEMLGKGVWGTPGQVYDVEEDCERSPTM

SEQ ID NO: 836395 - protein, 103 aa, Homo sapiens; identical to SEQ ID NO: 836370

SEQ ID NO: 836396 - protein, 104 aa, Homo sapiens; identical to SEQ ID NO: 836369

SEQ ID NO: 836397 - protein, 152 aa, Homo sapiens
MRCSRRSRKWLCWGAPHNPAPPTSTVIHIRSETSVPDHVVWSLFNTLFMNPCCLGFIAFAYSVKSRDRKMVGDVTGAQAYASTAKCLNIWALILGILMTISAHHHPSVGRPGPCDRSGGIIEARSSARDLYPTYSIFHSSPCPRRPSPASAL

SEQ ID NO: 836398 - protein, 93 aa, Homo sapiens
MNPCCLGFIAFAYSVKSRDRKMVGDVTGAQAYASTAKCLNIWALILGILMTISAHHHPSVGRPGPCDRSGGIIEARSSARDLYPTIVQRLTGR

SEQ ID NO: 836399 - protein, 103 aa, Homo sapiens; identical to SEQ ID NO: 836370

SEQ ID NO: 836400 - protein, 103 aa, Homo sapiens; identical to SEQ ID NO: 836370

SEQ ID NO: 836401 - protein, 103 aa, Homo sapiens; identical to SEQ ID NO: 836370

SEQ ID NO: 836402 - protein, 103 aa, Homo sapiens; identical to SEQ ID NO: 836370

SEQ ID NO: 836403 - protein, 103 aa, Homo sapiens; identical to SEQ ID NO: 836370

SEQ ID NO: 836404 - protein, 112 aa, Homo sapiens
MNPCCLGFIAFAYSVKSRDRKMVGDVTGAQAYASTAKCLNIWALILGILMTISAHHHPSVGRPGPCDRSGGIIEARSSARDLYPTYSIFHSSPCPRSRVLYQPFILTVWGSS

SEQ ID NO: 836405 - protein, 133 aa, Homo sapiens
MNPCCLGFIAFAYSVKSRDRKMVGDVTGAQAYASTAKCLNIWALILGILMTISAHHHPSVGRPGPCDRSGGIIEARSSARDLYPTYSIFHSSPCPRRPSPASALLSSHAFLPMAFNKGVYVSGTYIFLLPVPP

SEQ ID NO: 836406 - protein, 198 aa, Homo sapiens
MNPCCLGFIAFAYSVKSRDRKMVGDVTGAQAYASTAKCLNIWALILGILMTISAHHHPSVGRPGPCDRSGGIIEARSSARDLYPTYSIFHSSPCPRRPSPASALLSSHAFLPMAFNKGVYVSGKKKKKQKTKQNTTTAERPIYGGGRGKTRVTRTGATRAERVFLQHPSFSGPPRRDNRPESPNRGEPIKLRKHRYPR

SEQ ID NO: 836407 - protein, 121 aa, Homo sapiens
MNPCCLGFIAFAYSVKSRDRKMVGDVTGAQAYASTAKCLNIWALILGILMTISAHHHPSVGRPGPCDRSGGIIEARSSARDLYPTYSIFHSSPCPRREPSPVSALYPTTLFHNARDKILRV

SEQ ID NO: 836408 - protein, 151 aa, Homo sapiens
MRCSRRSRKWLCWGAPHNPAPPTSTVIHIRSETSVPDHVVWSLFNTLFMNPCCLGFIAFAYSVKSRDRKMVGDVTGAQAYASTAKCLNIWALILGILMTISAHHHPSVGRPGPCDRSGGIIEARSSARDLYPTYSIFHSSPCPRRGQELCP

SEQ ID NO: 836409 - protein, 152 aa, Homo sapiens; identical to SEQ ID NO: 836397

SEQ ID NO: 836410 - protein, 107 aa, Homo sapiens; identical to SEQ ID NO: 836391

SEQ ID NO: 836411 - protein, 125 aa, Homo sapiens
MEYCTVTYWFYLHGVQASSYYQTYLPPLRFIAFAYSVKSRDRKMVGDVTGAQAYASTAKCLNIWALILGILMTISAHHHPSVGRPGPCDRSGGIIEARSSARDLYPTYSIFHSSPCPRRGQELCP

SEQ ID NO: 836412 - protein, 147 aa, Homo sapiens
GGDRVVGPPQHHVLLLSISLFGGLATVDRERRRFGQFDSGVQFMNPCCLGFIAFAYSVKSRDRKMVGDVTGAQAYASTAKCLNIWALILGILMTISAHHHPSVGRPGPCDRSGGIIEARSSARDLYPTYSIFHSSPCPRRPSPASAL

SEQ ID NO: 836413 - protein, 608 aa, Homo sapiens
AYRGGAGVAGAVWTVMAATVATAAAVAPAPAPGTDSASSVHWFRKGLRLHDNPALLAAVRGARCVRCVYILDPWFAASSSVGINRWRFLLQSLEDLDTSLRKLNSRLFVVRGQPADVFPRLFKEWGVTRLTFEYDSEPFGKERDAAIMKMAKEAGVEVVTENSHTLYDLDRIIELNGQKPPLTYKRFQAIISRMELPKKPVGLVTSQQMESCRAEIQENHDETYGVPSLEELGFPTEGLGPAVWQGGETEALARLDKHLERKAWVANYERPRMNANSLLASPTGLSPYLRFGCLSCRLFYYRLWDLYKKVKRNSTPPLSLFGQLLWREFFYTAATNNPRFDRMEGNPICIQIPWDRNPEALAKWAEGKTGFPWIDAIMTQLRQEGWIHHLARHAVACFLTRGDLWVSWESGVRVFDELLLDADFSVNAGSWMWLSCSAFFQQFFHCYCPVGFGRRTDPSGDYIRRYLPKLKAFPSRYIYEPWNAPESIQKAAKCIIGVDYPRPIVNHAETSRLNIERMKQIYQQLSRYRGLCLLASVPSCVEDLSHPVAEPSSSQAGSMSSAGPRPLPSGPASPKRKLEAAEEPPGEELSKRARVAELPTPELPSKDA

SEQ ID NO: 836414 - protein, 66 aa, Homo sapiens
MNANSLLASPTGLSPYLRFGCLSCRLFYYRLWDLYKKVRGTYLPTLHLRPAARPFGLVSHPKKGTG

SEQ ID NO: 836415 - protein, 608 aa, Homo sapiens; identical to SEQ ID NO: 836413

SEQ ID NO: 836416 - protein, 70 aa, Homo sapiens
NKKQRPGYVWTASIHSGLLSLQVLPHAQSQKPKAKKFPPPYRSTHRYLTGVGYAWYCNRSLRQHTYLFRI

SEQ ID NO: 836417 - protein, 336 aa, Homo sapiens
MNANSLLASPTGLSPYLRFGCLSCRLFYYRLWDLYKKVKRNSTPPLSLFGQLLWREFFYTAATNNPRFDRMEGNPICIQIPWDRNPEALAKWAEGKTGFPWIDAIMTQLRQEGWIHHLARHAVACFLTRGDLWVSWESGVRVFDELLLDADFSVNAGSWMWLSCSAFFQQFFHCYCPVGFGRRTDPSGDYIRRYLPKLKAFPSRYIYEPWNAPESIQKAAKCIIGVDYPRPIVNHAETSRLNIERMKQIYQQLSRYRGLCLLASVPSCVEDLSHPVAEPSSSQAGSMSSAGPRPLPSGPASPKRKLEAAEEPPGEELSKRARVAELPTPELPSKDA

SEQ ID NO: 836418 - protein, 608 aa, Homo sapiens; identical to SEQ ID NO: 836413

SEQ ID NO: 836419 - protein, 608 aa, Homo sapiens; identical to SEQ ID NO: 836413

SEQ ID NO: 836420 - protein, 608 aa, Homo sapiens; identical to SEQ ID NO: 836413

SEQ ID NO: 836421 - protein, 608 aa, Homo sapiens
AYRGGAGVAGAVWTVMAATVATAAAVAPAPAPGTDSASSVHWFRKGLRLHDNPALLAAVRGARCVRCVYILDPWFAASSSVGINRWRFLLQSLEDLDTSLRKLNSRLFVVRGQPADVFPRLFKEWGVTRLTFEYDSEPFGKERDAAIMKMAKEAGVEVVTENSHTLYDLDRIIELNGQKPPLTYKRFQAIISRMELPKKPVGLVTSQQMESCRAEIQENHDETYGVPSLEELGFPTEGLGPAVWQGGETEALARLDKHLERKAWVANYERPRMNANSLLASPTGLSPYLRFGCLSCRLFYYRLWDLYKKVKRNSTPPLSLFGQLLWREFFYTAATNNPRFDRMEGNPICIQIPWDRNPEALAKWAEGKTGFPWIDAIMTQLRQEGWIHHLARHAVACFLTRGDLWVSWESGVRVFDELLLDADFSVNAGSWMWLSCSAFFQQFFHCYCPVGFGRRTDPSGDYIRRYLPKLKAFPSRYIYEPWNAPESIQKAAKCIIGVDYPRPIVNHAETSRLNIERMKQIYQQLSRYRGLCLLASVPSCVEDLSHPVAEPSSSQAGSMSSAGPRPLPSGPASPKRKLEAAEEPPGEELSSSGVGNSATRARLLSSSP

SEQ ID NO: 836422 - protein, 81 aa, Homo sapiens
GPQQQFGGPGALYTTGFSAATRINQNTLMEPQVDSMPWELFLHIGSLKNSPDVCFIRTPNSKKEAPRDGQDICPLKLSTTV

SEQ ID NO: 836423 - protein, 81 aa, Homo sapiens; identical to SEQ ID NO: 836422

SEQ ID NO: 836424 - protein, 270 aa, Homo sapiens
MGNTSSERAALERHGGHKTPRRDSSGGTKDGDRPKILMDSPEDADLFHSEEIKAPEKEEFLAWQHDLEVNDKAPAQARPTVFRWTGGGKEVYLSGSFNNWSKLPLTRSHNNFVAILDLPEGEHQYKFFVDGQWTHDPSEPIVTSQLGTVNNIIQVKKTDFEVFDALMVDSQKCSDVSELSSSPPGPYHQEPYVCKPEERFRAPPILPPHLLQVILNKDTGISCDPALLPEPNHVMLNHLYALSIKDGVMVLSATHRYKKKYVTTLLYKPI

SEQ ID NO: 836425 - protein, 255 aa, Homo sapiens
MGNTSSERAALERHGGHKTPRRDSSGGTKDGDRPKILMDSPEDADLFHSEEIKAPEKEEFLAWQHDLEVNDKAPAQARPTVFRWTGGGKEVYLSGSFNNWSKLPLTRSHNNFVAILDLPEGEHQYKFFVDGQWTHDPSEPIVTSQLGTVNNIIQVKKTDFEVFDALMVDSQKCSDVSELSSSPPGPYHQEPYVCKPEERFRAPPILPPHLLQVILNKDTGISHLPTPTTPSRWQPPLYSLLLVIQLCFLSPITSC

SEQ ID NO: 836426 - protein, 264 aa, Homo sapiens
MGNTSSERAALERHGGHKTPRRDSSGGTKDGDRPKILMDSLLQGPFPAVKHRLLPQLLGTGSRPEGDGCPGAPTVFRWTGGGKEVYLSGSFNNWSKLPLTRSHNNFVAILDLPEGEHQYKFFVDGQWTHDPSEPIVTSQLGTVNNIIQVKKTDFEVFDALMVDSQKCSDVSELSSSPPGPYHQEPYVCKPEERFRAPPILPPHLLQVILNKDTGISCDPALLPEPNHVMLNHLYALSIKDGVMVLSATHRYKKKYVTTLLYKPI

SEQ ID NO: 836427 - protein, 104 aa, Homo sapiens
MVDSQKCSDVSELSSSPPGPYHQEPYVCKPEERFRAPPILPPHLLQVILNKDTGISCDPALLPEPNHVMLNHLYALSIKDGVMVLSATHRYKKKYVTTLLYKPI

SEQ ID NO: 836428 - protein, 270 aa, Homo sapiens; identical to SEQ ID NO: 836424

SEQ ID NO: 836429 - protein, 252 aa, Homo sapiens
MGNTSSERAALERHGGHKTPRRDSSGGTKDGDRPKILMDSPEDADLFHSEEIKAPEKEEFLAWQHDLEVNDKAPAQARPTVFRWTGGGKEVYLSGSFNNWSKLPLTRSHNNFVAILDLPEGEHQYKFFVDGQWTHDPSEPIVTSQLGTVNNIIQVKKTDFEVFDALMVDSQKCSDVSELSSSPPGPYHQEPYVCKPEERFRAPPILPPHLLQVILNKDTGISCDPALLPEPNHTQRDFTRSRGTLLRTSAPS

SEQ ID NO: 836430 - protein, 270 aa, Homo sapiens; identical to SEQ ID NO: 836424

SEQ ID NO: 836431 - protein, 238 aa, Homo sapiens
MIDTSTGPALDTWGLWGLQFKAPEKEEFLAWQHDLEVNDKAPAQARPTVFRWTGGGKEVYLSGSFNNWSKLPLTRSHNNFVAILDLPEGEHQYKFFVDGQWTHDPSEPIVTSQLGTVNNIIQVKKTDFEVFDALMVDSQKCSDVSELSSSPPGPYHQEPYVCKPEERFRAPPILPPHLLQVILNKDTGISCDPALLPEPNHVMLNHLYALSIKDGVMVLSATHRYKKKYVTTLLYKPI

SEQ ID NO: 836432 - protein, 153 aa, Homo sapiens
MGNTSSERAALERHGGHKTPRRDSSGGTKDGDRPKILMDSPEDADLFHSEEIKAPEKEEFLAWQHDLEVNDKAPAQARPTVFRWTGGGKEVYLSGSFNNWSKLPLTRRAVQFSPRTLPSGALRLQTRRALSGTPYSPPTSPPGHPEQGHGDFL

SEQ ID NO: 836433 - protein, 252 aa, Homo sapiens; identical to SEQ ID NO: 836429

SEQ ID NO: 836434 - protein, 170 aa, Homo sapiens
MPVMRLFPCFLQLLAGLALPAVPPQQWALSAGNGSSEVEVVPFQEVWGRSYCRALERLVDVVSEYPSEVEHMFSPSCVSLLRCTGCCGDENLHCVPVETANVTMQLLKIRSGDRPSYVELTFSQHVRCECRPLREKMKPERRRPKGRGKRRREKQRPTDCHLCGDAVPRR

SEQ ID NO: 836435 - protein, 85 aa, Homo sapiens
CVSFPFSGMGGSCHGPLKEVPGGKDIASPNFVLGQAVCPQERANGAEKQQEGQARVGEKGQKKSDTVASLMLQHPSTAPPNPQSL

SEQ ID NO: 836436 - protein, 85 aa, Homo sapiens; identical to SEQ ID NO: 836435

SEQ ID NO: 836437 - protein, 170 aa, Homo sapiens; identical to SEQ ID NO: 836434

SEQ ID NO: 836438 - protein, 163 aa, Homo sapiens
MCSKWEGTQRGPYLLAITLGPRVQSSKVPPAHLCTFLSKQWALSAGNGSSEVEVVPFQEVWGRSYCRALERLVDVVSEYPSEVEHMFSPSCVSLLRCTGCCGDENLHCVPVETANVTMQLLKIRSGDRPSYVELTFSQHVRCECRPLREKMKPERCGDAVPRR

SEQ ID NO: 836439 - protein, 149 aa, Homo sapiens
MPVMRLFPCFLQLLAGLALPAVPPQQWALSAGNGSSEVEVVPFQEVWGRSYCRALERLVDVVSEYPSEVEHMFSPSCVSLLRCTGCCGDENLHCVPVETANVTMQLLKIRSGDRPSYVELTFSQHVRCECRPLREKMKPERCGDAVPRR

SEQ ID NO: 836440 - protein, 136 aa, Homo sapiens
MPVMRLFPCFLQLLAGLALPAVPPQQWALSAGNGSSEVEVVPFQEVWGRSYCRALERLVDVVSEYPSEVEHMFSPSCVSLLRCTGCCGDENLHCVPVETANVTMQLSKDPFWGHGPQYVVTFSHTRSQLQRGYGTD

SEQ ID NO: 836441 - protein, 85 aa, Homo sapiens; identical to SEQ ID NO: 836435

SEQ ID NO: 836442 - protein, 331 aa, Homo sapiens
MEPEFLYDLLQLPKGVEPPAEEELSKGGKKKYLPPTSRKDPKFEELQKVLMEWINATLLPEHIVVRSLEEDMFDGLILHHLFQRLAALKLEAEDIALTATSQKHKLTVVLEAVNRSLQLEEWQAKWSVESIFNKDLLSTLHLLVALAKRFQPDLSLPTNVQVEVITIESTKSGLKSEKLVEQLTEYSTDKDEPPKDVFDELFKLAPEKVNAVKEAIVNFVNQKLDRLGLSVQNLDTQFADGVILLLLIGQLEGFFLHLKEFYLTPNSPAEMLHNVTLALELLKDEGLLSCPVSPEDIVNKDAKSTLRVLYGLFCKHTQKAHRDRTPHGAPN

SEQ ID NO: 836443 - protein, 331 aa, Homo sapiens; identical to SEQ ID NO: 836442

SEQ ID NO: 836444 - protein, 349 aa, Homo sapiens
MEPEFLYDLLQLPKGVEPPAEEELSKGGKKKYLPPTSRKDPKFEELQKVLMEWINATLLPEHIVVRSLEEDMFDGLILHHLFQRLAALKLEAEDIALTATSQKHKLTVVLEAVNRSLQLEEWQAKWSVESIFNKDLLSTLHLLVALAKRFQPDLSLPTNVQVEVITIESTKSGLKSEKLVEQLTEYSTDKDEPPKDVFDELFKLAPEKVNAVKEAIVNFVNQKLDRLGLSVQNLDTQFADGVILLLLIGQLEGFFLHLKEFYLTPNSPAEMLHNVTLALELLKDEGLLSCPVSPEVGHCHPGLTGCPALLWPADIVNKDAKSTLRVLYGLFCKHTQKAHRDRTPHGAPN

SEQ ID NO: 836445 - protein, 331 aa, Homo sapiens; identical to SEQ ID NO: 836442

SEQ ID NO: 836446 - protein, 366 aa, Homo sapiens
MEPEFLYDLLQLPKGVEPPAEEELSKGGKKKYLPPTSRKDPKFEELQKVLMEWINATLLPEHIVVRSLEEDMFDGLILHHLFQRLAALKLEAEDIALTATSQKHKLTVVLEAVNRSLQLEEWQAKWSVESIFNKDLLSTLHLLVALAKRFQPDLSLPTNVQVEVITIEVAAWAPGICKQKLSLLGPHCRTLHGWSWLGRGCPRSTKSGLKSEKLVEQLTEYSTDKDEPPKDVFDELFKLAPEKVNAVKEAIVNFVNQKLDRLGLSVQNLDTQFADGVILLLLIGQLEGFFLHLKEFYLTPNSPAEMLHNVTLALELLKDEGLLSCPVSPEDIVNKDAKSTLRVLYGLFCKHTQKAHRDRTPHGAPN

SEQ ID NO: 836447 - protein, 251 aa, Homo sapiens
SATDSGNCKRPHAQLWGKGALSLTVRTLGMPWGVRQTHPQPQDSWGRKTIKPEAVLRRDDTEQTDHWGFFGPQSFLDYLISSPFIFLQSTKSGLKSEKLVEQLTEYSTDKDEPPKDVFDELFKLAPEKVNAVKEAIVNFVNQKLDRLGLSVQNLDTQFADGVILLLLIGQLEGFFLHLKEFYLTPNSPAEMLHNVTLALELLKDEGLLSCPVSPEDIVNKDAKSTLRVLYGLFCKHTQKAHRDRTPHGAPN

SEQ ID NO: 836448 - protein, 132 aa, Homo sapiens
MPLGASGIEVNAVKEAIVNFVNQKLDRLGLSVQNLDTQFADGVILLLLIGQLEGFFLHLKEFYLTPNSPAEMLHNVTLALELLKDEGLLSCPVSPEDIVNKDAKSTLRVLYGLFCKHTQKAHRDRTPHGAPN

SEQ ID NO: 836449 - protein, 78 aa, Homo sapiens
PSSFSSSSARVTLCSISAGELGVRKNSFKCRKKPSSCPVSPEDIVNKDAKSTLRVLYGLFCKHTQKAHRDRTPHGAPN

SEQ ID NO: 836450 - protein, 332 aa, Homo sapiens
MEPEFLYDLLQLPKGVEPPAEEELSKGGKKKYLPPTSRKDPKFEELQKVLMEWINATLLPEHIVVRSLEEDMFDGLILHHLFQRLAALKLEAEDIALTATSQKHKLTVVLEAVNRSLQLEEWQAKWSVESIFNKDLLSTLHLLVALAKRFQPDLSLPTNVQVEVITIESTKSGLKSEKLVEQLTEYSTDKDEPPEEDVFDELFKLAPEKVNAVKEAIVNFVNQKLDRLGLSVQNLDTQFADGVILLLLIGQLEGFFLHLKEFYLTPNSPAEMLHNVTLALELLKDEGLLSCPVSPEDIVNKDAKSTLRVLYGLFCKHTQKAHRDRTPHGAPN

SEQ ID NO: 836451 - protein, 331 aa, Homo sapiens; identical to SEQ ID NO: 836442

SEQ ID NO: 836452 - protein, 331 aa, Homo sapiens; identical to SEQ ID NO: 836442

SEQ ID NO: 836453 - protein, 286 aa, Homo sapiens [sequence omitted]

SEQ ID NO: 836454 - protein, 321 aa, Homo sapiens
MEPEFLYDLLQLPKGVEPPAEEELSKGGKKKYLPPTSRKDPKFEELQKVLMEWINATLLPEHIVVRSLEEDMFDGLILHHLFQRLAALKLEAEDIALTATSQKHKLTVVLEAVNRSLQLEEWQAKWSVESIFNKDLLSTLHLLVALAKRFQPDLSLPTNVQVEVITIESTKSGLKSEKLVEQLTEYSTDKDEPPEEDVFDELFKLAPEKVNAVKEAIVNFVNQKLDRLGLSVQNLDTQFADGVILLLLIGQLEGFFLHLKEFYLTPNSPAEMLHNVTLALELLKDEGLLSCPVSPEVDSRESRMPRCYTAAASYVVFRSQY

SEQ ID NO: 836455 - protein, 173 aa, Homo sapiens
TFAVRVHVLSSLAEFFPSHLRTQNAPNRRVLRSLSPKDVFDELFKLAPEKVNAVKEAIVNFVNQKLDRLGLSVQNLDTQFADGVILLLLIGQLEGFFLHLKEFYLTPNSPAEMLHNVTLALELLKDEGLLSCPVSPEDIVNKDAKSTLRVLYGLFCKHTQKAHRDRTPHGAPN

SEQ ID NO: 836456 - protein, 110 aa, Homo sapiens
MEGGGQADRVLVVGCGGRPQALAYVAAILEVNSLRGNWHGLGKAGRGGEMKALSLSGLQNPGGPGGTAGAGAPGRAFWRFVAASLSRHPPPSGPAAERRKLLPAERAWRK

SEQ ID NO: 836457 - protein, 637 aa, Homo sapiens
RHSRTRARGGPRYADKMAAAAVDSAMEVVPALAEEAAPEVAGLSCLVNLPGEVLEYILCCGSLTAADIGRVSSTCRRLRELCQSSGKVWKEQFRVRWPSLMKHYSPTDYVNWLEEYKVRQKAGLEARKIVASFSKRFFSEHVPCNGFSDIENLEGPEIFFEDELVCILNMEGRKALTWKYYAKKILYYLRQQKILNNLKAFLQQPDDYESYLEGAVYIDQYCNPLSDISLKDIQAQIDSIVELVCKTLRGINSRHPSLAFKAGESSMIMEIELQSQVLDAMNYVLYDQLKFKGNRMDYYNALNLYMHQVLIRRTGIPISMSLLYLTIARQLGVPLEPVNFPSHFLLRWCQGAEGATLDIFDYIYIDAFGKGKQLTVKECEYLIGQHVTAALYGVVNVKKVLQRMVGNLLSLGKREGIDQSYQLLRDSLDLYLAMYPDQVQLLLLQARLYFHLGIWPEKVLDILQHIQTLDPGQHGAVGYLVQHTLEHIERKKEEVGVEVKLRSDEKHRDVCYSIGLIMKHKRYGYNCVIYGWDPTCMMGHEWIRNMNVHSLPHGHHQPFYNVLVEDGSCRYAAQENLEYNVEPQEISHPDVGRYFSEFTGTHYIPNAELEIRYPEDLEFVYETVQNIYSAKKENIDE

SEQ ID NO: 836458 - protein, 637 aa, Homo sapiens; identical to SEQ ID NO: 836457

SEQ ID NO: 836459 - protein, 637 aa, Homo sapiens; identical to SEQ ID NO: 836457

SEQ ID NO: 836460 - protein, 637 aa, Homo sapiens; identical to SEQ ID NO: 836457

SEQ ID NO: 836461 - protein, 537 aa, Homo sapiens
MKHYSPTDYVNWLEEYKVRQKAGLEARKIVASFSKRFFSEHVPCNGFSDIENLEGPEIFFEDELVCILNMEGRKALTWKYYAKKILYYLRQQKILNNLKAFLQQPDDYESYLEGAVYIDQYCNPLSDISLKDIQAQIDSIVELVCKTLRGINSRHPSLAFKAGESSMIMEIELQSQVLDAMNYVLYDQLKFKGNRMDYYNALNLYMHQVLIRRTGIPISMSLLYLTIARQLGVPLEPVNFPSHFLLRWCQGAEGATLDIFDYIYIDAFGKGKQLTVKECEYLIGQHVTAALYGVVNVKKVLQRMVGNLLSLGKREGIDQSYQLLRDSLDLYLAMYPDQVQLLLLQARLYFHLGIWPEKVLDILQHIQTLDPGQHGAVGYLVQHTLEHIERKKEEVGVEVKLRSDEKHRDVCYSIGLIMKHKRYGYNCVIYGWDPTCMMGHEWIRNMNVHSLPHGHHQPFYNVLVEDGSCRYAAQENLEYNVEPQEISHPDVGRYFSEFTGTHYIPNAELEIRYPEDLEFVYETVQNIYSAKKENIDE

SEQ ID NO: 836462 - protein, 468 aa, Homo sapiens
MEGRKALTWKYYAKKILYYLRQQKILNNLKAFLQQPDDYESYLEGAVYIDQYCNPLSDISLKDIQAQIDSIVELVCKTLRGINSRHPSLAFKAGESSMIMEIELQSQVLDAMNYVLYDQLKFKGNRMDYYNALNLYMHQVLIRRTGIPISMSLLYLTIARQLGVPLEPVNFPSHFLLRWCQGAEGATLDIFDYIYIDAFGKGKQLTVKECEYLIGQHVTAALYGVVNVKKVLQRMVGNLLSLGKREGIDQSYQLLRDSLDLYLAMYPDQVQLLLLQARLYFHLGIWPEKVLDILQHIQTLDPGQHGAVGYLVQHTLEHIERKKEEVGVEVKLRSDEKHRDVCYSIGLIMKHKRYGYNCVIYGWDPTCMMGHEWIRNMNVHSLPHGHHQPFYNVLVEDGSCRYAAQENLEYNVEPQEISHPDVGRYFSEFTGTHYIPNAELEIRYPEDLEFVYETVQNIYSAKKENIDE

SEQ ID NO: 836463 - protein, 198 aa, Homo sapiens
RHSRTRARGGPRYADKMAAAAVDSAMEVVPALAEEAAPEVAGLSCLVNLPGEVLEYILCCGSLTAADIGRVSSTCRRLRELCQSSGKVWKEQFRVRWPSLMKHYSPTDYVNWLEEYKVRQKAGLEARKIVASFSKRFFSEHVPCNGFSDIENLEGPEIFFEDELVCILNMEGRKALTWKYYAKSFEGKKSGFTPLVIP

SEQ ID NO: 836464 - protein, 354 aa, Homo sapiens
RHSRTRARGGPRYADKMAAAAVDSAMEVVPALAEEAAPEVAGLSCLVNLPGEVLEYILCCGSLTAADIGRVSSTCRRLRELCQSSGKVWKEQFRVRWPSLMKHYSPTDYVNWLEEYKVRQKAGLEARKIVASFSKRFFSEHVPCNGFSDIENLEGPEIFFEDELVCILNMEGRKALTWKYYAKKILYYLRQQKILNNLKAFLQQPDDYESYLEGAVYIDQYCNPLSDISLKDIQAQIDSIVELVCKTLRGINSRHPSLAFKAGESSMIMEIELQSQVLDAMNYVLYDQLKFKGNRMDYYNALNLYMHQVLIRRTGIPISMSLLYLTIARQLGVPLEPVNFPSHFLLRWCQGAEG

SEQ ID NO: 836465 - protein, 637 aa, Homo sapiens; identical to SEQ ID NO: 836457

SEQ ID NO: 836466 - protein, 644 aa, Homo sapiens
RHSRTRARGGPRYADKMAAAAVDSAMEVVPALAEEAAPEVAGLSCLVNLPGEVLEYILCCGSLTAADIGRVSSTCRRLRELCQSSGKVWKEQFRVRWPSLMKHYSPTDYVNWLEEYKVRQKAGLEARKIVASFSKRFFSEHVPCNGFSDIENLEGPEIFFEDELVCILNMEGRKALTWKYYAKKILYYLRQQKILNNLKAFLQQPDDYESYLEGAVYIDQYCNPLSDISLKDIQAQIDSIVELVCKTLRGINSRHPSLAFKAGESSMIMEIELQSQVLDAMNYVLYDQLKFKGNRMDYYNALNLYMHQVLIRRTGIPISMSLLYLTIARQLGVPLEPVNFPSHFLLRWCQGAEGATLDIFDYIYIDAFGKGKQLTVKECEYLIGQHVTAALYGVVNVKKVLQRMVGNLLSLGKREGIDQSYQLLRDSLDLYLAMYPDQVQLLLLQARLYFHLGIWPEKSFCLVLKVLDILQHIQTLDPGQHGAVGYLVQHTLEHIERKKEEVGVEVKLRSDEKHRDVCYSIGLIMKHKRYGYNCVIYGWDPTCMMGHEWIRNMNVHSLPHGHHQPFYNVLVEDGSCRYAAQENLEYNVEPQEISHPDVGRYFSEFTGTHYIPNAELEIRYPEDLEFVYETVQNIYSAKKENIDE

SEQ ID NO: 836467 - protein, 537 aa, Homo sapiens; identical to SEQ ID NO: 836461

SEQ ID NO: 836468 - protein, 223 aa, Homo sapiens
RHSRTRARGGPRYADKMAAAAVDSAMEVVPALAEEAAPEVAGLSCLVNLPGEVLEYILCCGSLTAADIGRVSSTCRRLRELCQSSGKVWKEQFRVRWPSLMKHYSPTDYVNWLEEYKVRQKAGLEARKIVASFSKRFFSEHVPCNGFSDIENLEGPEIFFEDELVCILNMEGRKALTWKYYAKKILYYLRQQKILNNLKAFLQQPDDYESYLEAAAPGKPLHQ

SEQ ID NO: 836469 - protein, 586 aa, Homo sapiens
RHSRTRARGGPRYADKMAAAAVDSAMEVVPALAEEAAPEVAGLSCLVNLPGEVLEYILCCGSLTAADIGRVSSTCRRLRELCQSSGKVWKEQFRVRWPSLMKHYSPTDYVNWLEEYKVRQKAGLEARKIVASFSKRFFSEHVPCNGFSDIENLEGPEIFFEDELVCILNMEGRKALTWKYYAKKILYYLRQQKILNNLKAFLQQPDDYESYLEGAVYIDQYCNPLSDISLKDIQAQIDSIVELVCKTLRGINSRHPSLAFKAGESSMIMEIELQSQVLDAMNYVLYDQLKFKGNRMDYYNALNLYMHQVLIRRTGIPISMSLLYLTIARQLGVPLEPVNFPSHFLLRWCQGAEGATLDIFDYIYIDAFGKGKQLTVKECEYLIGQHVTAALYGVVNVKKVLQRMVGNLLSLGKREGIDQSYQLLRDSLDLYLAMYPDQVQLLLLQARLYFHLGIWPEKVLDILQHIQTLDPGQHGAVGYLVQHTLEHIERKKEEVGVEVKLRSDEKHRDVCYSIGLIMKHKRYGYNCVIYGWDPTCMMGHEWIRNMNVHSLPHGHHQPFYNVLVEDGSCRYAAQGRLPCLSVMGMV

SEQ ID NO: 836470 - protein, 315 aa, Homo sapiens
LGAYLERHGPPEASELPEPGGALAGGPGSGGGGVVVGVAEVRNWRCCCLGSTCWCRSLVLVCVLAALCFASLALVRRYLHHLLLWVESLDSLLGVLLFVVGFIVVSFPCGWGYIVLNVAAGYLYGFVLGMGLMMVGVLIGTFIAHVVCKRLLTAWVAARIQSSEKLSAVIRVVEGGSGLKVVALARLTPIPFGLQNAVFSITDLSLPNYLMASSVGLLPTQLLNSYLGTTLRTMEDVIAEQSVSGYIVFWLQIIISIGLMFYVVHRAQVELNAAIVACEMELKSSLVKGNQPNTSGSSFYNKRTLTFSGGGINVV

SEQ ID NO: 836471 - protein, 315 aa, Homo sapiens; identical to SEQ ID NO: 836470

SEQ ID NO: 836472 - protein, 292 aa, Homo sapiens
LGAYLERHGPPEASELPEPGGALAGGPGSGGGGVVVGVAEVRNWRCCCLGSTCWCRSLVLVCVLAALCFASLALVRRYLHHLLLWVESLDSLLGVLLFVVGFIVVSFPCGWGYIVLNVAAGYLYGFVLGMGLMMVGVLIGTFIAHVVCKRLLTAWVAARIQSSEKLSAVIRVVEGGSGLKVVALARLTPIPFGLQNAVFSITDLSLPNYLMASSVGLLPTQLLNSYLGKQPKEKGESYETKYKKIRHGFTIKKCPRQMNHDQVMMRRTVMTTRYGPNVSYKTHRGTITHTGS

SEQ ID NO: 836473 - protein, 315 aa, Homo sapiens; identical to SEQ ID NO: 836470

SEQ ID NO: 836474 - protein, 175 aa, Homo sapiens
MEVPPPAPRSFLCRALCLFPRVFAAEAVTADSEVLEERQKRLPYVPEPYYPESGWDRLRELFGKDEQQRISKDLANICKTAATAGIIGWVYGGIPAFIHAKQQYIEQSQAEIYHNRFDAVQSAHRAATRGFIRYGWRWGWRTAVFVTIFNTVNTSLNVYRNKDALSHFVIAGALL

SEQ ID NO: 836475 - protein, 200 aa, Homo sapiens [sequence omitted]

SEQ ID NO: 836476 - protein, 165 aa, Homo sapiens
MGEYQLLFMLNNNTLSRARQKFIITGLMLCTVNTSLNVYRNKDALSHFVIAGAVTGSLFRINVGLRGLVAGGIIGALLGTPVGGLLMAFQKYSGETVQERKQKDRKALHELKLEEWKGRLQVTEHLPEKIESSLQEDEPENDAKKIEALLNLPRNPSVIDKQDKD

SEQ ID NO: 836477 - protein, 285 aa, Homo sapiens
MEVPPPAPRSFLCRALCLFPRVFAAEAVTADSEVLEERQKRLPYVPEPYYPESGWDRLRELFGKDEQQRISKDLANICKTAATAGIIGWVYGGIPAFIHAKQQYIEQSQAEIYHNRFDAVQSAHRAATRGFIRYGWRWGWRTAVFVTIFNTVNTSLNVYRNKDALSHFVIAGAVTGSLFRINVGLRGLVAGGIIGALLGTPVGGLLMAFQKYSGETVQERKQKDRKALHELKLEEWKGRLQVTEHLPEKIESSLQEDEPENDAKKIEALLNLPRNPSVIDKQDKD

SEQ ID NO: 836478 - protein, 285 aa, Homo sapiens; identical to SEQ ID NO: 836477

SEQ ID NO: 836479 - protein, 211 aa, Homo sapiens
MEVPPPAPRSFLCRALCLFPRVFAAEAVTADSEVLEERQKRLPYVPEPYYPESGWDRLRELFGKDEQQRISKDLANICKTAATAGIIGWVYGGIPAFIHAKQQYIEQSQAEIYHNRFDAVQSAHRAATRGFIRYGWRWGWRTAVFVTIFNTVNTSLNVYRNKDALSHFVIAGAVTGSLFRINVGLRGLVAGGIIGALLGTPVGGLLMAFQN

SEQ ID NO: 836480 - protein, 285 aa, Homo sapiens; identical to SEQ ID NO: 836477

SEQ ID NO: 836481 - protein, 128 aa, Homo sapiens
MEVPPPAPRSFLCRALCLFPRVFAAEAVTADSEVLEERQKRLPYVPEPYYPESGWDRLRELFGKDEQQRISKDLANICKTAATAGIIGWVYGGIPAFIHAKQQYIEQSQAEIYHNRFDAVLSREVFLG

SEQ ID NO: 836482 - protein, 285 aa, Homo sapiens; identical to SEQ ID NO: 836477

SEQ ID NO: 836483 - protein, 96 aa, Homo sapiens
ALEDPRGCMGTPVGGLLMAFQKYSGETVQERKQKDRKALHELKLEEWKGRLQVTEHLPEKIESSLQEDEPENDAKKIEALLNLPRNPSVIDKQDKD

SEQ ID NO: 836484 - protein, 150 aa, Homo sapiens
MEVPPPAPRSFLCRALCLFPRVFAAEAVTADSEVLEERQKRLPYVPEPYYPESGWDRLRELFGKDEQQRISKDLANICKTAATAGIIGWVYGGIPAFIHAKQQYIEQSQAEIYHNRFDAVQSAHRAATRGFIRYGWRWGWRTAVFVTIFK

SEQ ID NO: 836485 - protein, 590 aa, Homo sapiens
SQNKQVRITFGFSCKNSNQFGIMMYHNNRLIKSFEKVGCQVKPTRGEGVGVIGVIECNFLKPAYNKQDFEYTKEYRLTINALAQKLNAYWKEKTSQDNFETSTVARPIPKVPDQTWVQCDECLKWRKLPGKIDPSMLPARWFCYYNSHPKYRRCSVPEEQELTDEDLCLSKAKKQEQTVEEKKKMPMENENHQVFSNPPKILTVQEMAGLNNKTIGYEGIHSPSVLPSGGEESRSPSLQLKPLDSSVLQFSSKYKWILGEEPVEKRRRLQNEMTTPSLDYSMPAPYRRVEAPVAYPEGENSHDKSSSERSTPPYLFPEYPEASKNTGQNREVSILYPGAKDQRQGSLLPEELEDQMPRLVAEESNRGSTTINKEEVNKGPFVAVVGVAKGVRDSGAPIQLIPFNREELAERRKAVESWNPVPYSVASAAIPAAAIGEKARGYEESEGHNTPKLKNQRELEELKRTTEKLERVLAERNLFQQKVEELEQERNHWQSEFKKVQHELVIYSTQEAEGLYWSKKHMGYRQAEFQILKAELERTKEEKQELKEKLKETETHLEMLQKAQGFGKAYAATYPRQLSPYFCPPSLGAS

SEQ ID NO: 836486 - protein, 582 aa, Homo sapiens
SQNKQVRITFGFSCKNSNQFGIMMYHNNRLIKSFEKVGCQVKPTRGEGVGVIGVIECNFLKPAYNKQDFEYTKEYRLTINALAQKLNAYWKEKTSQDNFETSTVARPIPKVPDQTWVQCDECLKWRKLPGKIDPSMLPARWFCYYNSHPKYRRCSVPEEQELTDEDLCLSKAKKQEQTVEEKKKMPMENENHQVFSNPPKILTVQEMAGLNNKTIGYEGIHSPSVLPSGGEESRSPSLQLKPLDSSVLQFSSKYKWILGEEPVEKRRRLQNEMTTPSLDYSMPAPYRRVEAPVAYPEGENSHDKSSSERSTPPYLFPEYPEASKNTGQNREVSILYPGAKDQRQGSLLPEELEDQMPRLVAEESNRGSTTINKEEVNKGPFVAVVGVAKGVRDSGAPIQLIPFNREELAERRKAVESWNPVPYSVASAAIPAAAIGEKARGYEESEGHNTPKLKNQRELEELKRTTEKLERVLAERNLFQQKVEELEQERNHWQSEFKKVQHELVIYSTQEAEGLYWSKKHMGYRQAEFQILKAELERTKEEKQELKEKLKETETHLEMLQKAQVSYRTPEGDDLERLITRV

SEQ ID NO: 836487 - protein, 627 aa, Homo sapiens
SQNKQVRITFGFSCKNSNQFGIMMYHNNRLIKSFEKVGCQVKPTRGEGVGVIGVIECNFLKPAYNKQDFEYTKEYRLTINALAQKLNAYWKEKTSQDNFETSTVARPIPKVPDQTWVQCDECLKWRKLPGKIDPSMLPARWFCYYNSHPKYRRCSVPEEQELTDEDLCLSKAKKQEQTVEEKKKMPMENENHQVFSNPPKILTVQEMAGLNNKTIGYEGIHSPSVLPSGGEESRSPSLQLKPLDSSVLQFSSKYKWILGEEPVEKRRRLQNEMTTPSLDYSMPAPYRRVEAPVAYPEGENSHDKSSSERSTPPYLFPEYPEASKNTGQNREVSILYPGAKDQRQGSLLPEELEDQMPRLVAEESNRGSTTINKEEVNKGPFVAVVGVAKGVRDSGAPIQLIPFNREELAERRKAVESWNPVPYSVASAAIPAAAIGEKARGYEESEGHNTPKLKNQRELEELKRTTEKLERVLAERNLFQQKVEELEQERNHWQSEFKKVQHELVIYSTQEAEGLYWSKKHMGYRQAEFQILKAELERTKEEKQELKEKLKETETHLEMLQKAQVSYRTPEGDDLERALAKLTRLRIHVSYLLTSVLPHLELREIGYDSEQVDGILYTVLEANHILD

SEQ ID NO: 836488 - protein, 590 aa, Homo sapiens; identical to SEQ ID NO: 836485

SEQ ID NO: 836489 - protein, 411 aa, Homo sapiens
MSKRPSYAPPPTPAPATQMPSTPGFVGYNPYSHLAYNNYRLGGNPGTNSRVTASSGITIPKPPKPPDKPLMPYMRYSRKVWDQVKASNPDLKLWEIGKIIGGMWRDLTDEEKQEYLNEYEAEKIEYNESMKAYHNSPAYLAYINAKSRAEAALEEESRQRQSRMEKGEPYMSIQPAEDPDDYDDGFSMKHTATARFQRNHRLISEILSESVVPDVRSVVTTARMQVLKRQVQSLMVHQRKLEAELLQIEERHQEKKRKFLESTDSFNNELKRLCGLKVEVDMEKIAAEIAQAEEQARKRQEEREKEAAEQAERSQSSIVPEEEQAANKGEEKKDDENIPMETEETHLEETTESQQNGEEGTSTPEDKESGQEGVDSMAEEGTSDSNTGSESNSATVEEPPTDPIPEDEKKE

SEQ ID NO: 836490 - protein, 411 aa, Homo sapiens; identical to SEQ ID NO: 836489

SEQ ID NO: 836491 - protein, 411 aa, Homo sapiens; identical to SEQ ID NO: 836489

SEQ ID NO: 836492 - protein, 411 aa, Homo sapiens; identical to SEQ ID NO: 836489

SEQ ID NO: 836493 - protein, 272 aa, Homo sapiens
MSKRPSYAPPPTPAPATQMPSTPGFVGYNPYSHLAYNNYRLGGNPGTNSRVTASSGITIPKPPKPPDKPLMPYMRYSRKVWDQVKASNPDLKLWEIGKIIGGMWRDLTDEEKQEYLNEYEAEKIEYNESMKAYHNSPAYLAYINAKSRAEAALEEESRQRQSRMEKGEPYMSIQPAEDPDDYDDGFSMKHTATARFQRNHRLISEILSESVVPDVRSVVTTARMQVLKRQVQSLMVHQRKLEAELLQIEERHQEKKRKFLESTDSFNNELKR

SEQ ID NO: 836494 - protein, 349 aa, Homo sapiens
MSKRPSYAPPPTPAPATQMPSTPGFVGYNPYSHLAYNNYRLGGNPGTNSRVTASSGITIPKPPKPPDKPLMPYMRYSRKVWDQVKASNPDLKLWEIGKIIGGMWRDLTDEEKQEYLNEYEAEKIEYNESMKAYHNSPAYLAYINAKSRAEAALEEESRQRQSRMEKGEPYMSIQPAEDPDDYDDGFSMKHTATARFQRNHRLISEILSESVVPDVRSVVTTARMQVLKRQVQSLMVHQRKLEAELLQIEERHQEKKRKFLESTDSFNNELKRLCGLKVEVDMEKIAAEIAQAEEQARKRQEEREKEAAEQAERSQSSIVPEEEQAANKGEEKKDDENIPMETEETQPLA

SEQ ID NO: 836495 - protein, 351 aa, Homo sapiens
MSKRPSYAPPPTPAPATQMPSTPGFVGYNPYSHLAYNNYRLGGNPGTNSRVTASSGITIPKPPKPPDKPLMPYMRYSRKVWDQVKASNPDLKLWEIGKIIGGMWRDLTDEEKQEYLNEYEAEKIEYNESMKAYHNSPAYLAYINAKSRAEAALEEESRQRQSRMEKGEPYMSIQPAEDPDDYDDGFSMKHTATARFQRNHRLISEILSESVVPDVRSVVTTARMQVLKRQVQSLMVHQRKLEAELLQIEERHQEKKRKFLESTDSFNNELKRLCGLKVEVDMEKIAAEIAQAEEQARKRQEEREKEAAEQAERSQSSIVPEEEQAVRGCFTSNGRVHNDLETDGDTTLARR

SEQ ID NO: 836496 - protein, 303 aa, Homo sapiens
MSKRPSYAPPPTPAPATQMPSTPGFVGYNPYSHLAYNNYRLGGNPGTNSRVTASSGITIPKPPKPPDKPLMPYMRYSRKVWDQVKASNPDLKLWEIGKIIGGMWRDLTDEEKQEYLNEYEAEKIEYNESMKAYHNSPAYLAYINAKSRAEAALEEESRQRQSRMEKGEPYMSIQPAEDPDDYDDGFSMKHTATARFQRNHRLISEILSESVVPDVRSVVTTARMQVLKRQVQSLMVHQRKLEAELLQIEERHQEKKRKFLESTDSFNNELKRLCGLKVEVDMEKISARLFCIYVSQDAGDNEY

SEQ ID NO: 836497 - protein, 404 aa, Homo sapiens
SCFCLICFHQQMPSTPGFVGYNPYSHLAYNNYRLGGNPGTNSRVTASSGITIPKPPKPPDKPLMPYMRYSRKVWDQVKASNPDLKLWEIGKIIGGMWRDLTDEEKQEYLNEYEAEKIEYNESMKAYHNSPAYLAYINAKSRAEAALEEESRQRQSRMEKGEPYMSIQPAEDPDDYDDGFSMKHTATARFQRNHRLISEILSESVVPDVRSVVTTARMQVLKRQVQSLMVHQRKLEAELLQIEERHQEKKRKFLESTDSFNNELKRLCGLKVEVDMEKIAAEIAQAEEQARKRQEEREKEAAEQAERSQSSIVPEEEQAANKGEEKKDDENIPMETEETHLEETTESQQNGEEGTSTPEDKESGQEGVDSMAEEGTSDSNTGSESNSATVEEPPTDPIPEDEKKE

SEQ ID NO: 836498 - protein, 202 aa, Homo sapiens
TDEDAFRRVNPFEIFLEDEMGGGRDSEEMEIDGDPFSAIGFSMNGYPDEDAVFADSFNNELKRLCGLKVEVDMEKIAAEIAQAEEQARKRQEEREKEAAEQAERSQSSIVPEEEQAANKGEEKKDDENIPMETEETHLEETTESQQNGEEGTSTPEDKESGQEGVDSMAEEGTSDSNTGSESNSATVEEPPTDPIPEDEKKE

SEQ ID NO: 836499 - protein, 411 aa, Homo sapiens; identical to SEQ ID NO: 836489

SEQ ID NO: 836500 - protein, 411 aa, Homo sapiens; identical to SEQ ID NO: 836489

SEQ ID NO: 836501 - protein, 411 aa, Homo sapiens; identical to SEQ ID NO: 836489

SEQ ID NO: 836502 - protein, 411 aa, Homo sapiens; identical to SEQ ID NO: 836489

SEQ ID NO: 836503 - protein, 363 aa, Homo sapiens
MSKRPSYAPPPTPAPATQMPSTPGFVGYNPYSHLAYNNYRLGGNPGTNSRVTASSGITIPKPPKPPDKPLMPYMRYSRKVWDQVKASNPDLKLWEIGKIIGGMWRDLTDEEKQEYLNEYEAEKIEYNESMKAYHNSPAYLAYINAKSRAEAALEEESRQRQSRMEKGEPYMSIQPAEDPDDYDDGFSMKHTATARFQRNHRLISEILSESVVPDVRSVVTTARMQVLKRQVQSLMVHQRKLEAELLQIEERHQEKKRKFLESTDSFNNELKRLCGLKVEVDMEKIAAEIAQAEEQARKRQEEREKEAAEQAERSQSSIVPEEEQAANKGEEKKDDENIPMETEKNCQLCPRKTLTSRYTDFPD

SEQ ID NO: 836504 - protein, 435 aa, Homo sapiens
PTGAYEVNGGTERGTNETENLICQNVKRPSYAPPPTPAPATQMPSTPGFVGYNPYSHLAYNNYRLGGNPGTNSRVTASSGITIPKPPKPPDKPLMPYMRYSRKVWDQVKASNPDLKLWEIGKIIGGMWRDLTDEEKQEYLNEYEAEKIEYNESMKAYHNSPAYLAYINAKSRAEAALEEESRQRQSRMEKGEPYMSIQPAEDPDDYDDGFSMKHTATARFQRNHRLISEILSESVVPDVRSVVTTARMQVLKRQVQSLMVHQRKLEAELLQIEERHQEKKRKFLESTDSFNNELKRLCGLKVEVDMEKIAAEIAQAEEQARKRQEEREKEAAEQAERSQSSIVPEEEQAANKGEEKKDDENIPMETEETHLEETTESQQNGEEGTSTPEDKESGQEGVDSMAEEGTSDSNTGSESNSATVEEPPTDPIPEDEKKE

SEQ ID NO: 836505 - protein, 188 aa, Homo sapiens
MQVLKRQVQSLMVHQRKLEAELLQIEERHQEKKRKFLESTDSFNNELKRLCGLKVEVDMEKIAAEIAQAEEQARKRQEEREKEAAEQAERSQSSIVPEEEQAANKGEEKKDDENIPMETEETHLEETTESQQNGEEGTSTPEDKESGQEGVDSMAEEGTSDSNTGSESNSATVEEPPTDPIPEDEKKE

SEQ ID NO: 836506 - protein, 181 aa, Homo sapiens
QQNGEEGTSTPEDKESGQEGVDSMAEEGTSDSNTGSESNSATVEEPPTDPIPEDEAAEIAQAEEQARKRQEEREKEAAEQAERSQSSIVPEEEQAANKGEEKKDDENIPMETEETHLEETTESQQNGEEGTSTPEDKESGQEGVDSMAEEGTSDSNTGSESNSATVEEPPTDPIPEDEKKE

SEQ ID NO: 836507 - protein, 212 aa, Homo sapiens
MSKRPSYAPPPTPAPATQMPSTPGFVGYNPYSHLAYNNYRLGGNPGTNSRVTASSGITIPKPPKPPDKPLMPYMRYSRKVWDQVKASNPDLKLWEIGKIIGGMWRDLTDEEKQEYLNEYEAEKIEYNESMKAYHNSPAYLAYINAKSRAEAALEEESRQRQSRMEKGEPYMSIQPAEDPDDKRKKVGFCLCFLCELRYEKSLKYKFLFLILN

SEQ ID NO: 836508 - protein, 1086 aa, Homo sapiens
MATVGEWSCVRCTFLNPAGQRQCSICEAPRHKPDLNHILRLSVEEQKWPCARCTFRNFLGKEACEVCGFTPEPAPGAAFLPVLNGVLPKPPAILGEPKGSCQEEAGPVRTAGLVATEPARGQCEDKDEEEKEEQEEEEGAAEPRGGWACPRCTLHNTPVASSCSVCGGPRRLSLPRIPPEALVVPEVVAPAGFHVVPAAPPPGLPGEGAEANPPATSQGPAAEPEPPRVPPFSPFSSTLQNNPVPRSRREVPPQLQPPVPEAAQPSPSAGCRGAPQGSGWAGASRLAELLSGKRLSVLEEEATEGGTSRVEAGSSTSGSDIIDLAGDTVRYTPASPSSPDFTTWSCAKCTLRNPTVAPRCSACGCSKLHGFQEHGEPPTHCPDCGADKPSPCGRSCGRVSSAQKAARVLPERPGQWACPACTLLNALRAKHCAACHTPQLLVAQRRGAAPLRRRESMHVEQRRQTDEGEAKALWENIVAFCRENNVSFVDDSFPPGPESVGFPAGDSVQQRVRQWLRPQEINCSVFRDHRATWSVFHTLRPSDILQGLLGNCWFLSALAVLAERPDLVERVMVTRSLCAEGAYQVRLCKDGTWTTVLVDDMLPCDEAGCLLFSQAQRKQLWVALIEKALAKLHGSYFALQAGRAIEGLATLTGAPCESLALQLSSTNPREEPVDTDLIWAKMLSSKEAGFLMGASCGGGNMKVDDSAYESLGLRPRHAYSILDVRDVQGTRLLRLRNPWGRFSWNGSWSDEWPHWPGHLRGELMPHGSSEGVFWMEYGDFVRYFDSVDICKVHSDWQEARVQGCFPSSASAPVGVTALTVLERASLEFALFQEGSRRSDAVDSHLLDLCILVFRATFGSGGHLSLGRLLAHSKRAVKKFVSCDVMLEPGEYAVVCCAFNHWGPPLPGTPAPQASSPSAGVPRASPEPPGHVLAVYSSRLVMVEPVEAQPTTLADAIILLTESRGERHEGREGMTCYYLTHGWAGLIVVVENRHPKAYLHVQCDCTDSFNVVSTRGSLRTQDSVPPLHRQVLVILSQLEGNAGFSITHRLAHRKAAQAFLSDWTASKGTHSPPLTPEVAGLHGPRPL

SEQ ID NO: 836509 - protein, 1210 aa, Homo sapiens
QRRVRPGRAVAAGPGPGATLRRQRKAGAGRGQGPGPEPGRGAPRLRSGRPSGQRGRRREGPRRSPEAEVVDRPAGASGPGGRGRAARAARTRRRRRAVEAAAQTRHREGLGACCSFSHTHSPGSMATVGEWSCVRCTFLNPAGQRQCSICEAPRHKPDLNHILRLSVEEQKWPCARCTFRNFLGKEACEVCGFTPEPAPGAAFLPVLNGVLPKPPAILGEPKGSCQEEAGPVRTAGLVATEPARGQCEDKDEEEKEEQEEEEGAAEPRGGWACPRCTLHNTPVASSCSVCGGPRRLSLPRIPPEALVVPEVVAPAGFHVVPAAPPPGLPGEGAEANPPATSQGPAAEPEPPRVPPFSPFSSTLQNNPVPRSRREVPPQLQPPVPEAAQPSPSAGCRGAPQGSGWAGASRLAELLSGKRLSVLEEEATEGGTSRVEAGSSTSGSDIIDLAGDTVRYTPASPSSPDFTTWSCAKCTLRNPTVAPRCSACGCSKLHGFQEHGEPPTHCPDCGADKPSPCGRSCGRVSSAQKAARVLPERPGQWACPACTLLNALRAKHCAACHTPQLLVAQRRGAAPLRRRESMHVEQRRQTDEGEAKALWENIVAFCRENNVSFVDDSFPPGPESVGFPAGDSVQQRVRQWLRPQEINCSVFRDHRATWSVFHTLRPSDILQGLLGNCWFLSALAVLAERPDLVERVMVTRSLCAEGAYQVRLCKDGTWTTVLVDDMLPCDEAGCLLFSQAQRKQLWVALIEKALAKLHGSYFALQAGRAIEGLATLTGAPCESLALQLSSTNPREEPVDTDLIWAKMLSSKEAGFLMGASCGGGNMKVDDSAYESLGLRPRHAYSILDVRDVQGTRLLRLRNPWGRFSWNGSWSDEWPHWPGHLRGELMPHGSSEGVFWMEYGDFVRYFDSVDICKVHSDWQEARVQGCFPSSASAPVGVTALTVLERASLEFALFQEGSRRSDAVDSHLLDLCILVFRATFGSGGHLSLGRLLAHSKRAVKKFVSCDVMLEPGEYAVVCCAFNHWGPPLPGTPAPQASSPSAGVPRASPEPPGHVLAVYSSRLVMVEPVEAQPTTLADAIILLTESRGERHEGREGMTCYYLTHGWAGLIVVVENRHPKAYLHVQCDCTDSFNVVSTRGSLRTQDSVPPLHRQVLVILSQLEGNAGFSITHRLAHRKAAQAFLSDWTASKGTHSPPLTPEVAGLHGPRPL

SEQ ID NO: 836510 - protein, 1157 aa, Homo sapiens
QRRVRPGRAVAAGPGPGATLRRQRKAGAGRGQGPGPEPGRGAPRLRSGRPSGQRGRRREGPRRSPEAEVVDRPAGASGPGGRGRAARAARTRRRRRAVEAAAQTRHREGLGACCSFSHTHSPGSMATVGEWSCVRCTFLNPAGQRQCSICEAPRHKPDLNHILRLSVEEQKWPCARCTFRNFLGKEACEVCGFTPEPAPGAAFLPVLNGVLPKPPAILGEPKGSCQEEAGPVRTAGLVATEPARGQCEDKDEEEKEEQEEEEGAAEPRGGWACPRCTLHNTPVASSCSVCGGPRRLSLPRIPPEALVVPEVVAPAGFHVVPAAPPPGLPGEGAEANPPATSQGPAAEPEPPRVPPFSPFSSTLQNNPVPRSRREVPPQLQPPVPEAAQPSPSAGCRGAPQGSGWAGASRLAELLSGKRLSVLEEEATEGGTSRVEAGSSTSGSDIIDLAGDTVRYTPASPSSPDFTTWSCAKCTLRNPTVAPRCSACGCSKLHGFQEHGEPPTHCPDCGADKPSPCGRSCGRVSSAQKAARVLPERPGQWACPACTLLNALRAKHCAACHTPQLLVAQRRGAAPLRRRESMHVEQRRQTDEGEAKALWENIVAFCRENNVSFVDDSFPPGPESVGFPAGDSVQQRVRQWLRPQEINCSVFRDHRATWSVFHTLRPSDILQGLLGNCWFLSALAVLAERPDLVERVMVTRSLCAEGAYQVRLCKDGTWTTVLVDDMLPCDEAGCLLFSQAQRKQLWVALIEKALAKLHGSYFALQAGRAIEGLATLTGAPCESLALQLSSTNPREEPVDTDLIWAKMLSSKEAGFLMGASCGGGNMKVDDSAYESLGLRPRHAYSILDVRDVQGTRLLRLRNPWGRFSWNGSWSDEWPHWPGHLRGELMPHGSSEGVFWMEYGDFVRYFDSVDICKVHSDWQEARVQGCFPSSASAPVGVTALTVLERASLEFALFQEGSRRSDAVDSHLLDLCILVFRATFGSGGHLSLGRLLAHSKRAVKKFVSCDVMLEPGEYAVVCCAFNHWGPPLPGTPAPQASSPSAGVPRASPEPPGHVLAVYSSRLVMVEPVEAQPTTLADAIILLTESRGERHEGREGMTCYYLTHGWAGLIVVVENRHPKAYLHVQCDCTDSFNVVSTRGSLRTQDSVPPLHSPVPLP

SEQ ID NO: 836511 - protein, 1097 aa, Homo sapiens
QRRVRPGRAVAAGPGPGATLRRQRKAGAGRGQGPGPEPGRGAPRLRSGRPSGQRGRRREGPRRSPEAEVVDRPAGASGPGGRGRAARAARTRRRRRAVEAAAQTRHREGLGACCSFSHTHSPGSMATVGEWSCVRCTFLNPAGQRQCSICEAPRHKPDLNHILRLSVEEQKWPCARCTFRNFLGKEACEVCGFTPEPAPGAAFLPVLNGVLPKPPAILGEPKGSCQEEAGPVRTAGLVATEPARGQCEDKDEEEKEEQEEEEGAAEPRGGWACPRCTLHNTPVASSCSVCGGPRRLSLPRIPPEALVVPEVVAPAGFHVVPAAPPPGLPGEGAEANPPATSQGPAAEPEPPRVPPFSPFSSTLQNNPVPRSRREVPPQLQPPVPEAAQPSPSAGCRGAPQGSGWAGASRLAELLSGKRLSVLEEEATEGGTSRVEAGSSTSGSDIIDLAGDTVRYTPASPSSPDFTTWSCAKCTLRNPTVAPRCSACGCSKLHGFQEHGEPPTHCPDCGADKPSPCGRSCGRVSSAQKAARVLPERPGQWACPACTLLNALRAKHCAACHTPQLLVAQRRGAAPLRRRESMHVEQRRQTDEGEAKALWENIVAFCRENNVSFVDDSFPPGPESVGFPAGDSVQQRVRQWLRPQEINCSVFRDHRATWSVFHTLRPSDILQGLLGNCWFLSALAVLAERPDLVERVMVTRSLCAEGAYQVRLCKDGTWTTVLVDDMLPCDEAGCLLFSQAQRKQLWVALIEKALAKLHGSYFALQAGRAIEGLATLTGAPCESLALQLSSTNPREEPVDTDLIWAKMLSSKEAGFLMGASCGGGNMKVDDSAYESLGLRPRHAYSILDVRDVQGTRLLRLRNPWGRFSWNGSWSDEWPHWPGHLRGELMPHGSSEGVFWMEYGDFVRYFDSVDICKVHSDWQEARVQGCFPSSASAPVGVTALTVLERASLEFALFQEGSRRSDAVDSHLLDLCILVFRATFGSGGHLSLGRLLAHSKRAVKKFVSCDVMLEPGEYAVVCCAFNHWGPPLPGTPAPQASSPSAGVPRASPEPPGHVLAVYSSRLVMVEPVEAQPTTLADAIILLTPLWPPCTLSCEYF

SEQ ID NO: 836512 - protein, 1086 aa, Homo sapiens; identical to SEQ ID NO: 836508

SEQ ID NO: 836513 - protein, 429 aa, Homo sapiens
QRRVRPGRAVAAGPGPGATLRRQRKAGAGRGQGPGPEPGRGAPRLRSGRPSGQRGRRREGPRRSPEAEVVDRPAGASGPGGRGRAARAARTRRRRRAVEAAAQTRHREGLGACCSFSHTHSPGSMATVGEWSCVRCTFLNPAGQRQCSICEAPRHKPDLNHILRLSVEEQKWPCARCTFRNFLGKEACEVCGFTPEPAPGAAFLPVLNGVLPKPPAILGEPKGSCQEEAGPVRTAGLVATEPARGQCEDKDEEEKEEQEEEEGAAEPRGGWACPRCTLHNTPVASSCSVCGGPRRLSLPRIPPPHALYEGDPDRGRLSQNLRTPPRELPAQGSASHGPPAPLLPLPEPHSPPGQASWPPRRIPRTRRAVNQPRSPASPNTRRGPRPGCPSLWAQGLLRARQPGALSAKPNLGVRGQDPGVGSGTTPHGA

SEQ ID NO: 836514 - protein, 233 aa, Homo sapiens
IRAAGIRHEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEGPIDAAFTRINCQGKTYLFKGSQYWRFEDGVLDPDYPRNISDGFDGIPDNVDAALALPAHSYSGRERVYFFKGNSTGVPVSTAQSESVKQLLLLVDTLHEQRTVGGISAFLETLLTDSSIAA

SEQ ID NO: 836515 - protein, 503 aa, Homo sapiens
MAPLRPLLILALLAWVALADQESCKGRCTEGFNVDKKCQCDELCSYYQSCCTDYTAECKPQGVFRAQVGGLGCPLLLETHYHPLSAVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEKAVRPGYPKLIRDVWGIEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSAGTRQPQFISRDWHGVPGQVDAAMAGRIYISGMAPRPSLAKKQRFRHRNRKGYRSQRGHSRGRNQNSRRPSRAMWLSLFSSEESNLGANNYDDYRMDWLVPATCEPIQSVFFFSGDKYYRVNLRTRRVDTVDPPYPRSIAQYWLGCPAPGHL

SEQ ID NO: 836516 - protein, 544 aa, Homo sapiens
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEKAVRPGYPKLIRDVWGIEGPIDAAFTRINCQGKTYLFKGSQYWRFEDGVLDPDYPRNISDGFDGIPDNVDAALALPAHSYSGRERVYFFKGYSGGGGRLSRQWSSLGFLSHFTGDRPQHVPTPDPHLMLGDPNFNSLWDLQSCPGPALLMPTTRSSGKQYWEYQFQHQPSQEECEGSSLSAVFEHFAMMQRDSWEDIFELLFWGRTSAGTRQPQFISRDWHGVPGQVDAAMAGRIYISGMAPRPSLAKKQRFRHRNRKGYRSQRGHSRGRNQNSRRPSRAMWLSLFSSEESNLGANNYDDYRMDWLVPATCEPIQSVFFFSGDKYYRVNLRTRRVDTVDPPYPRSIAQYWLGCPAPGHL

SEQ ID NO: 836517 - protein, 478 aa, Homo sapiens
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEKAVRPGYPKLIRDVWGIEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSAGTRQPQFISRDWHGVPGQVDAAMAGRIYISGMAPRPSLAKKQRFRHRNRKGYRSQRGHSRGRNQNSRRPSRAMWLSLFSSEESNLGANNYDDYRMDWLVPATCEPIQSVFFFSGDKYYRVNLRTRRVDTVDPPYPRSIAQYWLGCPAPGHL

SEQ ID NO: 836518 - protein, 478 aa, Homo sapiens; identical to SEQ ID NO: 836517

SEQ ID NO: 836519 - protein, 460 aa, Homo sapiens
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSAGTRQPQFISRDWHGVPGQVDAAMAGRIYISGMAPRPSLAKKQRFRHRNRKGYRSQRGHSRGRNQNSRRPSRAMWLSLFSSEESNLGANNYDDYRMDWLVPATCEPIQSVFFFSGDKYYRVNLRTRRVDTVDPPYPRSIAQYWLGCPAPGHL

SEQ ID NO: 836520 - protein, 478 aa, Homo sapiens; identical to SEQ ID NO: 836517

SEQ ID NO: 836521 - protein, 552 aa, Homo sapiens
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGESRAGTGDAGLPQERPCSHTISSTLGQYCYELDEGPIDAAFTRINCQGKTYLFKGSQYWRFEDGVLDPDYPRNISDGFDGIPDNVDAALALPAHSYSGRERVYFFKGTQGVVGDWAGSGAVLDSFHISLGTGLSMCPPLTPTSCWEILTSTASGISSLALAQPSYCPPPRSSGKQYWEYQFQHQPSQEECEGSSLSAVFEHFAMMQRDSWEDIFELLFWGRTSAGTRQPQFISRDWHGVPGQVDAAMAGRIYISGMAPRPSLAKKQRFRHRNRKGYRSQRGHSRGRNQNSRRPSRAMWLSLFSSEESNLGANNYDDYRMDWLVPATCEPIQSVFFFSGDKYYRVNLRTRRVDTVDPPYPRSIAQYWLGCPAPGHL

SEQ ID NO: 836522 - protein, 449 aa, Homo sapiens
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEKAVRPGYPKLIRDVWGIEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSAGTRQPQFISRDWHGVPGQVDAAMAGRIYISGMAPRPSLAKKQRFRLSLFSSEESNLGANNYDDYRMDWLVPATCEPIQSVFFFSGDKYYRVNLRTRRVDTVDPPYPRSIAQYWLGCPAPGHL

SEQ ID NO: 836523 - protein, 109 aa, Homo sapiens
MSGASRAPSMPPSPASTVRGRPTSSRVVSTGALRMVSWTLITPEISLTASMASRTTWMQPWPSLPIATVAGSGSTSSRGNSTGSTSSSTSPVRRSVKAAPCRLCLNTLP

SEQ ID NO: 836524 - protein, 283 aa, Homo sapiens [sequence omitted]

SEQ ID NO: 836525 - protein, 69 aa, Homo sapiens
LLKEILSYDDYRMDWLVPATCEPIQSVFFFSGDKYYRVNLRTRRVDTVDPPYPRSIAQYWLGCPAPGHL

SEQ ID NO: 836526 - protein, 478 aa, Homo sapiens; identical to SEQ ID NO: 836517

SEQ ID NO: 836527 - protein, 329 aa, Homo sapiens
TFIQKLTPTKRNFNGPRPFTTERSFLPRQYCYELDEKAVRPGYPKLIRDVWGIEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSAGTRQPQFISRDWHGVPGQVDAAMAGRIYISGMAPRPSLAKKQRFRHRNRKGYRSQRGHSRGRNQNSRRPSRAMWLSLFSSEESNLGANNYDDYRMDWLVPATCEPIQSVFFFSGDKYYRVNLRTRRVDTVDPPYPRSIAQYWLGCPAPGHL

SEQ ID NO: 836528 - protein, 486 aa, Homo sapiens
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGESRAGTGDAGLPQERPCSHTISSTLGQYCYELDEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSAGTRQPQFISRDWHGVPGQVDAAMAGRIYISGMAPRPSLAKKQRFRHRNRKGYRSQRGHSRGRNQNSRRPSRAMWLSLFSSEESNLGANNYDDYRMDWLVPATCEPIQSVFFFSGDKYYRVNLRTRRVDTVDPPYPRSIAQYWLGCPAPGHL

SEQ ID NO: 836529 - protein, 385 aa, Homo sapiens
DPPGCRNSALAARAVLPEEEAPAPEVGASKPEGIDSRPETLHPGRPQPPAEEELCSGKPFDAFTDLKNGSLFAFRGESRAGTGDAGLPQERPCSHTISSTLGQYCYELDEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSAGTRQPQFISRDWHGVPGQVDAAMAGRIYISGMAPRPSLAKKQRFRHRNRKGYRSQRGHSRGRNQNSRRPSRAMWLSLFSSEESNLGANNYDDYRMDWLVPATCEPIQSVFFFSGDKYYRVNLRTRRVDTVDPPYPRSIAQYWLGCPAPGHL

SEQ ID NO: 836530 - protein, 458 aa, Homo sapiens
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEKAVRPGYPKLIRDVWGIEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSAGTRQPQFISRDWHARPSLAKKQRFRHRNRKGYRSQRGHSRGRNQNSRRPSRAMWLSLFSSEESNLGANNYDDYRMDWLVPATCEPIQSVFFFSGDKYYRVNLRTRRVDTVDPPYPRSIAQYWLGCPAPGHL

SEQ ID NO: 836531 - protein, 162 aa, Homo sapiens
MLGYNFSSFPAGTRQPQFISRDWHGVPGQVDAAMAGRIYISGMAPRPSLAKKQRFRHRNRKGYRSQRGHSRGRNQNSRRPSRAMWLSLFSSEESNLGANNYDDYRMDWLVPATCEPIQSVFFFSGDKYYRVNLRTRRVDTVDPPYPRSIAQYWLGCPAPGHL

SEQ ID NO: 836532 - protein, 283 aa, Homo sapiens [sequence omitted]

SEQ ID NO: 836533 - protein, 94 aa, Homo sapiens
MPEDEYTVYDDGEEKNNATVHEQVGGPSLTSDLQAQSKGNPEQTPVLKPEEEAPAPEVGASKPEGIDSRPETLHPGRPQPPAEEELCSGKPFDA

SEQ ID NO: 836534 - protein, 345 aa, Homo sapiens
MQRLVAWDPACLPLPPPPPAFKSMEVANFYYEADCLAAAYGGKAAPAAPPAARPGPRPPAGELGSIGDHERAIDFSPYLEPLGAPQAPAPATATDTFEAAPPAPAPAPASSGQHHDFLSDLFSDDYGGKNCKKPAEYGYVSLGRLGAAKGALHPGCFAPLHPPPPPPPPPAELKAEPGFEPADCKRKEEAGAPGGGAGMAAGFPYALRAYLGYQAVPSGSSGSLSTSSSSSPPGTPSPADAKAPPTACYAGAAPAPSQVKSKAKKTVDKHSDEYKIRRERNNIAVRKSRDKAKMRNLETQHKVLELTAENERLQKKVEQLSRELSTLRNLFKQLPEPLLASSGHC

SEQ ID NO: 836535 - protein, 345 aa, Homo sapiens; identical to SEQ ID NO: 836534

SEQ ID NO: 836536 - protein, 345 aa, Homo sapiens; identical to SEQ ID NO: 836534

SEQ ID NO: 836537 - protein, 345 aa, Homo sapiens; identical to SEQ ID NO: 836534

SEQ ID NO: 836538 - protein, 345 aa, Homo sapiens; identical to SEQ ID NO: 836534

SEQ ID NO: 836539 - protein, 345 aa, Homo sapiens; identical to SEQ ID NO: 836534

SEQ ID NO: 836540 - protein, 497 aa, Homo sapiens
RAAAGHVLRRLGEGRRGGVYSPGARGPHALTGSWQPESSSGRACSSPFAAVRRFLSPGRKMASVAVDPQPSVVTRVVNLPLVSSTYDLMSSAYLSTKDQYPYLKSVCEMAENGVKTITSVAMTSALPIIQKLEPQIAVANTYACKGLDRIEERLPILNQPSTQIVANAKGAVTGAKDAVTTTVTGAKDSVASTITGVMDKTKGAVTGSVEKTKSVVSGSINTVLGSRMMQLVSSGVENALTKSELLVEQYLPLTEEELEKEAKKVEGFDLVQKPSYYVRLGSLSTKLHSRAYQQALSRVKEAKQKSQQTISQLHSTVHLIEFARKNVYSANQKIQDAQDKLYLSWVEWKRSIGYDDTDESHCAEHIESRTLAIARNLTQQLQTTCHTLLSNIQGVPQNIQDQAKHMGVMAGDIYSVFRNAASFKEVSDSLLTSSKGQLQKMKESLDDVMDYLVNNTPLNWLVGPFYPQLTESQNAQDQGAEMDKSSQETQRSEHKTH

SEQ ID NO: 836541 - protein, 186 aa, Homo sapiens
RAAAGHVLRRLGEGRRGGVYSPGARGPHALTGSWQPESSSGRACSSPFAAVRRFLSPGRKMASVAVDPQPSVVTRVVNLPLVSSTYDLMSSAYLSTKDQYPYLKSVCEMAENGVKTITSVAMTSALPIIQKLEPQIAVANTYACKGLDRIEERLPILNQPSTQANTCFPNLDLDVCLKNNGHFLTS

SEQ ID NO: 836542 - protein, 138 aa, Homo sapiens
RAAAGHVLRRLGEGRRGGVYSPGARGPHALTGSWQPESSSGRACSSPFAAVRRFLSPGRKMASVAVDPQPSVVTRVVNLPLVSSTYDLMSSAYLSTKDQYPYLKSVCEMAENGVKTITSVAMTSALPIIQKLEPQSEF

SEQ ID NO: 836543 - protein, 103 aa, Homo sapiens
QYGMVLGQSNVYSANQKIQDAQDKLYLSWVEWKRSIGYDDTDESHCAEHIESRTLAIARNLTQQLQTTCHIRTGPHVSLTCWHCSGFREGRKYHATAPGVCLK

SEQ ID NO: 836544 - protein, 497 aa, Homo sapiens; identical to SEQ ID NO: 836540

SEQ ID NO: 836545 - protein, 512 aa, Homo sapiens
MAGVNSAEGECAPSGCPSEPVPGPQRRPVGVGGSPGPWDRCSAPRGAQRWTGRGGDGPRPPARLAASRFLSPGRKMASVAVDPQPSVVTRVVNLPLVSSTYDLMSSAYLSTKDQYPYLKSVCEMAENGVKTITSVAMTSALPIIQKLEPQIAVANTYACKGLDRIEERLPILNQPSTQIVANAKGAVTGAKDAVTTTVTGAKDSVASTITGVMDKTKGAVTGSVEKTKSVVSGSINTVLGSRMMQLVSSGVENALTKSELLVEQYLPLTEEELEKEAKKVEGFDLVQKPSYYVRLGSLSTKLHSRAYQQALSRVKEAKQKSQQTISQLHSTVHLIEFARKNVYSANQKIQDAQDKLYLSWVEWKRSIGYDDTDESHCAEHIESRTLAIARNLTQQLQTTCHTLLSNIQGVPQNIQDQAKHMGVMAGDIYSVFRNAASFKEVSDSLLTSSKGQLQKMKESLDDVMDYLVNNTPLNWLVGPFYPQLTESQNAQDQGAEMDKSSQETQRSEHKTH

SEQ ID NO: 836546 - protein, 437 aa, Homo sapiens
MASVAVDPQPSVVTRVVNLPLVSSTYDLMSSAYLSTKDQYPYLKSVCEMAENGVKTITSVAMTSALPIIQKLEPQIAVANTYACKGLDRIEERLPILNQPSTQIVANAKGAVTGAKDAVTTTVTGAKDSVASTITGVMDKTKGAVTGSVEKTKSVVSGSINTVLGSRMMQLVSSGVENALTKSELLVEQYLPLTEEELEKEAKKVEGFDLVQKPSYYVRLGSLSTKLHSRAYQQALSRVKEAKQKSQQTISQLHSTVHLIEFARKNVYSANQKIQDAQDKLYLSWVEWKRSIGYDDTDESHCAEHIESRTLAIARNLTQQLQTTCHTLLSNIQGVPQNIQDQAKHMGVMAGDIYSVFRNAASFKEVSDSLLTSSKGQLQKMKESLDDVMDYLVNNTPLNWLVGPFYPQLTESQNAQDQGAEMDKSSQETQRSEHKTH

SEQ ID NO: 836547 - protein, 505 aa, Homo sapiens
RAAAGHVLRRLGEGRRGGVYSPGARGPHALTGSWQPESSSGRACSSPFAAVRRFLSPGRKMASVAVDPQPSVVTRVVNLPLVSSTYDLMSSAYLSTKDQYPYLKSVCEMAENGVKTITSVAMTSALPIIQKLEPQIAVANTYACKGLDRIEERLPILNQPSTQIVANAKGAVTGAKDAVTTTVTGAKDSVASTITGVMDKTKGAVTGSVEKTKSVVSGSINTVLGSRMMQLVSSGVENALTKSELLVEQYLPLTEEELEKEAKKVEGFDLVQKPSYYVRLGSLSTKLHSRAYQQALSRVKEAKQKSQQTISQLHSTVHLIEFARKNVYSANQKIQDAQDKLYLSWVEWKRSIGYDDTDESHCAEHIESRTLAIARNLTQQLQTTCHTLLSNIQGVPQNIQDQAKHMGVMAGDIYSVFRNAASFKEVSDSLLTSSKGQLQKMKESLDDVMDYLVNNTPLNWLVFDFTTIDLTSETDEIPDIIALEEENGSNNSHANGPVLSGQDVE

SEQ ID NO: 836548 - protein, 170 aa, Homo sapiens
RAAAGHVLRRLGEGRRGGVYSPGARGPHALTGSWQPESSSGRACSSPFAAVRRFLSPGRKMASVAVDPQPSVVTRVVNLPLVSSTYDLMSSAYLSTKDQYPYLKSVCEMAENGVKTITSVAMTSALPIIQKLEPQIAVANTYACKGLDRIEERLPILNQPSTQVSLGQKC

SEQ ID NO: 836549 - protein, 131 aa, Homo sapiens
RAAAGHVLRRLGEGRRGGVYSPGARGPHALTGSWQPESSSGRACSSPFAAVRRFLSPGRKMASVAVDPQPSVVTRVVNLPLVSSTYDLMSSAYLSTKDQYPYLKSVCEMAENGVKTITSVAMTSALPIISV

SEQ ID NO: 836550 - protein, 497 aa, Homo sapiens; identical to SEQ ID NO: 836540

SEQ ID NO: 836551 - protein, 497 aa, Homo sapiens; identical to SEQ ID NO: 836540

SEQ ID NO: 836552 - protein, 497 aa, Homo sapiens; identical to SEQ ID NO: 836540

SEQ ID NO: 836553 - protein, 581 aa, Homo sapiens
RAAAGHVLRRLGEGRRGGVYSPGARGPHALTGSWQPESSSGRACSSPFAAVRRFLSPGRKMASVAVDPQPSVVTRVVNLPLVSSTYDLMSSAYLSTKDQYPYLKSVCEMAENGVKTITSVAMTSALPIIQKLEPQIAVANTYACKGLDRIEERLPILNQPSTQIVANAKGAVTGAKDAVTTTVTGAKDSVASTITGVMDKTKGAVTGSVEKTKSVVSGSINTVLGSRMMQLVSSGVENALTKSELLVEQYLPLTEEELEKEAKKVEGFDLVQKPSYYVRLGSLSTKLHSRAYQQALSRVKEAKQKSQQTISQHSGTHQDHHSPTASMEHTQYRNEELTDKTPSDHTAPPPTPREQPHNDNRRKNKKNTVQPQRQKATTHRTDRRVNKEATSKRSNAGRAQHKPDDAAVAAHPASDTSTRTRILPTATTRNRGRTSRRKPPKHQRRADKGRRTTPQHATTQWLKHRHGGPVERNWKPQSADDRETNTRRDTRSEARQHSSAPKDELDNSDHTHRAAESTEPDDKTEREVHTEAGRYHEQQDTERNASSTRAGRADPTQQSRQTGREAKPHAPTKPSRHNDHT

SEQ ID NO: 836554 - protein, 125 aa, Homo sapiens
GAFYHKRNMCVSACLGEKPRDAPLSGNTRQHVRSTIIRPAGAQILGVDRRLHPGLAVHLPADVDHQAGVRRGRPFHRPTANASRHTPPPARDFSGRRIFSMGGRLSSSHPAVTFFVTTSVAAIVN

SEQ ID NO: 836555 - protein, 188 aa, Homo sapiens
MTWRRSGTTPSTTSFAWAPEEHPTLLTEAPLNPKANREKMTQIMFETFNVPAMYVAIQAVLSLYASGRTTGIVLDSGDGVTHNVPIYEGYALPHAIMRLDFENEMATAASSSSLEKSYELPDGQVITIGNERFRCPETLFQPSFIGMESAGIHETTYNSIMKCDIDIRKDLYANNVMSGGTTMYPGNR

SEQ ID NO: 836556 - protein, 135 aa, Homo sapiens
MRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVMSGGTTMYPGNR

SEQ ID NO: 836557 - protein, 132 aa, Homo sapiens
MTWRRSGTTPSTTSFAWAPEEHPTLLTEAPLNPKANREKMTQIMFETFNVPAMYVAIQAVLSLYASGRTTGIVLDSGDGVTHNVPIYEGCMESAGIHETTYNSIMKCDIDIRKDLYANNVMSGGTTMYPGNR

SEQ ID NO: 836558 - protein, 160 aa, Homo sapiens
MTWRRSGTTPSTTSFAWAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSPGNR

SEQ ID NO: 836559 - protein, 231 aa, Homo sapiens
MTWRRSGTTPSTTSFAWAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVMSGGTTMYPGNR

SEQ ID NO: 836560 - protein, 231 aa, Homo sapiens; identical to SEQ ID NO: 836559

SEQ ID NO: 836561 - protein, 231 aa, Homo sapiens; identical to SEQ ID NO: 836559

SEQ ID NO: 836562 - protein, 198 aa, Homo sapiens
MTWRRSGTTPSTTSFAWAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGEPRSPSPRP

SEQ ID NO: 836563 - protein, 165 aa, Homo sapiens
MTWRRSGTTPSTTSFAWAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDYMAAIYSMQVQTALILLPRDAS

SEQ ID NO: 836564 - protein, 231 aa, Homo sapiens; identical to SEQ ID NO: 836559

SEQ ID NO: 836565 - protein, 127 aa, Homo sapiens
PGPEPARREDPGALCCGREPIRHPGTGLTSCCTTTLTLRGGHQEKFPVRIRRLHPGLAVHLPADVDHQAGVRRGRPFHRPTANASRHTPPPARDFSGRRIFSMGGRLSSSHPAVTFFVTTSVAAIVN

SEQ ID NO: 836566 - protein, 81 aa, Homo sapiens
PRASAHAPRRGPQVLPADVDHQAGVRRGRPFHRPTANASRHTPPPARDFSGRRIFSMGGRLSSSHPAVTFFVTTSVAAIVN

SEQ ID NO: 836567 - protein, 207 aa, Homo sapiens
VGPTTGRLPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVMSGGTTMYPGNR

SEQ ID NO: 836568 - protein, 164 aa, Homo sapiens
HRGEAYTDHFSTQKKHRHYPPACNYSNSLHRLCPVRPNIILRGHSNYKLTIRHLEFGTEREIVRDIKEKLCYVALDFENEMATAASSSSLEKSYELPDGQVITIGNERFRCPETLFQPSFIGMESAGIHETTYNSIMKCDIDIRKDLYANNVMSGGTTMYPGNR

SEQ ID NO: 836569 - protein, 231 aa, Homo sapiens; identical to SEQ ID NO: 836559

SEQ ID NO: 836570 - protein, 231 aa, Homo sapiens; identical to SEQ ID NO: 836559

SEQ ID NO: 836571 - protein, 234 aa, Homo sapiens
MTWRRSGTTPSTTSFAWAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVMSGGTTMYPGISACS

SEQ ID NO: 836572 - protein, 574 aa, Homo sapiens
MASDLESSLTSIDWLPQLTLRATIEKLGSASQAGPPGSSRKCSPGSPTDPNATLSKDEAAVHQDGKPRYSYATLITYAINSSPAKKMTLSEIYRWICDNFPYYKNAGIGWKNSIRHNLSLNKCFRKVPRPRDDPGKGSYWTIDTCPDISRKRRHPPDDDLSQDSPEQEASKSPRGGVAGSGEASLPPEGNPQMSLQSPTSIASYSQGTGSVDGGAVAAGASGRESAEGPPPLYNTNHDFKFSYSEINFQDLSWSFRNLYKSMLEKSSSSSQHGFSSLLGDIPPSNNYYMYQQQQPPPPQQQQQQQQPPQPPPQQSQPQQQQAPAQGPSAVGGAPPLHTPSTDGCTPPGGKQAGAEGYGPPPVMAMHPPPLQHGGYHPHQHHPHSHPAQQPPPPQPQAQGQAPINNTGFAFPSDWCSNIDSLKESFKMVNRLNWSSIEQSQFSELMESLRQAEQKNWTLDQHHIANLCDSLNHFLTQTGHVPPQGGTHRPPAPARIADSCALTSGKQESAMSQVNSYGHPQAPHLYPGPSPMYPIPTQDSAGYNRPAHHMVPRPSVPPPGANEEIPDDFDWDLIT

SEQ ID NO: 836573 - protein, 526 aa, Homo sapiens
MASDLESSLTSIDWLPQLTLRATIEKLGSASQAGPPGSSRKCSPGSPTDPNATLSKDEAAVHQDGKPRYSYATLITYAINSSPAKKMTLSEIYRWICDNFPYYKNAGIGWKNSIRHNLSLNKCFRKVPRPRDDPGKGSYWTIDTCPDISRKRRHPPDDDLSQDSPEQEASKSPRGGVAGSGEASLPPEGNPQMSLQSPTSIASYSQGTGSVDGGAVAAGASGRESAEGPPPLYNTNHDFKFSYSEINFQDLSWSFRNLYKSMLEKSSSSSQHGFSSLLGDIPPSNNYYMYQQQQPPPPQQQQQQQQPPQPPPQQSQPQQQQAPAQGPSAVGGAPPLHTPSTDGCTPPGGKQAGAEGYGPPPVMAMHPPPLQHGGYHPHQHHPHSHPAQQPPPPQPQAQGQAPINNTGFAFPSDWCSNIDSLKESFKMVNRLNWSSIEQSQFSELMESLRQAEQKNWTLDQHHIANLCDSLNHFLTQTGHVPPQGGTHRPPAPARIADSCALTSGKQESAMSQGTAPSQLPWRWRLC

SEQ ID NO: 836574 - protein, 74 aa, Homo sapiens
APPSGAPRERRRERGREQPLPLLERKDPYHSGEGKKRPLEGTPLSCLEARKTPVLAGEETPRSGKKGAFRREAE

SEQ ID NO: 836575 - protein, 562 aa, Homo sapiens
MASDLESSLTSIDWLPQLTLRATIEKLGSASQAGPPGSSRKCSPGSPTDPNATLSKDEAAVHQDGKPRYSYATLITYAINSSPAKKMTLSEIYRWICDNFPYYKNAGIGWKNSIRHNLSLNKCFRKVPRPRDDPGKGSYWTIDTCPDISRKRRHPPDDDLSQDSPEQEASKSPRGGVAGSGEASLPPEGNPQMSLQSPTSIASYSQGTGSVDGGAVAAGASGRESAEGPPPLYNTNHDFKFSYSEINFQDLSWSFRNLYKSMLEKSSSSSQHGFSSLLGDIPPSNNYYMYHSSSRHSHLPSSPSHSSSRHLPRAPQLYGGAPPLHTPSTDGCTPPGGKQAGAEGYGPPPVMAMHPPPLQHGGYHPHQHHPHSHPAQQPPPPQPQAQGQAPINNTGFAFPSDWCSNIDSLKESFKMVNRLNWSSIEQSQFSELMESLRQAEQKNWTLDQHHIANLCDSLNHFLTQTGHVPPQGGTHRPPAPARIADSCALTSGKQESAMSQVNSYGHPQAPHLYPGPSPMYPIPTQDSAGYNRPAHHMVPRPSVPPPGANEEIPDDFDWDLIT

SEQ ID NO: 836576 - protein, 142 aa, Homo sapiens
MFEARLVQGSILKKVLEALKDLINEACWDISSSGVNLQSMDSSHVSLVQLTLRSEGFDTYRCDRNLAMGVNLTSMSKILKCAGNEDIITLRAEDNADTLALVFEAPNQEKVSDYEMKLMDLDVEQLWNSRTGVQLCSKDAFW

SEQ ID NO: 836577 - protein, 142 aa, Homo sapiens; identical to SEQ ID NO: 836576

SEQ ID NO: 836578 - protein, 142 aa, Homo sapiens; identical to SEQ ID NO: 836576

SEQ ID NO: 836579 - protein, 142 aa, Homo sapiens; identical to SEQ ID NO: 836576

SEQ ID NO: 836580 - protein, 142 aa, Homo sapiens; identical to SEQ ID NO: 836576

SEQ ID NO: 836581 - protein, 142 aa, Homo sapiens; identical to SEQ ID NO: 836576

SEQ ID NO: 836582 - protein, 124 aa, Homo sapiens
MFEARLVQGSILKKVLEALKDLINEACWDISSSGVNLQSMDSSHVSLVQLTLRSEGFDTYRCDRNLAMGVNLTSMSKILTLALVFEAPNQEKVSDYEMKLMDLDVEQLWNSRTGVQLCSKDAFW

SEQ ID NO: 836583 - protein, 124 aa, Homo sapiens; identical to SEQ ID NO: 836582

SEQ ID NO: 836584 - protein, 142 aa, Homo sapiens; identical to SEQ ID NO: 836576

SEQ ID NO: 836585 - protein, 142 aa, Homo sapiens; identical to SEQ ID NO: 836576

SEQ ID NO: 836586 - protein, 142 aa, Homo sapiens; identical to SEQ ID NO: 836576

SEQ ID NO: 836587 - protein, 142 aa, Homo sapiens; identical to SEQ ID NO: 836576

SEQ ID NO: 836588 - protein, 94 aa, Homo sapiens
MSKILKCAGNEDIITLRAEDNADTLALVFEAPNQEKVSDYEMKLMDLDVEQLWNSRTGVQLCRYRRVTFKSALFYIYRGGDSICFRVNLCNAKF

SEQ ID NO: 836589 - protein, 86 aa, Homo sapiens
TAPASQCPQRADPDRCRNDAVDEGHRDLSGSGSWANVWVHGMPLATAEAVPQPQVYALNFILRTAPVSHRPQLIETVVAPFCRRGN

SEQ ID NO: 836590 - protein, 612 aa, Homo sapiens
QALPVATSREAAVLPPPAPDHLLQDQPPGGTRHPAFTGTQGAVLSSVNMSRPSSRAIYLHRKEYSQNLTSEPTLLQHRVEHLMTCKQGSQRVQGPEDALQKLFEMDAQGRVWSQDLILQVRDGWLQLLDIETKEELDSYRLDSIQAMNVALNTCSYNSILSITVQEPGLPGTSTLLFQCQEVGAERLKTSLQKALEEELEQSRPRLGGLQPGQDRWRGPAMERPLPMEQARYLEPGIPPEQPHQRTLEHSLPPSPRPLPRHTSAREPSAFTLPPPRRSSSPEDPERDEEVLNHVLRDIELFMGKLEKAQAKTSRKKKFGKKNKDQGGLTQAQYIDCFQKIKYSFNLLGRLATWLKETSAPELVHILFKSLNFILARCPEAGLAAQVISPLLTPKAINLLQSCLSPPESNLWMGLGPAWTTSRADWTGDEPLPYQPTFSDDWQLPEPSSQAPLGYQDPVSLRPSSPKPAQPALKMQVLYEFEARNPRELTVVQGEKLEVLDHSKRWWLVKNEAGRSGYIPSNILEPLQPGTPGTQGQSPSRVPMLRLSSRPEEVTDWLQAENFSTATVRTLGSLTGSQLLRIRPGELQMLCPQEAPRILSRLEAVRRMLGISP

SEQ ID NO: 836591 - protein, 148 aa, Homo sapiens
QALPVATSREAAVLPPPAPDHLLQDQPPGGTRHPAFTGTQGAVLSSVNMSRPSSRAIYLHRKEYSQNLTSEPTLLQHRVEVSTSAAPGQCPTKPKCSHVPTALPEHGHFTQVPAPEANSLSQPCRMDSDPTSLPEHLLSVRDGEGWSD

SEQ ID NO: 836592 - protein, 580 aa, Homo sapiens
QALPVATSREAAVLPPPAPDHLLQDQPPGGTRHPAFTGTQGAVLSSVNMSRPSSRAIYLHRKEYSQNLTSEPTLLQHRVEHLMTCKQGSQRVQGPEDALQKLFEMDAQGRVWSQDLILQVRDGWLQLLDIETKEELDSYRLDSIQAMNVALNTCSYNSILSITVQEPGLPGTSTLLFQCQEVGAERLKTSLQKALEEELEQSRPRLGGLQPGQDRWRGPAMERPLPMEQARYLEPGIPPEQPHQRTLEHSLPPSPRPLPRHTSAREPSAFTLPPPRRSSSPEDPERDEEVLNHVLRDIELFMGKLEKAQAKTSRKKKFGKKNKDQGGLTQAQYIDCFQKIKYSFNLLGRLATWLKETSAPELVHILFKSLNFILARCPEAGLAAQVISPLLTPKAINLLQSCLSPPESNLWMGLGPAWTTSRADWTGDEPLPYQPTFSDDWQLPEPSSQAPLGYQDPVSLRRGSHRLGSTSHFPQEKTHNHDPQPGDPNSRPSSPKPAQPALKMQVLYEFEARNPRELTVVQGEKLEVLDHSKRWWLVKNEAGRSGYIPSNILEPLQPGTPGTQGQSPSRVLPSLDYPEP

SEQ ID NO: 836593 - protein, 520 aa, Homo sapiens
QALPVATSREAAVLPPPAPDHLLQDQPPGGTRHPAFTGTQGAVLSSVNMSRPSSRAIYLHRKEYSQNLTSEPTLLQHRVEHLMTCKQGSQRVQGPEDALQKLFEMDAQGRVWSQDLILQVRDGWLQLLDIETKEELDSYRLDSIQAMNVALNTCSYNSILSITVQEPGLPGTSTLLFQCQEVGAERLKTSLQKALEEELEQSRPRLGGLQPGQDRWRGPAMERPLPMEQARYLEPGIPPEQPHQRTLEHSLPPSPRPLPRHTSAREPSAFTLPPPRRSSSPEDPERDEEVLNHVLRDIELFMGKLEKAQAKTSRKKKFGKKNKDQGGLTQAQYIDCFQKIKYSFNLLGRLATWLKETSAPELVHILFKSLNFILARCPEAGLAAQVISPLLTPKAINLLQSCLSPPESNLWMGLGPAWTTSRADWTGDEPLPYQPTFSDDWQLPEPSSQAPLGYQDPVSLRYALSLIGTAWSWGGRDRTVVLWISGSLHLKRAKRVSFSQKNMYKDIPLLPWVKNSVLPS

SEQ ID NO: 836594 - protein, 545 aa, Homo sapiens
QALPVATSREAAVLPPPAPDHLLQDQPPGGTRHPAFTGTQGAVLSSVNMSRPSSRAIYLHRKEYSQNLTSEPTLLQHRVEHLMTCKQGSQRVQGPEDALQKLFEMDAQGRVWSQDLILQVRDGWLQLLDIETKEELDSYRLDSIQAMNVALNTCSYNSILSITVQEPGLPGTSTLLFQCQEVGAERLKTSLQKALEEELEQSRPRLGGLQPGQDRWRGPAMERPLPMEQARYLEPGIPPEQPHQRTLEHSLPPSPRPLPRHTSAREPSAFTLPPPRRSSSPEDPERDEEVLNHVLRDIELFMGKLEKAQAKTSRKKKFGKKNKDQGGLTQAQYIDCFQKIKYSFNLLGRLATWLKETSAPELVHILFKSLNFILARCPEAGLAAQVISPLLTPKAINLLQSCLSPPESNLWMGLGPAWTTSRADWTGDEPLPYQPTFSDDWQLPEPSSQAPLGYQDPVSLRRGSHRLGSTSHFPQEKTHNHDPQPGDPNSRPSSPKPAQPALKMQVLYEFEARNPRELETAQTSDDDVERDRCRDRCNQKGSARA

SEQ ID NO: 836595 - protein, 168 aa, Homo sapiens
AAKGGWSRDGAAKVGGLEREKEGRKELEGESLVWGGKAGWKEAQGTEVVTLGKVLDHSKRWWLVKNEAGRSGYIPSNILEPLQPGTPGTQGQSPSRVPMLRLSSRPEEVTDWLQAENFSTATVRTLGSLTGSQLLRIRPGELQMLCPQEAPRILSRLEAVRRMLGISP

SEQ ID NO: 836596 - protein, 642 aa, Homo sapiens
QALPVATSREAAVLPPPAPDHLLQDQPPGGTRHPAFTGTQGAVLSSVNMSRPSSRAIYLHRKEYSQNLTSEPTLLQHRVEHLMTCKQGSQRVQGPEDALQKLFEMDAQGRVWSQDLILQVRDGWLQLLDIETKEELDSYRLDSIQAMNVALNTCSYNSILSITVQEPGLPGTSTLLFQCQEVGAERLKTSLQKALEEELEQSRPRLGGLQPGQDRWRGPAMERPLPMEQARYLEPGIPPEQPHQRTLEHSLPPSPRPLPRHTSAREPSAFTLPPPRRSSSPEDPERDEEVLNHVLRDIELFMGKLEKAQAKTSRKKKFGKKNKDQGGLTQAQYIDCFQKIKYSFNLLGRLATWLKETSAPELVHILFKSLNFILARCPEAGLAAQVISPLLTPKAINLLQSCLSPPESNLWMGLGPAWTTSRADWTGDEPLPYQPTFSDDWQLPEPSSQAPLGYQDPVSLRRGSHRLGSTSHFPQEKTHNHDPQPGDPNSRPSSPKPAQPALKMQVLYEFEARNPRELTVVQGEKLEVLDHSKRWWLVKNEAGRSGYIPSNILEPLQPGTPGTQGQSPSRVPMLRLSSRPEEVTDWLQAENFSTATVRTLGSLTGSQLLRIRPGELQMLCPQEAPRILSRLEAVRRMLGISP

SEQ ID NO: 836597 - protein, 67 aa, Homo sapiens
SSGPSTLSQAPLGYQDPVSLRPSSPKPAQPALKMQVLYEFEARNPRELTVVQGEKLEVLDHSNALLV

SEQ ID NO: 836598 - protein, 613 aa, Homo sapiens
GGVECPEALNGPEALNGPEALNGPEALNGPEALNGPPPAAPQTQTWRPYPWPQCFDTVPHIGPGKLLYLKPGTSYLKGAEDTSSSSSAFLYPARLWSTSLSFLPVLGLPLSLQHLMTCKQGSQRVQGPEDALQKLFEMDAQGRVWSQDLILQVRDGWLQLLDIETKEELDSYRLDSIQAMNVALNTCSYNSILSITVQEPGLPGTSTLLFQCQEVGAERLKTSLQKALEEELEQSRPRLGGLQPGQDRWRGPAMERPLPMEQARYLEPGIPPEQPHQRTLEHSLPPSPRPLPRHTSAREPSAFTLPPPRRSSSPEDPERDEEVLNHVLRDIELFMGKLEKAQAKTSRKKKFGKKNKDQGGLTQAQYIDCFQKIKYSFNLLGRLATWLKETSAPELVHILFKSLNFILARCPEAGLAAQVISPLLTPKAINLLQSCLSPPESNLWMGLGPAWTTSRADWTGDEPLPYQPTFSDDWQLPEPSSQAPLGYQDPVSLRRGSHRLGSTSHFPQEKTHNHDPQPGDPNSRPSSPKPAQPALKMQVLYEFEARNPRELTVVQGEKLEVLDHSKRWWLVKNEAGRSGYIPSNILEPLQPGTPGTQGQSPSRVLPSLDYPEP

SEQ ID NO: 836599 - protein, 125 aa, Homo sapiens
QWTFYAQPSTLRIPGPCFPSEKTHNHDPQPGDPNSRPSSPKPAQPALKMQVLYEFEARNPRELTVVQGEKLEVLDHSKRWWLVKNEAGRSGYIPSNILEPLQPGTPGTQGQSPSRVLPSLDYPEP

SEQ ID NO: 836600 - protein, 110 aa, Homo sapiens
SSGPSTLSQAPLGYQDPVSLRPSSPKPAQPALKMQVLYEFEARNPRELTVVQGEKLEVLDHSKRWWLVKNEAGRSGYIPSNILEPLQPGTPGTQGQSPSRVLPSLDYPEP

SEQ ID NO: 836601 - protein, 105 aa, Homo sapiens
MCTASPYTMCCCACSCDDIRQEKQRLLKSCPKTVQKPQPPVAFSPPPLGAADQSKLTDRRRNVQMFMVSSVWKRSSGNFGQDFSVGNASKYKARAIFKKDLLNLY

SEQ ID NO: 836602 - protein, 285 aa, Homo sapiens
MAGLGHPAAFGRATHAVVRALPESLGQHALRSAKGEEVDVARAERQHQLYVGVLGSKLGLQVVELPADESLPDCVFVEDVAVVCEETALITRPGAPSRRKEVDMMKEALEKLQLNIVEMKDENATLDGGDVLFTGREFFVGLSKRTNQRGAEILADTFKDYAVSTVPVADGLHLKSFCSMAGPNLIAIGSSESAQKALKIMQQMSDHRYDKLTVPDDIAANCIYLNIPNKGHVLLHRTPEEYPESAKVYEKLKDHMLIPVSMSELEKVDGLLTCCSVLINKKVDS

SEQ ID NO: 836603 - protein, 285 aa, Homo sapiens; identical to SEQ ID NO: 836602

SEQ ID NO: 836604 - protein, 285 aa, Homo sapiens; identical to SEQ ID NO: 836602

SEQ ID NO: 836605 - protein, 285 aa, Homo sapiens; identical to SEQ ID NO: 836602

SEQ ID NO: 836606 - protein, 190 aa, Homo sapiens
MCKCLWVDMMKEALEKLQLNIVEMKDENATLDGGDVLFTGREFFVGLSKRTNQRGAEILADTFKDYAVSTVPVADGLHLKSFCSMAGPNLIAIGSSESAQKALKIMQQMSDHRYDKLTVPDDIAANCIYLNIPNKGHVLLHRTPEEYPESAKVYEKLKDHMLIPVSMSELEKVDGLLTCCSVLINKKVDS

SEQ ID NO: 836607 - protein, 105 aa, Homo sapiens; identical to SEQ ID NO: 836601

SEQ ID NO: 836608 - protein, 108 aa, Homo sapiens
MSLTSSSSVRVEWIAAVTIAAGTAAIGYLAYKRFYVKDHRNKAMINLHIQKDNPKIVHAFDMEDLGDKAVYCRCWRSKKFPFCDGAHTKHNEETGDNVGPLIIKKKET

SEQ ID NO: 836609 - protein, 108 aa, Homo sapiens; identical to SEQ ID NO: 836608

SEQ ID NO: 836610 - protein, 103 aa, Homo sapiens
MINLHIQKDNPKIVHAFDMEDLGDKAVYCRCWRSKKHNGETQKKKKKKKNLCGRALGPRKKFLKPFALGAPGPPRVGNTGPKGVPKEKTGAGTRGGVSPQKKS

SEQ ID NO: 836611 - protein, 108 aa, Homo sapiens; identical to SEQ ID NO: 836608

SEQ ID NO: 836612 - protein, 140 aa, Homo sapiens
MSLTSSSSVRAHSMLGIDNSPLRLRLTRLCRTFFSPTLPGAGLNGSQQLPCAAGTAAIGYLAYKRFYVKDHRNKAMINLHIQKDNPKIVHAFDMEDLGDKAVYCRCWRSKKFPFCDGAHTKHNEETGDNVGPLIIKKKET

SEQ ID NO: 836613 - protein, 108 aa, Homo sapiens; identical to SEQ ID NO: 836608

SEQ ID NO: 836614 - protein, 108 aa, Homo sapiens; identical to SEQ ID NO: 836608

SEQ ID NO: 836615 - protein, 108 aa, Homo sapiens; identical to SEQ ID NO: 836608

SEQ ID NO: 836616 - protein, 914 aa, Homo sapiens [sequence omitted]

SEQ ID NO: 836617 - protein, 699 aa, Homo sapiens
SLWISAEFGLLFMPTTSEKASIMFARHVDSIVEFCTEQNHNKEAPNKQNQKCNLRSTWEVIRDSEDFKKTTPMTTQPPNPTFSLLQIGQRIVCLVLDKSGSMATGNRLNRLNQAGQLFLLQTVELGSWVGMVTFDSAAHVQSELIQINSGSDRDTLAKRLPAAASGGTSICSGLRSAFTVIRKKYPTDGSEIVLLTDGEDNTISGCFNEVKQSGAIIHTVALGPSAAQELEELSKMTGGLQTYASDQVQNNGLIDAFGALSSGNGAVSQRSIQLESKGLTLQNSQWMNGTVIVDSTVGKDTLFLITWTTQPPQILLWDPSGQKQGGFVVDKNTKMAYLQIPGIAKVGTWKYSLQASSQTLTLTVTSRASNATLPPITVTSKTNKDTSKFPSPLVVYANIRQGASPILRASVTALIESVNGKTVTLELLDNGAGADATKDDGVYSRYFTTYDTNGRYSVKVRALGGVNAARRRVIPQQSGALYIPGWIENDEIQWNPPRPEINKDDVQHKQVCFSRTSSGGSFVASDVPNAPIPDLFPPGQITDLKAEIHGGSLINLTWTAPGDDYDHGTAHKYIIRISTSILDLRDKFNESLQVNTTALIPKEANSEEVFLFKPENITFENGTDLFIAIQAVDKVDLKSEISNIARVSLFIPPQTPPETPSPDETSAPCPNIHINSTIPGIHILKIMWKWIGELQLSIA

SEQ ID NO: 836618 - protein, 513 aa, Homo sapiens
MAWWLMPLIPALWEAEQSGCFNEVKQSGAIIHTVALGPSAAQELEELSKMTGGLQTYASDQVQNNGLIDAFGALSSGNGAVSQRSIQLESKGLTLQNSQWMNGTVIVDSTVGKDTLFLITWTTQPPQILLWDPSGQKQGGFVVDKNTKMAYLQIPGIAKVGTWKYSLQASSQTLTLTVTSRASNATLPPITVTSKTNKDTSKFPSPLVVYANIRQGASPILRASVTALIESVNGKTVTLELLDNGAGADATKDDGVYSRYFTTYDTNGRYSVKVRALGGVNAARRRVIPQQSGALYIPGWIENDEIQWNPPRPEINKDDVQHKQVCFSRTSSGGSFVASDVPNAPIPDLFPPGQITDLKAEIHGGSLINLTWTAPGDDYDHGTAHKYIIRISTSILDLRDKFNESLQVNTTALIPKEANSEEVFLFKPENITFENGTDLFIAIQAVDKVDLKSEISNIARVSLFIPPQTPPETPSPDETSAPCPNIHINSTIPGIHILKIMWKWIGELQLSIA

SEQ ID NO: 836619 - protein, 407 aa, Homo sapiens
MGPFKSSVFILILHLLEGALSNSLIQLNNNGYEGIVVAIDPNVPEDETLIQQIKDMVTQASLYLFEATGKRFYFKNVAILIPETWKTKADYVRPKLETYKNADVLVAESTPPGNDEPYTEQMGNCGEKGERIHLTPDFIAGKKLAEYGPQGRAFVHEWAHLRWGVFDEYNNDEKFYLSNGRIQAVRCSAGITGTNVVKKCQGGSCYTKRCTFNKVTGLYEKGCEFVLQSRQTEKASIMFAQHVDSIVEFCTEQNHNKEAPNKQNQKCNLRSTWEVIRDSEDFKKTTPMTTQPPNPTFSLLQIGQRIVCLVLDKSGSMATGNRLNRLNQAGQLFLLQTVELGSWVGMVTFDSAAHVQSELIQINSGSDRDTLAKRLPAAASGGTSICSGLRSAFTVIRKKYPKLGHSA

SEQ ID NO: 836620 - protein, 914 aa, Homo sapiens [sequence omitted]

SEQ ID NO: 836621 - protein, 547 aa, Homo sapiens
DGSESRYLWSYAVSRGSLVRDLIVHLIVIRKKYPTDGSEIVLLTDGEDNTISGCFNEVKQSGAIIHTVALGPSAAQELEELSKMTGGLQTYASDQVQNNGLIDAFGALSSGNGAVSQRSIQLESKGLTLQNSQWMNGTVIVDSTVGKDTLFLITWTTQPPQILLWDPSGQKQGGFVVDKNTKMAYLQIPGIAKVGTWKYSLQASSQTLTLTVTSRASNATLPPITVTSKTNKDTSKFPSPLVVYANIRQGASPILRASVTALIESVNGKTVTLELLDNGAGADATKDDGVYSRYFTTYDTNGRYSVKVRALGGVNAARRRVIPQQSGALYIPGWIENDEIQWNPPRPEINKDDVQHKQVCFSRTSSGGSFVASDVPNAPIPDLFPPGQITDLKAEIHGGSLINLTWTAPGDDYDHGTAHKYIIRISTSILDLRDKFNESLQVNTTALIPKEANSEEVFLFKPENITFENGTDLFIAIQAVDKVDLKSEISNIARVSLFIPPQTPPETPSPDETSAPCPNIHINSTIPGIHILKIMWKWIGELQLSIA

SEQ ID NO: 836622 - protein, 586 aa, Homo sapiens
RTHQEVHRRPACSSLPAAPGSISQRLRGPGSWCVCSAGGSWKTLSLPAEAMSDYENDDECWNVLEGFRVTLTSVIDPSRITPYLRQCKVLNPDDEEQVLSDPNLVIRKRKVGVLLDILQRTGHKGYVAFLESLELYYPQLYKKVTGKEPARVFSMIIDASGESGLTQLLMTEVMKLQKKVQDLTALLSSKDDFIKELRVKDSLLRKHQERVQRLKEECEAGSRELKRCKEENYDLAMRLAHQSEEKGAALMRNRDLQLEIDQLKHSLMKAEDDCKVERKHTLKLRHAMEQRPSQELLWELQQEKALLQARVQELEASVQEGKLDRSSPYIQVLEEDWRQALRDHQEQANTIFSLRKDLRQGEARRLRCMEEKEMFELQCLALRKDSKMYKDRIEAILLQMEEVAIERDQAIATREELHAQHARGLQEKDALRKQVRELGEKADELQLQVFQCEAQLLAVEGRLRRQQLETLVLSSDLEDGSPRRSQELSLPQDLEDTQLSDKGCLAGGGSPKQPFAALHQEQVLRNPHDAGLSSGEPPEKERRRLKESFENYRRKRALRKMQKGWRQGEEDRENTTGSDNTDTEGS

SEQ ID NO: 836623 - protein, 586 aa, Homo sapiens; identical to SEQ ID NO: 836622

SEQ ID NO: 836624 - protein, 91 aa, Homo sapiens
AHEQFRVPAGSGAAGPGWVLGLAIRQPSRLFWAWRGPGVAEGMPRAPWRIPLCALPTLCLGSPLPSQPTHPIFYDHRAPTWKMAHPGGPRR

SEQ ID NO: 836625 - protein, 127 aa, Homo sapiens
GRGGAGAGRTEPASGMLRTALRGAPRLLSRVQPRAPCLRRLWGRGARPEVAGRRRAWAWGWRRSSSEQGPGPAAALGRVEAAHYQLVYTCKVGARRDGTGDRPVSDATRPAGRSGPPGIREAAWSSH

SEQ ID NO: 836626 - protein, 636 aa, Homo sapiens
RTHQEVHRRPACSSLPAAPGSISQRLRGPGSWCVCSAGGSWKTLSLPAEAMSDYENDDECWNVLEGFRVTLTSVIDPSRITPYLRQCKVLNPDDEEQVLSDPNLVIRKRKVGVLLDILQRTGHKGYVAFLESLELYYPQLYKKVTGKEPARVFSMIIDASGESGLTQLLMTEVMKLQKKVQDLTALLSSKDDFIKELRVKDSLLRKHQERVQRLKEECEAGSRELKRCKEENYDLAMRLAHQSEEKGAALMRNRDLQLEIDQLKHSLMKAEDDCKVERKHTLKLRHAMEQRPSQELLWELQQEKALLQARVQELEASVQEGKLDRSSPYIQVLEEDWRQALRDHQEQANTIFSLRKDLRQGEARRLRCMEEKEMFELQCLALRKDSKMYKDRIEAILLQMEEVAIERDQSTQMEGLLTSLRAQRLDVLRSLCLELGGRAEGPGQSLGPSLRVGLVLSRQAIATREELHAQHARGLQEKDALRKQVRELGEKADELQLQVFQCEAQLLAVEGRLRRQQLETLVLSSDLEDGSPRRSQELSLPQDLEDTQLSDKGCLAGGGSPKQPFAALHQEQVLRNPHDAGLSSGEPPEKERRRLKESFENYRRKRALRKMQKGWRQGEEDRENTTGSDNTDTEGS

SEQ ID NO: 836627 - protein, 561 aa, Homo sapiens
RTHQEVHRRPACSSLPAAPGSISQRLRGPGSWCVCSAGGSWKTLSLPAEAMSDYENDDECWNVLEGFRVTLTSVIDPSRITPYLRQCKVLNPDDEEQVLSDPNLVIRKRKVGVLLDILQRTGHKGYVAFLESLELYYPQLYKKVTGKEPARVFSMIIDASGESGLTQLLMTEVMKLQKKVQDLTALLSSKDDFIKELRVKDSLLRKHQERVQRLKEECEAGSRELKRCKEENYDLAMRLAHQSEEKGAALMRNRDLQLEIDQLKHSLMKAEDDCKVERKHTLKLRHAMEQRPSQELLWELQQEKALLQARVQELEASVQEGKLDRSSPYIQVLEEDWRQALRDHQEQANTIFSLRKDLRQGEARRLRCMEEKEMFELQCLALRKDSKMYKDRIEAILLQMEEVAIERDQAIATREELHAQHARGLQEKDALRKQVRELGEKADELQLQVFQCEAQLLAVEGRLRRQQLETLVLSSDLEDGSPRRSQELSLPQDLEDTQLSDKGCLAGGGSPKQPFAALHQEQFCGTPMPSRTAGHWGRLLSGTHFAEAMRVLTTPMHTPSV

SEQ ID NO: 836628 - protein, 178 aa, Homo sapiens
MLRTALRGAPRLLSRVQPRAPCLRRLWGRGARPEVAGRRRAWAWGWRRSSSEQGPGPAAALGRVEAAHYQLVYTCKVCGTRSSKRISKLAYHQGVVIVTCPGCQNHHIIADNLGWFSDLNGKRNIEEILTARGEQVHRVAGEGALELVLEAAGAPTSTAAPEAGEDEGPPSPGKTEPS

SEQ ID NO: 836629 - protein, 84 aa, Homo sapiens
MGKYDQWEESPPLSANAFNPLNASASLPAAMPITAADGRSDHTLTSPGGGGKAKVSGRPSSSPLSQQLAPELAARSSVSSSLLS

SEQ ID NO: 836630 - protein, 2517 aa, Homo sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEALHASGNEVPRGECSGPATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNTATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGKYDQWEESPPLSANAFNPLNASASLPAAMPITAADGRSDHTLTSPGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 836631 - protein, 2506 aa, Homo sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEALHASGNEVPRGECSGPATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAEKPVFFPAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNTATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGKYDQWEESPPLSANAFNPLNASASLPAAMPITAADGRSDHTLTSPGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 836632 - protein, 2697 aa, Homo sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEALHASGNEVPRGECSGPATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAEKPVFFPAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNTATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISVTTRSLLLLVTFAPGGTRPGEGMGNPTALLSWRGGWGIQGMALGGSRAWVRVRSQSPEHRHHHRPLIHGRSLGCEPMASSRAMRPSWWPRFLSVMGWSHQPSANYQLGTADHSPTPMHTGTRRPRGWRAGPQSPRKLAPPRILPRAPSSPSPPPEGSVRRVLPDSGPPHFLQEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGKYDQWEESPPLSANAFNPLNASASLPAAMPITAADGRSDHTLTSPGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 836633 - protein, 2479 aa, Homo sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEALHASGNEVPRGECSGPATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAEKPVFFPAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNTATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 836634 - protein, 2452 aa, Homo sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRPLYNQPSDTRQYHENIKINQAMRKKLILYFKRRNHARKQWEQKFCQRYDQLMEAWEKKVERIENNPRRRAKESKVNLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEALHASGNEVPRGECSGPATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAEKPVFFPAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNTATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGKYDQWEESPPLSANAFNPLNASASLPAAMPITAADGRSDHTLTSPGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 836635 - protein, 2507 aa, Homo sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEALHASGNEVPRGECSGPATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAEKPVFFPAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNTATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYSLMTYRSQAVQEHASTNMGLEAIIRKALMGKYDQWEESPPLSANAFNPLNASASLPAAMPITAADGRSDHTLTSPGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 836636 - protein, 2563 aa, Homo sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEALHASGNEVPRGECSGPATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAEKPVFFPAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNTATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGKTTLTAATFIDAIIMRQIAHDKGAREGGALANGSPRDGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGKYDQWEESPPLSANAFNPLNASASLPAAMPITAADGRSDHTLTSPGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 836637 - protein, 2075 aa, Homo sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEALHASGNEVPRGECSGPATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNTATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGKYDQWEESPPLSANAFNPLNASASLPAAMPITAADGRSDHTLTSPGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 836638 - protein, 2525 aa, Homo sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEALHASGNEVPRGECSGPATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAEKPVFFPAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNTATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGKYDQWEESPPLSANAFNPLNASASLPAAMPITAADGRSDHTLTSPGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 836639 - protein, 880 aa, Homo sapiens
MAPSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNTATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 836640 - protein, 2445 aa, Homo sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEALHASGNEVPRGECSGPATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAEKPVFFPAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNTATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGGGGKAKVSGRPSSRKAKSPAPGLASGDRPPSVSSVHSEGDCNRRTPLTNRVWEDRPSSAGNSTVDEILPVLFTNPFPVPGRMLDT

SEQ ID NO: 836641 - protein, 485 aa, Homo sapiens
MNLVCAADQELETMGASEATLLNMLNISPFSFGLVIQQVFDNGSSPLSELRGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGKYDQWEESPPLSANAFNPLNASASLPAAMPITAADGRSDHTLTSPGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 836642 - protein, 1646 aa, Homo sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEALHASGNEVPRGECSGPATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAEKPVFFPAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLVSGMTDIDLTHGTAIDHWLRDFIS

SEQ ID NO: 836643 - protein, 1422 aa, Homo sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEALHASGNEVPRGECSGPATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAEKPVFFPAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLNGGKGDPQI

SEQ ID NO: 836644 - protein, 749 aa, Homo sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEALHASGNEVPRGECSGPGTNVAGWPGG

SEQ ID NO: 836645 - protein, 438 aa, Homo sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKGGSSSLKPAVHCNALCT

SEQ ID NO: 836646 - protein, 305 aa, Homo sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELHHVFEVHPCRAWVGPSFLFVAESYFTVGVGHVLFTHSSVGGREIVCIFGVL

SEQ ID NO: 836647 - protein, 86 aa, Homo sapiens
MTNFLRLRRGMQLVWAMAVARARAYIPSAQGTPLKYDTGASTTGSKKHDVRSLIGSPGRTFPPVHPLDVMADARALERACYEESLK

SEQ ID NO: 836648 - protein, 2508 aa, Homo sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAEKPVFFPAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNTATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGKYDQWEESPPLSANAFNPLNASASLPAAMPITAADGRSDHTLTSPGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 836649 - protein, 1540 aa, Homo sapiens
MRSPPLVVVVEEEEDSELCYHPGRLVREEGEVVLDEGSYHHNLFQMEAWDAHPDKEAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNTATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGKYDQWEESPPLSANAFNPLNASASLPAAMPITAADGRSDHTLTSPGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 836650 - protein, 601 aa, Homo sapiens
MACPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGKYDQWEESPPLSANAFNPLNASASLPAAMPITAADGRSDHTLTSPGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 836651 - protein, 2418 aa, Homo sapiens
FLEYHTGHPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEALHASGNEVPRGECSGPATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAEKPVFFPAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNTATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGKYDQWEESPPLSANAFNPLNASASLPAAMPITAADGRSDHTLTSPGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 836652 - protein, 2364 aa, Homo sapiens
RVLCSYKREELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEALHASGNEVPRGECSGPATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAEKPVFFPAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNTATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGKYDQWEESPPLSANAFNPLNASASLPAAMPITAADGRSDHTLTSPGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 836653 - protein, 2296 aa, Homo sapiens
QRTNNQTKTQENREGPGIKVKRVKGPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEALHASGNEVPRGECSGPATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAEKPVFFPAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNTATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGKYDQWEESPPLSANAFNPLNASASLPAAMPITAADGRSDHTLTSPGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 836654 - protein, 2450 aa, Homo sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEALHASGNEVPRGECSGPATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAEKPVFFPAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNTATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 836655 - protein, 2280 aa, Homo sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEALHASGNEVPRGECSGPATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAEKPVFFPAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNTATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPALCRPYSGDVYLVLGKGGEGAGEGARQACGSHTQAARAARDPKQDDHAPPRHCLPRMHLEPKSKLSSQPPRPPSASHPA

SEQ ID NO: 836656 - protein, 2525 aa, Homo sapiens; identical to SEQ ID NO: 836638

SEQ ID NO: 836657 - protein, 2354 aa, Homo sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEALHASGNEVPRGECSGPATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAEKPVFFPAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNTATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTVLVHKKKFSRLQSLPLNLCQTSPL

SEQ ID NO: 836658 - protein, 1922 aa, Homo sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEALHASGNEVPRGECSGPATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAEKPVFFPAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNTATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGSSGGGGGSSSRPASHSHAHQHSPISPRTQDALQQRPSVLHNTGMKGIITAVEPSTPTVLRSTINLLPVPAADPLT

SEQ ID NO: 836659 - protein, 1588 aa, Homo sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEALHASGNEVPRGECSGPATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAEKPVFFPAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEVHLLGSRHS

SEQ ID NO: 836660 - protein, 1358 aa, Homo sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEALHASGNEVPRGECSGPATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAEKPVFFPAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEPHV

SEQ ID NO: 836661 - protein, 406 aa, Homo sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQEVSPGPDSGLSSFSLASPVRVQRP

SEQ ID NO: 836662 - protein, 104 aa, Homo sapiens
MGSKSPGNTSQPPAFFSKLTESNSAMVKSKKQEINKKLNTHNRNEPEYSKGPAGSRGSMGPQVGGWPAWAAGAAQWQKPTVHLRKLSGPADHLPPGPLPHIWGA

SEQ ID NO: 836663 - protein, 88 aa, Homo sapiens
PWARCLTLHPPPALGYHGSSYSPEGVEPVSPVSSPSLTHDKGLPKHLEELDKSHLEGELRPKQPGTPHPVPRPPKPCTVRTLKAPSCR

SEQ ID NO: 836664 - protein, 108 aa, Homo sapiens
MVSVVGEFKSCTILFSDVVTFTNICTACEPIQIVNVLNSMYSKFDRLTSVHAVYKVETIGDAYMVVGGVPVPIGNHAQRVANFALGMRISAKEVTNPVTGEPIQVESN

SEQ ID NO: 836665 - protein, 515 aa, Homo sapiens
MHHRFVWREEQMGKCFSITTRIEVVCATLYQALQAAFLKMKEKYLNVSACPVKKSHWDVVRSIVMFGKGHLMNTFEPIYPERLWIEEKTFCNAFPFHIVFDESLQVKQARVNIQKYVPGLQTQNIQLDEYFSIIHPQVTFNIFSIRRFINSQFVLKTRREMMPVAWQSRTTLKLQGQMIWMESMWCMVYLCSPKLRSLQELEELNMHLSDIAPNDTTRDLILLNQQRLAEIELSNQLERKKEELQVLSKHLAIEKKKTETLLYAMLPKHVANQLREGKKVAAGEFKSCTILFSDVVTFTNICTACEPIQIVNVLNSMYSKFDRLTSVHAVYKVETIGDAYMVVGGVPVPIGNHAQRVANFALGMRISAKEVTNPVTGEPIQLRVGIHTGPVLADVVGDKMPRYCLFGDTVNTASRMESHGLPNKVHLSPTAYRALKNQGFKIIERGEIEVKGKGRMTTYFLIQNLNATEDEIMGRSKTPVDHKGSTQKASLPTTKLQGSVQPSCPEHSSLASWLL

SEQ ID NO: 836666 - protein, 693 aa, Homo sapiens
MYGFINTCLQSLVIEKFGEETWEKLKTSAEVQDAFMTYTMYDDVITIKLIQEACNILGVSMEAILKLFGEYFAILKMSGYDRMLRTLGGNLMEFIENLDALHSYLALSYQEMNAPSFRVERGADGKMFLHYYSDRSGLCHIVPGIIEAVAKDFFDIDVIMDILDMNEEVERTGKKEHVVFLIVQKAHRKMRKTKPKRLQDSQGMERDQEALQAAFLKMKEKYLNVSACPVKKSHWDVVRSIVMFGKGHLMNTFEPIYPERLWIEEKTFCNAFPFHIVFDESLQVKQARVNIQKYVPGLQTQNIQLDEYFSIIHPQVTFNIFSIRRFINSQFVLKTRREMMPVAWQSRTTLKLQGQMIWMESMWCMVYLCSPKLRSLQELEELNMHLSDIAPNDTTRDLILLNQQRLAEIELSNQLERKKEELQVLSKHLAIEKKKTETLLYAMLPKHVANQLREGKKVAAGEFKSCTILFSDVVTFTNICTACEPIQIVNVLNSMYSKFDRLTSVHAVYKVETIGDAYMVVGGVPVPIGNHAQRVANFALGMRISAKEVTNPVTGEPIQLRVGIHTGPVLADVVGDKMPRYCLFGDTVNTASRMESHGLPNKVHLSPTAYRALKNQGFKIIERGEIEVKGKGRMTTYFLIQNLNATEDEIMGRSKTPVDHKGSTQKASLPTTKLQGSVQPSCPEHSSLASWLL

SEQ ID NO: 836667 - protein, 766 aa, Homo sapiens
ARRAGAEEAREEGQRGSWKMADEAALALQPGGSPSAAGADREAASSPAGEPLRKRPRRDGPGLERSPGEPGGAAPEREVPAAARGCPGAAAAALWREAEAEAAAAGGEQEAQATAAAGEGDNGPGLQGPSREPPLADNLYDEDDDDEGEEEEEAAAAAIGYRDNLLFGDEIITNGFHSCESDEEDRASHASSSDWTPRPRIGPYTFVQQHLMIGTDPRTILKDLLPETIPPPELDDMTLWQIVINILSEPPKRKKRKDINTIEDAVKLLQECKKIIVLTGAGVSVSCGIPDFRSRDGIYARLAVDFPDLPDPQAMFDIEYFRKDPRPFFKFAKEIYPGQFQPSLCHKFIALSDKEGKLLRNYTQNIDTLEQVAGIQRIIQCHGSFATASCLICKYKVDCEAVRGDIFNQVVPRCPRCPADEPLAIMKPEIVFFGENLPEQFHRAMKYDKDEVDLLIVIGSSLKVRPVALIPSSIPHEVPQILINREPLPHLHFDVELLGDCDVIINELCHRLGGEYAKLCCNPVKLSEITEKPPRTQKELAYLSELPPTPLHVSEDSSSPERTSPPDSSVIVTLLDQAAKSNDDLDVSESKGCMEEKPQEVQTSRNVESIAEQMENPDLKNVGSSTGEKNERTSVAGTVRKCWPNRVAKEQISRRLDGNQYLFLPPNRYIFHGAEVYSDSEDDVLSSSSCGSNSDSGTCQSPSLEEPMEDESEIEEFYNGLEDEPDVPERAGGAGFGTDGDDQEAINEAISVKQEVTDMNYPSNKS

SEQ ID NO: 836668 - protein, 766 aa, Homo sapiens; identical to SEQ ID NO: 836667

SEQ ID NO: 836669 - protein, 383 aa, Homo sapiens
ARRAGAEEAREEGQRGSWKMADEAALALQPGGSPSAAGADREAASSPAGEPLRKRPRRDGPGLERSPGEPGGAAPEREVPAAARGCPGAAAAALWREAEAEAAAAGGEQEAQATAAAGEGDNGPGLQGPSREPPLADNLYDEDDDDEGEEEEEAAAAAIGYRDNLLFGDEIITNGFHSCESDEEDRASHASSSDWTPRPRIGPYTFVQQHLMIGTDPRTILKDLLPETIPPPELDDMTLWQIVINILSEPPKRKKRKDINTIEDAVKLLQECKKIIVLTGAGVSVSCGIPDFRSRDGIYARLAVDFPDLPDPQAMFDIEYFRKDPRPFFKFAKEIYPGQFQPSLCHKFIALSDKEGKLLRNYTQNIDTLEQVAGIQRIIQCHG

SEQ ID NO: 836670 - protein, 766 aa, Homo sapiens; identical to SEQ ID NO: 836667

SEQ ID NO: 836671 - protein, 1015 aa, Homo sapiens
PVLSFRDFGQLAVELLDQSYKQDEQLAMKLLTYELKNWSNATCLQLAVAAKHRDFIAHTCSQMLLTDMWMGRLRMRKNSGLKVILGILLPPSILSLEFKNKDDMPYMSQAQEIHLQEKEAEEPEKPTKEKEEEDMELTAMLGRNNGESSRKKDEEEVQSKHRLIPLGRKIYEFYNAPIVKFWFYTLAYIGYLMLFNYIVLVKMERWPSTQEWIVISYIFTLGIEKMREILMSEPGKLLQKVKVWLQEYWNVTDLIAILLFSVGMILRLQDQPFRSDGRVIYCVNIIYWYIRLLDIFGVNKYLGPYVMMIGKMMIDMMYFVIIMLVVLMSFGVARQAILFPNEEPSWKLAKNIFYMPYWMIYGEVFADQIDPPCGQNETREDGKIIQLPPCKTGAWIVPAIMACYLLVANILLVNLLIAVFNNTFFEVKSISNQVWKFQRYQLIMTFHERPVLPPPLIIFSHMTMIFQHLCCRWRKHESDPDERDYGLKLFITDDELKKVHDFEEQCIEEYFREKDDRFNSSNDERIRVTSERVENMSMRLEEVNEREHSMKASLQTVDIRLAQLEDLIGRMATALERLTGLERAESNKIRSRTSSDCTDAAYIVRQSSFNSQEGNTFKLQESIDPAGEETMSPTSPTLMPRMRSHSFYSVNMKDKGGIEKLESIFKERSLSLHRATSSHSVAKEPKAPAAPANTLAIVPDSRRPSSCIDIYVSAMDELHCDIDPLDNSVNILGLGEPSFSTPVPSTAPSSSAYATLAPTDRPPSRSIDFEDITSMDTRSFSSDYTHLPECQNPWDSEPPMYHTIERSKSSRYLATTPFLLEEAPIVKSHSFMFSPSRSYYANFGVPVKTAEYTSITDCIDTRCVNAPQAIADRAAFPGGLGDKVEDLTCCHPEREAELSHPSSDSEENEAKGRRATIAISSQEGDNSERTLSNNITVPKIERANSYSAEEPSAPYAHTRKSFSISDKLDRQRNTASLRNPFQRSKSSKPEGRGDSLSMRRLSRTSAFQSFESKHN

SEQ ID NO: 836672 - protein, 245 aa, Homo sapiens
MLGRNNGESSRKKDEEEVQSKHRLIPLGRKIYEFYNAPIVKFWFYTLAYIGYLMLFNYIVLVKMERWPSTQEWIVISYIFTLGIEKMREILMSEPGKLLQKVKVWLQEYWNVTDLIAILLFSVGMILRLQDQPFRSDGRVIYCVNIIYWYIRLLDIFGVNKYLGPYVMMIGKMMIDMMYFVIIMLVVLMSFGVARQAILFPNEEPSWKLAKNIFYMPYWMIYGEVFADQIDRKQVYDSHTPKSGI

SEQ ID NO: 836673 - protein, 110 aa, Homo sapiens
MLGLLGLNSQSTVLCLLTAGVYRIPDALQLYRVSEDGTLAVHPGMDRNLLYFHPGNRKDERGNGFYKRKRKRKTVVKFYLWMEGTGRCLGCKLSRKLFSLTLPQLLLCSS

SEQ ID NO: 836674 - protein, 949 aa, Homo sapiens
MLGRNNGESSRKKDEEEVQSKHRLIPLGRKIYEFYNAPIVKFWFYTLAYIGYLMLFNYIVLVKMERWPSTQEWIVISYIFTLGIEKMREILMSEPGKLLQKVKVWLQEYWNVTDLIAILLFSVGMILRLQDQPFRSDGRVIYCVNIIYWYIRLLDIFGVNKYLGPYVMMIGKMMIDMMYFVIIMLVVLMSFGVARQAILFPNEEPSWKLAKNIFYMPYWMIYGEVFADQIDPPCGQNETREDGKIIQLPPCKTGAWIVPAIMACYLLVANILLVNLLIAVFNNTFFEVKSISNQVWKFQRYQLIMTFHERPVLPPPLIIFSHMTMIFQHLCCRWRKHESDPDERDYGLKLFITDDELKKVHDFEEQCIEEYFREKDDRFNSSNDERIRVTSERVENMSMRLEEVNEREHSMKASLQTVDIRLAQLEDLIGRMATALERLTGLERAESNKIRSRTSSDCTDAAYIVRQSSFNSQEGNTFKLQESIDPAGEETMSPTSPTLMPRMRSHSFYSVNMKDKGGIEKLESIFKERSLSLHRATSSHSVAKEPKAPAAPANTLAIVPDSRRPSSCIDIYVSAMDELHCDIDPLDNSVNILGLGEPSFSTPVPSTAPSSSAYATLAPTDRPPSRSIDFEDITSMDTRSFSSDYTHLPECQNPWDSEPPMYHTIERSKSSRYLATTPFLLEEAPIVKSHSFMFSPSRSYYANFGVPVKTAEYTSITDCIDTRCVNAPQAIADRAAFPGGLGDKVEDLTCCHPEREAELSHPSSDSEENEAKGRRATIAISSQEGDNSERTLSNNITVPKIERANSYSAEEPSAPYAHTRKSFSISDKLDRQRNTASLRNPFQRSKSSKPEGRGDSLSMRRLSRTSAFQRNPALSSLTKQRHAFGSAELKVNFWPTIQKAFRLDTCRSKGFIGCYTCLARRRIRRGKSYRWICLRRLPAKPSDAGNQGA

SEQ ID NO: 836675 - protein, 108 aa, Homo sapiens
MLGRNNGESSRKKDEEEVQSKHRLIPLGRKIYEFYNAPIVKFWFYTLAYIGYLMLFNYIVLVKMERWPSTQEWIVISYIFTLGIEKMREVTAFIKENVRERQWLSSIC

SEQ ID NO: 836676 - protein, 88 aa, Homo sapiens
ISNSRPRRHGCENTTEGGRGCCKGSSLRHTAVAMVKLSKEAKQRLQQLFKGSQFAIRWGFIPLVIYLGFKRGADPGMPEPTVLSLLWG

SEQ ID NO: 836677 - protein, 81 aa, Homo sapiens
MIEAHVDVKTTDGYCFRLFCVGFTKKRNNQIRKTSYAQHQQVRQIRKKMMEIMTREVQTNDLKEVVNEIDSQHGRCVLWLG

SEQ ID NO: 836678 - protein, 136 aa, Homo sapiens
EWLKDSWCRFAFSGRIPRSQPFPMADPEELQVSSPPPPPPSSPSSSDASAASSPGGPVSLGWPVPSRSSGPTVDQLEEVELQIGDAAFSLTKLLEATSAVSAQVEELAFKCTENARFLKTWRDLLKEGYDSLKPDD

SEQ ID NO: 836679 - protein, 136 aa, Homo sapiens; identical to SEQ ID NO: 836678

SEQ ID NO: 836680 - protein, 136 aa, Homo sapiens; identical to SEQ ID NO: 836678

SEQ ID NO: 836681 - protein, 136 aa, Homo sapiens; identical to SEQ ID NO: 836678

SEQ ID NO: 836682 - protein, 92 aa, Homo sapiens
AAAGAYYYKFAAASSGCCKGSSLRHTAVAMVKLSKEAKQRLQQLFKGSQFAIRWGFIPLVIYLAYFGDKGLFGLLDLEAISGQHGRCVLWLG

SEQ ID NO: 836683 - protein, 136 aa, Homo sapiens; identical to SEQ ID NO: 836678

SEQ ID NO: 836684 - protein, 88 aa, Homo sapiens; identical to SEQ ID NO: 836676

SEQ ID NO: 836685 - protein, 88 aa, Homo sapiens; identical to SEQ ID NO: 836676

SEQ ID NO: 836686 - protein, 136 aa, Homo sapiens; identical to SEQ ID NO: 836678

SEQ ID NO: 836687 - protein, 136 aa, Homo sapiens; identical to SEQ ID NO: 836678

SEQ ID NO: 836688 - protein, 136 aa, Homo sapiens; identical to SEQ ID NO: 836678

SEQ ID NO: 836689 - protein, 136 aa, Homo sapiens; identical to SEQ ID NO: 836678

SEQ ID NO: 836690 - protein, 55 aa, Homo sapiens
MVKLSKEAKQRLQQLFKGSQFAIRWGFIPLVIYLGFKRGADPGMPEPTVLSLLWG

SEQ ID NO: 836691 - protein, 1433 aa, Homo sapiens [sequence omitted]

SEQ ID NO: 836692 - protein, 1433 aa, Homo sapiens [sequence omitted]

SEQ ID NO: 836693 - protein, 94 aa, Homo sapiens
RHHRGNQIKTSKYTVLSFVPKNIFEQLHRFANLYFVGIAVLNFIPVVNAFQPEVSMIPICVILAVTAIKDAWEDLRRYKSDKVINNRECLIYSR

SEQ ID NO: 836694 - protein, 501 aa, Homo sapiens
MKKEGRKRWKRKEDKKRVVVSNLLFEGWSHKENPNRHHRGNQIKTSKYTVLSFVPKNIFEQLHRFANLYFVGIAVLNFIPVVNAFQPEVSMIPICVILAVTAIKDAWEDLRRYKSDKVINNRECLIYSRKEQTYVQKCWKDVRVGDFIQMKCNEIVPADILLLFSSDPNGICHLETASLDGETNLKQRRVVKGFSQQEVQFEPELFHNTIVCEKPNNHLNKFKGYMEHPDQTRTGFGCESLLLRGCTIRNTEMAVGIVIYAGHETKAMLNNSGPRYKRSKIERRMNIDIFFCIGILILMCLIGAVGHSIWNGTFEEHPPFDVPDANGSFLPSALGGFYMFLTMIILLQVLIPISLYVSIELVKLGQVFFLSNDLDLYDEETDLSIQCRALNIAEDLGQIQYIFSDKTGTLTENKMVFRRCTIMGSEYSHQENGIEAPKGSIPLSKRKYPALLRNEEIKDILLALLEAVWHFHKLLPVSLWSSLSQIRAVPITCKLSFVYKG

SEQ ID NO: 836695 - protein, 1366 aa, Homo sapiens
MKKEGRKRWKRKEDKKRVVVSNLLFEGWSHKENPNRHHRGNQIKTSKYTVLSFVPKNIFEQLHRFANLYFVGIAVLNFIPVVNAFQPEVSMIPICVILAVTAIKDAWEDLRRYKSDKVINNRECLIYSRKEQTYVQKCWKDVRVGDFIQMKCNEIVPADILLLFSSDPNGICHLETASLDGETNLKQRRVVKGFSQQEVQFEPELFHNTIVCEKPNNHLNKFKGYMEHPDQTRTGFGCESLLLRGCTIRNTEMAVGIVIYAGHETKAMLNNSGPRYKRSKIERRMNIDIFFCIGILILMCLIGAVGHSIWNGTFEEHPPFDVPDANGSFLPSALGGFYMFLTMIILLQVLIPISLYVSIELVKLGQVFFLSNDLDLYDEETDLSIQCRALNIAEDLGQIQYIFSDKTGTLTENKMVFRRCTIMGSEYSHQENAKRLETPKELDSDGEEWTQYQCLSFSARWAQDPATMRSQKGAQPLRRSQSARVPIQGHYRQRSMGHRESSQPPVAFSSSIEKDVTPDKNLLTKVRDAALWLETLSDSRPAKASLSTTSSIADFFLALTICNSVMVSTTTEPRQRVTIKPSSKALGTSLEKIQQLFQKLKLLSLSQSFSSTAPSDTDLGESLGANVATTDSDERDDASVCSGGDSTDDGGYRSSMWDQGDILESGSGTSLEEALEAPATDLARPEFCYEAESPDEAALVHAAHAYSFTLVSRTPEQVTVRLPQGTCLTFSLLCTLGFDSVRKRMSVVVRHPLTGEIVVYTKGADSVIMDLLEDPACVPDINMEKKLRKIRARTQKHLDLYARDGLRTLCIAKKVVSEEDFRRWASFRREAEASLDNRDELLMETAQHLENQLTLLGATGIEDRLQEGVPDTIATLREAGIQLWVLTGDKQETAVNIAHSCRLLNQTDTVYTINTENQETCESILNCALEELKQFRELQKPDRKLFGFRLPSKTPSITSEAVVPEAGLVIDGKTLNAIFQGKLEKKFLELTQYCRSVLCCRSTPLQKSMIVKLVRDKLRVMTLSIGDGANDVSMIQAADIGIGISGQEGMQAVMSSDFAITRFKHLKKLLLVHGHWCYSRLARMVVYYLYKNVCYNLSTFWISMVDAFYQSLICFFIPYLAYKGSDIDVFTFGTPINTISLTTILLHQAMEMKTWTIFHGVVLLGSFLMYFLVSLLYNATCVICNSPTNPYWVMEGQLSNPTFYLVCFLTPVVALLPRYFFLSLQGTCGKSLISKAQKIDKLPPDKRNLEIQSWRSRQRPAPVPEVARPTHHPVSSITGQDFSASTPKSSNPPKRKHVEESVLHEQRCGTECMRDDSCSGDSSAQLSSGEHLLGPNRIMAYSRGQTDMCRCSKRSSHRRSQSSLTI

SEQ ID NO: 836696 - protein, 939 aa, Homo sapiens
MKKEGRKRWKRKEDKKRVVVSNLLFEGWSHKENPNRHHRGNQIKTSKYTVLSFVPKNIFEQLHRFANLYFVGIAVLNFIPVVNAFQPEVSMIPICVILAVTAIKDAWEDLRRYKSDKVINNRECLIYSRKEQTYVQKCWKDVRVGDFIQMKCNEIVPADILLLFSSDPNGICHLETASLDGETNLKQRRVVKGFSQQEVQFEPELFHNTIVCEKPNNHLNKFKGYMEHPDQTRTGFGCESLLLRGCTIRNTEMAVGIVIYAGHETKAMLNNSGPRYKRSKIERRMNIDIFFCIGILILMCLIGAVGHSIWNGTFEEHPPFDVPDANGSFLPSALGGFYMFLTMIILLQVLIPISLYVSIELVKLGQVFFLSNDLDLYDEETDLSIQCRALNIAEDLGQIQYIFSDKTGTLTENKMVFRRCTIMGSEYSHQENAKRLETPKELDSDGEEWTQYQCLSFSARWAQDPATMRSQKGAQPLRRSQSARVPIQGHYRQRSMGHRESSQPPVAFSSSIEKDVTPDKNLLTKVRDAALWLETLSDSRPAKASLSTTSSIADFFLALTICNSVMVSTTTEPRQRVTIKPSSKALGTSLEKIQQLFQKLKLLSLSQSFSSTAPSDTDLGESLGANVATTDSDERDDASVCSGGDSTDDGGYRSSMWDQGDILESGSGTSLEEALEAPATDLARPEFCYEAESPDEAALVHAAHAYSFTLVSRTPEQVTVRLPQGTCLTFSLLCTLGFDSVRKRMSVVVRHPLTGEIVVYTKGADSVIMDLLEDPACVPDINMEKKLRKIRARTQKHLDLYARDGLRTLCIAKKVVSEEDFRRWASFRREAEASLDNRDELLMETAQHLENQLTLLGATGIEDRLQEGVPDTIATLREAGIQLWVLTGDKQETAVNIAHSCRLLNQTDTVYTINTENQGEVSVFTIQIAEGKVPPHLLG

SEQ ID NO: 836697 - protein, 1272 aa, Homo sapiens
MVAAAAATEARLRRRTAATAALAGRSGGPHWDWDVTRAGRPGLGAGLRLPRLLSPPLRPRLLLLLLLLSPPLLLLLLPCEAEAAAAAAAVSGSAAAEAKECDRPCVNGGRCNPGTGQCVCPAGWVGEQCQHCGGRFRLTGSSGFVTDGPGNYKYKTKCTWLIEGQPNRIMRLRFNHFATECSWDHLYVYDGDSIYAPLVAAFSGLIVPERDGNETVPEVVATSGYALLHFFSDAAYNLTGFNITYSFDMCPNNCSGRGECKISNSSDTVECECSENWKGEACDIPHCTDNCGFPHRGICNSSDVRGCSCFSDWQGPGCSVPVPANQSFWTREEYSNLKLPRASHKAVVNGNIMWVVGGYMFNHSDYNMVLAYDLASREWLPLNRSVNNVVVRYGHSLALYKDKIYMYGGKIDSTGNVTNELRVFHIHNESWVLLTPKAKEQYAVVGHSAHIVTLKNGRVVMLVIFGHCPLYGYISNVQEYDLDKNTWSILHTQGALVQGGYGHSSVYDHRTRALYVHGGYKAFSANKYRLADDLYRYDVDTQMWTILKDSRFFRYLHTAVIVSGTMLVFGGNTHNDTSMSHGAKCFSSDFMAYDIACDRWSVLPRPDLHHDVNRFGHSAVLHNSTMYVFGGFNSLLLSDILVFTSEQCDAHRSEAACLAAGPGIRCVWNTGSSQCISWALATDEQEEKLKSECFSKRTLDHDRCDQHTDCYSCTANTNDCHWCNDHCVPRNHSCSEGQISIFRYENCPKDNPMYYCNKKTSCRSCALDQNCQWEPRNQECIALPENICGIGWHLVGNSCLKITTAKENYDNAKLFCRNHNALLASLTTQKKVEFVLKQLRIMQSSQSMSKLTLTPWVGLRKINVSYWCWEDMSPFTNSLLQWMPSEPSDAGFCGILSEPSTRGLKAATCINPLNGSVCERPANHSAKQCRTPCALRTACGDCTSGSSECMWCSNMKQCVDSNAYVASFPFGQCMEWYTMSTCPPENCSGYCTCSHCLEQPGCGWCTDPSNTGKGKCIEGSYKGPVKMPSQAPTGNFYPQPLLNSSMCLEDSRYNWSFIHCPACQCNGHSKCINQSICEKCENLTTGKHCETCISGFYGDPTNGGKCQPCKCNGHASLCNTNTGKCFCTTKGVKGDECQLCEVENRYQGNPLRGTCYYTLLIDYQFTFSLSQEDDRYYTAINFVATPDEQNRDLDMFINASKNFNLNITWAASFSAGTQAGEEMPVVSKTNIKEYKDSFSNEKFDFRNHPNITFFVYVSNFTWPIKIQVQTEQ

SEQ ID NO: 836698 - protein, 1355 aa, Homo sapiens
MVAAAAATEARLRRRTAATAALAGRSGGPHCVNGGRCNPGTGQCVCPAGWVGEQCQHCGGRFRLTGSSGFVTDGPGNYKYKTKCTWLIEGQPNRIMRLRFNHFATECSWDHLYVYDGDSIYAPLVAAFSGLIVPERDGNETVPEVVATSGYALLHFFSDAAYNLTGFNITYSFDMCPNNCSGRGECKISNSSDTVECECSENWKGEACDIPHCTDNCGFPHRGICNSSDVRGCSCFSDWQGPGCSVPVPANQSFWTREEYSNLKLPRASHKAVVNGNIMWVVGGYMFNHSDYNMVLAYDLASREWLPLNRSVNNVVVRYGHSLALYKDKIYMYGGKIDSTGNVTNELRVFHIHNESWVLLTPKAKEQYAVVGHSAHIVTLKNGRVVMLVIFGHCPLYGYISNVQEYDLDKNTWSILHTQGALVQGGYGHSSVYDHRTRALYVHGGYKAFSANKYRLADDLYRYDVDTQMWTILKDSRFFRYLHTAVIVSGTMLVFGGNTHNDTSMSHGAKCFSSDFMAYDIACDRWSVLPRPDLHHDVNRFGHSAVLHNSTMYVFGGFNSLLLSDILVFTSEQCDAHRSEAACLAAGPGIRCVWNTGSSQCISWALATDEQEEKLKSECFSKRTLDHDRCDQHTDCYSCTANTNDCHWCNDHCVPRNHSCSEGQISIFRYENCPKDNPMYYCNKKTSCRSCALDQNCQWEPRNQECIALPENICGIGWHLVGNSCLKITTAKENYDNAKLFCRNHNALLASLTTQKKVEFVLKQLRIMQSSQSMSKLTLTPWVGLRKINVSYWCWEDMSPFTNSLLQWMPSEPSDAGFCGILSEPSTRGLKAATCINPLNGSVCERPANHSAKQCRTPCALRTACGDCTSGSSECMWCSNMKQCVDSNAYVASFPFGQCMEWYTMSTCPPENCSGYCTCSHCLEQPGCGWCTDPSNTGKGKCIEGSYKGPVKMPSQAPTGNFYPQPLLNSSMCLEDSRYNWSFIHCPACQCNGHSKCINQSICEKCENLTTGKHCETCISGFYGDPTNGGKCQPCKCNGHASLCNTNTGKCFCTTKGVKGDECQLCEVENRYQGNPLRGTCYYTLLIDYQFTFSLSQEDDRYYTAINFVATPDEQNRDLDMFINASKNFNLNITWAASFSAGTQAGEEMPVVSKTNIKEYKDSFSNEKFDFRNHPNITFFVYVSNFTWPIKIQIAFSQHSNFMDLVQFFVTFFSCFLSLLLVAAVVWKIKQSCWASRRREQLLREMQQMASRPFASVNVALETDEEPPDLIGGSIKTVPKPIALEPCFGNKAAVLSVFVRLPRGLGGIPPPGQSGLAVASALVDISQQMPIVYKEKSGAVRNRKQQPPAQPGTCI

SEQ ID NO: 836699 - protein, 271 aa, Homo sapiens
ELIPVWVASSVVCSQVCLWPAINLVATPDEQNRDLDMFINASKNFNLNITWAASFSAGTQAGEEMPVVSKTNIKEYKDSFSNEKFDFRNHPNITFFVYVSNFTWPIKIQIAFSQHSNFMDLVQFFVTFFSCFLSLLLVAAVVWKIKQSCWASRRREQLLREMQQMASRPFASVNVALETDEEPPDLIGGSIKTVPKPIALEPCFGNKAAVLSVFVRLPRGLGGIPPPGQSGLAVASALVDISQQMPIVYKEKSGAVRNRKQQPPAQPGTCI

SEQ ID NO: 836700 - protein, 124 aa, Homo sapiens
LGSMVAHDETGGLLPIKRTIRVLDVNNQSFREQEEPSNKRVRPLARVTSLANLISPVRNGAVRRFGQTIQSFTLRGDHRSPASAQKFSRRPLGIVLLQGRSSLFVQRTSFPRPKKSLPHVSPMP

SEQ ID NO: 836701 - protein, 612 aa, Homo sapiens
MVAAAAATEARLRRRTAATAALAGRSGGPHWDWDVTRAGRPGLGAGLRLPRLLSPPLRPRLLLLLLLLSPPLLLLLLPCEAEAAAAAAAVSGSAAAEAKECDRPCVNGGRCNPGTGQCVCPAGWVGEQCQHCGGRFRLTGSSGFVTDGPGNYKYKTKCTWLIEGQPNRIMRLRFNHFATECSWDHLYVYDGDSIYAPLVAAFSGLIVPERDGNETVPEVVATSGYALLHFFSDAAYNLTGFNITYSFDMCPNNCSGRGECKISNSSDTVECECSENWKGEACDIPHCTDNCGFPHRGICNSSDVRGCSCFSDWQGPGCSVPVPANQSFWTREEYSNLKLPRASHKAVVNGNIMWVVGGYMFNHSDYNMVLAYDLASREWLPLNRSVNNVVVRYGHSLALYKDKIYMYGGKIDSTGNVTNELRVFHIHNESWVLLTPKAKEQYAVVGHSAHIVTLKNGRVVMLVIFGHCPLYGYISNVQEYDLDKNTWSILHTQGALVQGGYGHSSVYDHRTRALYVHGGYKAFSANKYRLADDLYRYDVDTQMWTILKDSRFFRYLHTAVIVSGTMLVFGGNTHNDTSMSHGAKCFSSDFMAYDIGKFPKTIFSSGIFLPIL

SEQ ID NO: 836702 - protein, 1198 aa, Homo sapiens
MVAAAAATEARLRRRTAATAALAGRSGGPHCVNGGRCNPGTGQCVCPAGWVGEQCQHCGGRFRLTGSSGFVTDGPGNYKYKTKCTWLIEGQPNRIMRLRFNHFATECSWDHLYVYDGDSIYAPLVAAFSGLIVPERDGNETVPEVVATSGYALLHFFSDAAYNLTGFNITYSFDMCPNNCSGRGECKISNSSDTVECECSENWKGEACDIPHCTDNCGFPHRGICNSSDVRGCSCFSDWQGPGCSVPVPANQSFWTREEYSNLKLPRASHKAVVNGNIMWVVGGYMFNHSDYNMVLAYDLASREWLPLNRSVNNVVVRYGHSLALYKDKIYMYGGKIDSTGNVTNELRVFHIHNESWVLLTPKAKEQYAVVGHSAHIVTLKNGRVVMLVIFGHCPLYGYISNVQEYDLDKNTWSILHTQGALVQGGYGHSSVYDHRTRALYVHGGYKAFSANKYRLADDLYRYDVDTQMWTILKDSRFFRYLHTAVIVSGTMLVFGGNTHNDTSMSHGAKCFSSDFMAYDIACDRWSVLPRPDLHHDVNRFGHSAVLHNSTMYVFGGFNSLLLSDILVFTSEQCDAHRSEAACLAAGPGIRCVWNTGSSQCISWALATDEQEEKLKSECFSKRTLDHDRCDQHTDCYSCTANTNDCHWCNDHCVPRNHSCSEGQISIFRYENCPKDNPMYYCNKKTSCRSCALDQNCQWEPRNQECIALPENICGIGWHLVGNSCLKITTAKENYDNAKLFCRNHNALLASLTTQKKVEFVLKQLRIMQSSQSMSKLTLTPWVGLRKINVSYWCWEDMSPFTNSLLQWMPSEPSDAGFCGILSEPSTRGLKAATCINPLNGSVCERPANHSAKQCRTPCALRTACGDCTSGSSECMWCSNMKQCVDSNAYVASFPFGQCMEWYTMSTCPPENCSGYCTCSHCLEQPGCGWCTDPSNTGKGKCIEGSYKGPVKMPSQAPTGNFYPQPLLNSSMCLEDSRYNWSFIHCPACQCNGHSKCINQSICEKCENLTTGKHCETCISGFYGDPTNGGKCQPCKCNGHASLCNTNTGKCFCTTKGVKGDECQLCEVENRYQGNPLRGTCYYTLLIDYQFTFSLSQEDDRYYTAINFVATPDEQNRDLDMFINASKNFNLNITWAASFSAGTQAGEEMPVVSKTNIKEYKDSFSNEKFDFRNHPNITFFVYVSNFTWPIKIQVQTEQ

SEQ ID NO: 836703 - protein, 1215 aa, Homo sapiens
MVAAAAATEARLRRRTAATAALAGRSGGPHCVNGGRCNPGTGQCVCPAGWVGEQCQHCGGRFRLTGSSGFVTDGPGNYKYKTKCTWLIEGQPNRIMRLRFNHFATECSWDHLYVYDGDSIYAPLVAAFSGLIVPERDGNETVPEVVATSGYALLHFFSDAAYNLTGFNITYSFDMCPNNCSGRGECKISNSSDTVECECSENWKGEACDIPHCTDNCGFPHRGICNSSDVRGCSCFSDWQGPGCSVPVPANQSFWTREEYSNLKLPRASHKAVVNGNIMWVVGGYMFNHSDYNMVLAYDLASREWLPLNRSVNNVVVRYGHSLALYKDKIYMYGGKIDSTGNVTNELRVFHIHNESWVLLTPKAKEQYAVVGHSAHIVTLKNGRVVMLVIFGHCPLYGYISNVQEYDLDKNTWSILHTQGALVQGGYGHSSVYDHRTRALYVHGGYKAFSANKYRLADDLYRYDVDTQMWTILKDSRFFRYLHTAVIVSGTMLVFGGNTHNDTSMSHGAKCFSSDFMAYDIACDRWSVLPRPDLHHDVNRFGHSAVLHNSTMYVFGGFNSLLLSDILVFTSEQCDAHRSEAACLAAGPGIRCVWNTGSSQCISWALATDEQEEKLKSECFSKRTLDHDRCDQHTDCYSCTANTNDCHWCNDHCVPRNHSCSEGQISIFRYENCPKDNPMYYCNKKTSCRSCALDQNCQWEPRNQECIALPENICGIGWHLVGNSCLKITTAKENYDNAKLFCRNHNALLASLTTQKKVEFVLKQLRIMQSSQSMSKLTLTPWVGLRKINVSYWCWEDMSPFTNSLLQWMPSEPSDAGFCGILSEPSTRGLKAATCINPLNGSVCERPANHSAKQCRTPCALRTACGDCTSGSSECMWCSNMKQCVDSNAYVASFPFGQCMEWYTMSTCPPENCSGYCTCSHCLEQPGCGWCTDPSNTGKGKCIEGSYKGPVKMPSQAPTGNFYPQPLLNSSMCLEDSRYNWSFIHCPACQCNGHSKCINQSICEKCENLTTGKHCETCISGFYGDPTNGGKCQPCKCNGHASLCNTNTGKCFCTTKGVKGDECQLCEVENRYQGNPLRGTCYYTLLIDYQFTFSLSQEDDRYYTAINFVATPDEQNRDLDMFINASKNFNLNITWAASFSAGTQAGEEMPVVSKTNIKEYKDSFSNEKFDFRNHPNITFFVYVSNFTWPIKIQIAFSQHSNFMDLVQFFVTFFRP

SEQ ID NO: 836704 - protein, 940 aa, Homo sapiens
MGSGPIDPKELLKGLDSFLNRDGEVKSVDGISKIFSLMKEARKMVSRCTYLNILLQTRSPEILVKFIDVGGYKLLNNWLTYSKTTNNIPLLQQILLTLQHLPLTVDHLKQNNTAKLVKQLSKSSEDEELRKLASVLVSDWMAVIRSQSSTQPAEKDKKKRKDEGKSRTTLPERPLTEVKAETRAEEAPEKKREKPKSLRTTAPSHAKFRSTGLELETPSLVPVKKNASTVVVSDKYNLKPIPLKRQSNVAAPGDATPPAEKKYKPLNTTPNATKEIKVKIIPPQPMEGLGFLDALNSAPVPGIKIKKKKKVLSPTAAKPSPFEGKTSTEPSTAKPSSPEPAPPSEAMDADRPGTPVPPVEVPELMDTASLEPGALDAKPVESPGDPNQLTRKGRKRKSVTWPEEGKLREYFYFELDETERVNVNKIKDFGEAAKREILSDRHAFETARRLSHDNMEEKVPWVCPRPLVLPSPLVTPGSNSQERYIQAEREKGILQELFLNKESPHEPDPEPYEPIPPKLIPLDEECSMDETPYVETLEPGGSGGSPDGAGGSKLPPVLANLMGSMGAGKGPQGPGGGGINVQEILTSIMGSPNSHPSEELLKQPDYSDKIKQMLVPHGLLGPGPIANGFPPGGPGGPKGMQHFPPGPGGPMPGPHGGPGGPVGPRLLGPPPPPRGGDPFWDGPGDPMRGGPMRGGPGPGPGPYHRGRGGRGGNEPPPPPPPFRGARGGRSGGGPPNGRGGPGGGMVGGGGHRPHEGPGGGMGNSSGHRPHEGPGGGMGSGHRPHEGPGGSMGGGGGHRPHEGPGGGISGGSGHRPHEGPGGGMGAGGGHRPHEGPGGSMGGSGGHRPHEGPGHGGPHGHRPHDVPGHRGHDHRGPPPHEHRGHDGPGHGGGGHRGHDGGHSHGGDMSNRPVCRHFMMKGNCRYENNCAFYHPGVNGPPLP

SEQ ID NO: 836705 - protein, 940 aa, Homo sapiens; identical to SEQ ID NO: 836704

SEQ ID NO: 836706 - protein, 974 aa, Homo sapiens
MGSGPIDPKELLKGLDSFLNRDGEVKSVDGISKIFSLMKEARKMVSRCTYLNILLQTRSPEILVKFIDVGGYKLLNNWLTYSKTTNNIPLLQQILLTLQHLPLTVDHLKQNNTAKLVKQLSKSSEDEELRKLASVLVSDWMAVIRSQSSTQPAEKDKKKRKDEGKSRTTLPERPLTEVKAETRAEEAPEKKREKPKSLRTTAPSHAKFRSTGLELETPSLVPVKKNASTVVVSDKYNLKPIPLKRQRYGPYSQALNGVDLWTQGSRRGGVGDVDDSSSSDSNVAAPGDATPPAEKKYKPLNTTPNATKEIKVKIIPPQPMEGLGFLDALNSAPVPGIKIKKKKKVLSPTAAKPSPFEGKTSTEPSTAKPSSPEPAPPSEAMDADRPGTPVPPVEVPELMDTASLEPGALDAKPVESPGDPNQLTRKGRKRKSVTWPEEGKLREYFYFELDETERVNVNKIKDFGEAAKREILSDRHAFETARRLSHDNMEEKVPWVCPRPLVLPSPLVTPGSNSQERYIQAEREKGILQELFLNKESPHEPDPEPYEPIPPKLIPLDEECSMDETPYVETLEPGGSGGSPDGAGGSKLPPVLANLMGSMGAGKGPQGPGGGGINVQEILTSIMGSPNSHPSEELLKQPDYSDKIKQMLVPHGLLGPGPIANGFPPGGPGGPKGMQHFPPGPGGPMPGPHGGPGGPVGPRLLGPPPPPRGGDPFWDGPGDPMRGGPMRGGPGPGPGPYHRGRGGRGGNEPPPPPPPFRGARGGRSGGGPPNGRGGPGGGMVGGGGHRPHEGPGGGMGNSSGHRPHEGPGGGMGSGHRPHEGPGGSMGGGGGHRPHEGPGGGISGGSGHRPHEGPGGGMGAGGGHRPHEGPGGSMGGSGGHRPHEGPGHGGPHGHRPHDVPGHRGHDHRGPPPHEHRGHDGPGHGGGGHRGHDGGHSHGGDMSNRPVCRHFMMKGNCRYENNCAFYHPGVNGPPLP

SEQ ID NO: 836707 - protein, 655 aa, Homo sapiens
MEGLGFLDALNSAPVPGIKIKKKKKVLSPTAAKPSPFEGKTSTEPSTAKPSSPEPAPPSEAMDADRPGTPVPPVEVPELMDTASLEPGALDAKPVESPGDPNQLTRKGRKRKSVTWPEEGKLREYFYFELDETERVNVNKIKDFGEAAKREILSDRHAFETARRLSHDNMEEKVPWVCPRPLVLPSPLVTPGSNSQERYIQAEREKGILQELFLNKESPHEPDPEPYEPIPPKLIPLDEECSMDETPYVETLEPGGSGGSPDGAGGSKLPPVLANLMGSMGAGKGPQGPGGGGINVQEILTSIMGSPNSHPSEELLKQPDYSDKIKQMLVPHGLLGPGPIANGFPPGGPGGPKGMQHFPPGPGGPMPGPHGGPGGPVGPRLLGPPPPPRGGDPFWDGPGDPMRGGPMRGGPGPGPGPYHRGRGGRGGNEPPPPPPPFRGARGGRSGGGPPNGRGGPGGGMVGGGGHRPHEGPGGGMGNSSGHRPHEGPGGGMGSGHRPHEGPGGSMGGGGGHRPHEGPGGGISGGSGHRPHEGPGGGMGAGGGHRPHEGPGGSMGGSGGHRPHEGPGHGGPHGHRPHDVPGHRGHDHRGPPPHEHRGHDGPGHGGGGHRGHDGGHSHGGDMSNRPVCRHFMMKGNCRYENNCAFYHPGVNGPPLP

SEQ ID NO: 836708 - protein, 655 aa, Homo sapiens; identical to SEQ ID NO: 836707

SEQ ID NO: 836709 - protein, 655 aa, Homo sapiens; identical to SEQ ID NO: 836707

SEQ ID NO: 836710 - protein, 119 aa, Homo sapiens
PPFLRQAFDGDMATAPLMPPPALAEEWVPVVDIAPTKALAEAWVEVVDIVPMKALDTGGPMATGLMMSLVTEAMTIEGRHLMSTVAMMVLATGEGATEGTMEATAMEETCQTALSADIS

SEQ ID NO: 836711 - protein, 76 aa, Homo sapiens
YTAKVLYTSHYLEKGGPMATGLMMSLVTEAMTIEGRHLMSTVAMMVLATGEGATEGTMEATAMEETCQTALSADIS

SEQ ID NO: 836712 - protein, 181 aa, Homo sapiens
MGSGPIDPKELLKGLDSFLNRDGEVKSVDGISKIFSLMKEARKMVSRCTYLNILLQTRSPEILVKFIDVGGYKLLNNWLTYSKTTNNIPLLQQILLTLQHLPLTVDHLKQNNTAKLVKQLSKSSEDEELRKLASVLVSDWMAVIRSQSSTQPAGKLLSPLSWELFLSYGMWPLGAASLLHL

SEQ ID NO: 836713 - protein, 235 aa, Homo sapiens [sequence omitted]

SEQ ID NO: 836714 - protein, 940 aa, Homo sapiens; identical to SEQ ID NO: 836704

SEQ ID NO: 836715 - protein, 655 aa, Homo sapiens; identical to SEQ ID NO: 836707

SEQ ID NO: 836716 - protein, 800 aa, Homo sapiens
MAVIRSQSSTQPAEKDKKKRKDEGKSRTTLPERPLTEVKAETRAEEAPEKKREKPKSLRTTAPSHAKFRSTGLELETPSLVPVKKNASTVVVSDKYNLKPIPLKRQSNVAAPGDATPPAEKKYKPLNTTPNATKEIKVKIIPPQPMEGLGFLDALNSAPVPGIKIKKKKKVLSPTAAKPSPFEGKTSTEPSTAKPSSPEPAPPSEAMDADRPGTPVPPVEVPELMDTASLEPGALDAKPVESPGDPNQLTRKGRKRKSVTWPEEGKLREYFYFELDETERVNVNKIKDFGEAAKREILSDRHAFETARRLSHDNMEEKVPWVCPRPLVLPSPLVTPGSNSQERYIQAEREKGILQELFLNKESPHEPDPEPYEPIPPKLIPLDEECSMDETPYVETLEPGGSGGSPDGAGGSKLPPVLANLMGSMGAGKGPQGPGGGGINVQEILTSIMGSPNSHPSEELLKQPDYSDKIKQMLVPHGLLGPGPIANGFPPGGPGGPKGMQHFPPGPGGPMPGPHGGPGGPVGPRLLGPPPPPRGGDPFWDGPGDPMRGGPMRGGPGPGPGPYHRGRGGRGGNEPPPPPPPFRGARGGRSGGGPPNGRGGPGGGMVGGGGHRPHEGPGGGMGNSSGHRPHEGPGGGMGSGHRPHEGPGGSMGGGGGHRPHEGPGGGISGGSGHRPHEGPGGGMGAGGGHRPHEGPGGSMGGSGGHRPHEGPGHGGPHGHRPHDVPGHRGHDHRGPPPHEHRGHDGPGHGGGGHRGHDGGHSHGGDMSNRPVCRHFMMKGNCRYENNCAFYHPGVNGPPLP

SEQ ID NO: 836717 - protein, 709 aa, Homo sapiens
MGSGPIDPKELLKGLDSFLNRDGEVKSVDGISKIFSLMKEARKMVSRCTYLNILLQTRSPEILVKFIDVGGYKLLNNWLTYSKTTNNIPLLQQILLTLQHLPLTVDHLKQNNTAKLVKQLSKSSEDEELRKLASVLVSDWMAVIRSQSSTQPAEKDKKKRKDEGKSRTTLPERPLTEVKAETRAEEAPEKKREKPKSLRTTAPSHAKFRSTGLELETPSLVPVKKNASTVVVSDKYNLKPIPLKRQSNVAAPGDATPPAEKKYKPLNTTPNATKEIKVKIIPPQPMEGLGFLDALNSAPVPGIKIKKKKKVLSPTAAKPSPFEGKTSTEPSTAKPSSPEPAPPSEAMDADRPGTPVPPVEVPELMDTASLEPGALDAKPVESPGDPNQLTRKGRKRKSVTWPEEGKLREYFYFELDETERVNVNKIKDFGEAAKREILSDRHAFETARRLSHDNMEEKVPWVCPRPLVLPSPLVTPGSNSQERYIQAEREKGILQELFLNKESPHEPDPEPYEPIPPKLIPLDEECSMDETPYVETLEPGGSGGSPDGAGGSKLPPVLANLMGSMGAGKGPQGPGGGGINVQEILTSIMGSPNSHPSEELLKQPDYSDAIAVVNLPLVLVRQHFICLGHLLKFLLSKLFIIWVFVWVPLESLAPIRLLDVISGRTERNVWDVVGSHGNWSVVRRASLGLLRQESRPPAAHRPCPHREPS

SEQ ID NO: 836718 - protein, 344 aa, Homo sapiens
MGSGPIDPKELLKGLDSFLNRDGEVKSVDGISKIFSLMKEARKMVSRCTYLNILLQTRSPEILVKFIDVGGYKLLNNWLTYSKTTNNIPLLQQILLTLQHLPLTVDHLKQNNTAKLVKQLSKSSEDEELRKLASVLVSDWMAVIRSQSSTQPAEKDKKKRKDEGKSRTTLPERPLTEVKAETRAEEAPEKKREKPKSLRTTAPSHAKFRSTGLELETPSLVPVKKNASTVVVSDKYNLKPIPLKRQSNVAAPGDATPPAEKKYKPLNTTPNATKEIKVKIIPPQPMEGLGFLDALNSAPVPGIKIKKKKKVLSPTAAKPSPFEGKTSTEPSTAKPVSVQLKWHL

SEQ ID NO: 836719 - protein, 119 aa, Homo sapiens
EREREREREREREREEERRERGDENPFPVLPLMLENLKLVILANTPTLLLRVPTCTQNSDTGSAALKKSSQLSSLFLMGWGDAERGIVYPTALRGLNQLDLSSGTHIIPTPPPAWAHHS

SEQ ID NO: 836720 - protein, 1048 aa, Homo sapiens
MAFPPRRRLRLGPRGLPLLLSGLLLPLCRAFNLDVDSPAEYSGPEGSYFGFAVDFFVPSASSRMFLLVGAPKANTTQPGIVEGGQVLKCDWSSTRRCQPIEFDATGNRDYAKDDPLEFKSHQWFGASVRSKQDKILACAPLYHWRTEMKQEREPVGTCFLQDGTKTVEYAPCRSQDIDADGQGFCQGGFSIDFTKADRVLLGGPGSFYWQGQLISDQVAEIVSKYDPNVYSIKYNNQLATRTAQAIFDDSYLGYSVAVGDFNGDGIDDFVSGVPRAARTLGMVYIYDGKNMSSLYNFTGEQMAAYFGFSVAATDINGDDYADVFIGAPLFMDRGSDGKLQEVGQVSVSLQRASGDFQTTKLNGFEVFARFGSAIAPLGDLDQDGFNDIAIAAPYGGEDKKGIVYIFNGRSTGLNAVPSQILEGQWAARSMPPSFGYSMKGATDIDKNGYPDLIVGAFGVDRAILYRARPVITVNAGLEVYPSILNQDNKTCSLPGTALKVSCFNVRFCLKADGKGVLPRKLNFQVELLLDKLKQKGAIRRALFLYSRSPSHSKNMTISRGGLMQCEELIAYLRDESEFRDKLTPITIFMEYRLDYRTAADTTGLQPILNQFTPANISRQAHILLDCGEDNVCKPKLEVSVDSDQKKIYIGDDNPLTLIVKAQNQGEGAYEAELIVSIPLQADFIGVVRNNEALARLSCAFKTENQTRQVVCDLGNPMKAGTQLLAGLRFSVHQQSEMDTSVKFDLQIQSSNLFDKVSPVVSHKVDLAVLAAVEIRGVSSPDHIFLPIPNWEHKENPETEEDVGPVVQHIYELRNNGPSSFSKAMLHLQWPYKYNNNTLLYILHYDIDGPMNCTSDMEINPLRIKISSLQTTEKNDTVAGQGERDHLITKRDLALSEGDIHTLGCGVAQCLKIVCQVGRLDRGKSAILYVKSLLWTETFMNKENQNHSYSLKSSASFNVIEFPYKNLPIEDITNSTLVTTNVTWGIQPAPMPVPVWVIILAVLAGLLLLAVLVFVMYRMGFFKRVRPPQEEQEREQLQPHENGEGNSET

SEQ ID NO: 836721 - protein, 1048 aa, Homo sapiens; identical to SEQ ID NO: 836720

SEQ ID NO: 836722 - protein, 1048 aa, Homo sapiens; identical to SEQ ID NO: 836720

SEQ ID NO: 836723 - protein, 312 aa, Homo sapiens
MDTSVKFDLQIQSSNLFDKVSPVVSHKVDLAVLAAVEIRGVSSPDHIFLPIPNWEHKENPETEEDVGPVVQHIYELRNNGPSSFSKAMLHLQWPYKYNNNTLLYILHYDIDGPMNCTSDMEINPLRIKISSLQTTEKNDTVAGQGERDHLITKRDLALSEGDIHTLGCGVAQCLKIVCQVGRLDRGKSAILYVKSLLWTETFMNKENQNHSYSLKSSASFNVIEFPYKNLPIEDITNSTLVTTNVTWGIQPAPMPVPVWVIILAVLAGLLLLAVLVFVMYRMGFFKRVRPPQEEQEREQLQPHENGEGNSET

SEQ ID NO: 836724 - protein, 1048 aa, Homo sapiens; identical to SEQ ID NO: 836720

SEQ ID NO: 836725 - protein, 193 aa, Homo sapiens
MAFPPRRRLRLGPRGLPLLLSGLLLPLCRAFNLDVDSPAEYSGPEGSYFGFAVDFFVPSASSRMFLLVGAPKANTTQPGIVEGGQVLKCDWSSTRRCQPIEFDATGNRDYAKDDPLEFKSHQWFGASVRSKQDKILACAPLYHWRTEMKQEREPVGTCFLQDGTKTVEYAPCRSRMYRILYQLLRRGVGSLVC

SEQ ID NO: 836726 - protein, 284 aa, Homo sapiens
MAFPPRRRLRLGPRGLPLLLSGLLLPLCRAFNLDVDSPAEYSGPEGSYFGFAVDFFVPSASSRMFLLVGAPKANTTQPGIVEGGQVLKCDWSSTRRCQPIEFDATGNRDYAKDDPLEFKSHQWFGASVRSKQDKILACAPLYHWRTEMKQEREPVGTCFLQDGTKTVEYAPCRSQDIDADGQGFCQGGFSIDFTKADRVLLGGPGSFYWQGQLISDQVAEIVSKYDPNVYSIKYNNQLATRTAQAIFDDSYLGYSVAVGDFNGDGIDDFVSGVPRAARTLGMSY

SEQ ID NO: 836727 - protein, 1048 aa, Homo sapiens; identical to SEQ ID NO: 836720

SEQ ID NO: 836728 - protein, 750 aa, Homo sapiens
MIAAFFGLPVSAIDINGHDYVHVLLRSASRSMVSVTREASREEVGQVSVSLQRASGDFQTTKLNGFEVFARFGSAIAPLGDLDQDGFNDIAIAAPYGGEDKKGIVYIFNGRSTGLNAVPSQILEGQWAARSMPPSFGYSMKGATDIDKNGYPDLIVGAFGVDRAILYRARPVITVNAGLEVYPSILNQDNKTCSLPGTALKVSCFNVRFCLKADGKGVLPRKLNFQVELLLDKLKQKGAIRRALFLYSRSPSHSKNMTISRGGLMQCEELIAYLRDESEFRDKLTPITIFMEYRLDYRTAADTTGLQPILNQFTPANISRQAHILLDCGEDNVCKPKLEVSVDSDQKKIYIGDDNPLTLIVKAQNQGEGAYEAELIVSIPLQADFIGVVRNNEALARLSCAFKTENQTRQVVCDLGNPMKAGTQLLAGLRFSVHQQSEMDTSVKFDLQIQSSNLFDKVSPVVSHKVDLAVLAAVEIRGVSSPDHIFLPIPNWEHKENPETEEDVGPVVQHIYELRNNGPSSFSKAMLHLQWPYKYNNNTLLYILHYDIDGPMNCTSDMEINPLRIKISSLQTTEKNDTVAGQGERDHLITKRDLALSEGDIHTLGCGVAQCLKIVCQVGRLDRGKSAILYVKSLLWTETFMNKENQNHSYSLKSSASFNVIEFPYKNLPIEDITNSTLVTTNVTWGIQPAPMPVPVWVIILAVLAGLLLLAVLVFVMYRMGFFKRVRPPQEEQEREQLQPHENGEGNSET

SEQ ID NO: 836729 - protein, 312 aa, Homo sapiens; identical to SEQ ID NO: 836723

SEQ ID NO: 836730 - protein, 815 aa, Homo sapiens
MAFPPRRRLRLGPRGLPLLLSGLLLPLCRAFNLDVDSPAEYSGPEGSYFGFAVDFFVPSASSRMFLLVGAPKANTTQPGIVEGGQVLKCDWSSTRRCQPIEFDATGNRDYAKDDPLEFKSHQWFGASVRSKQDKILACAPLYHWRTEMKQEREPVGTCFLQDGTKTVEYAPCRSQDIDADGQGFCQGGFSIDFTKADRVLLGGPGSFYWQGQLISDQVAEIVSKYDPNVYSIKYNNQLATRTAQAIFDDSYLGYSVAVGDFNGDGIDDFVSGVPRAARTLGMVYIYDGKNMSSLYNFTGEQMAAYFGFSVAATDINGDDYADVFIGAPLFMDRGSDGKLQEVGQVSVSLQRASGDFQTTKLNGFEVFARFGSAIAPLGDLDQDGFNDIAIAAPYGGEDKKGIVYIFNGRSTGLNAVPSQILEGQWAARSMPPSFGYSMKGATDIDKNGYPDLIVGAFGVDRAILYRARPVITVNAGLEVYPSILNQDNKTCSLPGTALKVSCFNVRFCLKADGKGVLPRKLNFQVELLLDKLKQKGAIRRALFLYSRSPSHSKNMTISRGGLMQCEELIAYLRDESEFRDKLTPITIFMEYRLDYRTAADTTGLQPILNQFTPANISRQAHILLDCGEDNVCKPKLEVSVDSDQKKIYIGDDNPLTLIVKAQNQGEGAYEAELIVSIPLQADFIGVVRNNEALARLSCAFKTENQTRQVVCDLGNPMKAGTQLLAGLRFSVHQQSEMDTSVKFDLQIQSSNLFDKVSPVVSHKVDLAVLAAVEIRGVSSPDHIFLPIPNWEHKENPETEEDVGPVVQHIYEVCSC

SEQ ID NO: 836731 - protein, 289 aa, Homo sapiens
MAFPPRRRLRLGPRGLPLLLSGLLLPLCRAFNLDVDSPAEYSGPEGSYFGFAVDFFVPSASSRMFLLVGAPKANTTQPGIVEGGQVLKCDWSSTRRCQPIEFDATGNRDYAKDDPLEFKSHQWFGASVRSKQDKILACAPLYHWRTEMKQEREPVGTCFLQDGTKTVEYAPCRSQDIDADGQGFCQGGFSIDFTKADRVLLGGPGSFYWQGQLISDQVAEIVSKYDPNVYSIKYNNQLATRTAQAIFDDSYLGYSVAVGDFNGDGIDDFVSGVPRAARTLGMVGQLKGI

SEQ ID NO: 836732 - protein, 797 aa, Homo sapiens
MTLISAAREYEIEFIYAISPGLDITFSNPKEVSTLKRKLDQVSQFGCRSFALLFDDIDHNMCAADKEVFSSFAHAQVSITNEIYQYLGEPETFLFCPTEYCGTFCYPNVSQSPYLRTVGEKLLPGIEVLWTGPKVVSKEIPVESIEEVSKIIKRAPVIWDNIHANDYDQKRLFLGPYKGRSTELIPRLKGVLTNPNCEFEANYVAIHTLATWYKSNMNGVRKDVVMTDSEDSTVSIQIKLENEGSDEDIETDVLYSPQMALKLALTEWLQEFGVPHQYSSRQVAHSGAKASVVDGTPLVAAPSLNATTVVTTVYQEPIMSQGAALSGEPTTLTKEEEKKQPDEEPMDMVVEKQEETDHKNDNQILSEIVEAKMAEELKPMDTDKESIAESKSPEMSMQEDCISDIAPMQTDEQTNKEQFVPGPNEKPLYTAEPVTLEDLQLLADLFYLPYEHGPKGAQMLREFQWLRANSSVVSVNCKGKDSEKIEEWRSRAAKFEEMCGLVMGMFTRLSNCANRTILYDMYSYVWDIKSIMSMVKSFVQWLGCRSHSSAQFLIGDQEPWAFRGGLAGEFQRLLPIDGANDLFFQPPPLTPTSKVYTIRPYFPKDEASVYKICREMYDDGVGLPFQSQPDLIGDKLVGGLLSLSLDYCFVLEDEDGICGYALGTVDVTPFIKKCKISWIPFMQEKYTKPNGDKELSEAEKIMLSFHEEQEVLPETFLANFPSLIKMDIHKKVTDPSVAKSMMACLLSSLKANGSRGAFCEVRPDDKRILEFYSKLGCFEIAKMEGFPKDVVILGRSL

SEQ ID NO: 836733 - protein, 1028 aa, Homo sapiens
SASAVRINRKRAVEAAAEGELGAWRGNSGRPKIIGRAAEAENEDRTLGRLLPGNERSQPRSPLMLLAPQLKAEAAADKGLAPVPPPFSSGHSGPCEKEGEGQRGRGRSRRGAHLELKPSPGLRAGAPTDRGRGGPAEVAAAGGRRMVQKESQATLEERESELSSNPAASAGASLEPPAAPAPGEDNPAGAGGAAVAGAAGGARRFLCGVVEGFYGRPWVMEQRKELFRRLQKWELNTYLYAPKDDYKHRMFWREMYSVEEAEQLMTLISAAREYEIEFIYAISPGLDITFSNPKEVSTLKRKLDQVSQFGCRSFALLFDDIDHNMCAADKEVFSSFAHAQVSITNEIYQYLGEPETFLFCPTGPKVVSKEIPVESIEEVSKIIKRAPVIWDNIHANDYDQKRLFLGPYKGRSTELIPRLKGVLTNPNCEFEANYVAIHTLATWYKSNMNGVRKDVVMTDSEDSTVSIQIKLENEGSDEDIETDVLYSPQMALKLALTEWLQEFGVPHQYSSRQVAHSGAKASVVDGTPLVAAPSLNATTVVTTVYQEPIMSQGAALSGEPTTLTKEEEKKQPDEEPMDMVVEKQEETDHKNDNQILSEIVEAKMAEELKPMDTDKESIAESKSPEMSMQEDCISDIAPMQTDEQTNKEQFVPGPNEKPLYTAEPVTLEDLQLLADLFYLPYEHGPKGAQMLREFQWLRANSSVVSVNCKGKDSEKIEEWRSRAAKFEEMCGLVMGMFTRLSNCANRTILYDMYSYVWDIKSIMSMVKSFVQWLGCRSHSSAQFLIGDQEPWAFRGGLAGEFQRLLPIDGANDLFFQPPPLTPTSKVYTIRPYFPKDEASVYKICREMYDDGVGLPFQSQPDLIGDKLVGGLLSLSLDYCFVLEDEDGICGYALGTVDVTPFIKKCKISWIPFMQEKYTKPNGDKELSEAEKIMLSFHEEQEVLPETFLANFPSLIKMDIHKKVTDPSVAKSMMACLLSSLKANGSRGAFCEVRPDDKRILEFYSKLGCFEIAKMEGFPKDVVILGRSL

SEQ ID NO: 836734 - protein, 745 aa, Homo sapiens
FGAYKYVFNSHFWSLLKSSFAHAQVSITNEIYQYLGEPETFLFCPTEYCGTFCYPNVSQSPYLRTVGEKLLPGIEVLWTGPKVVSKEIPVESIEEVSKIIKRAPVIWDNIHANDYDQKRLFLGPYKGRSTELIPRLKGVLTNPNCEFEANYVAIHTLATWYKSNMNGVRKDVVMTDSEDSTVSIQIKLENEGSDEDIETDVLYSPQMALKLALTEWLQEFGVPHQYSSRQVAHSGAKASVVDGTPLVAAPSLNATTVVTTVYQEPIMSQGAALSGEPTTLTKEEEKKQPDEEPMDMVVEKQEETDHKNDNQILSEIVEAKMAEELKPMDTDKESIAESKSPEMSMQEDCISDIAPMQTDEQTNKEQFVPGPNEKPLYTAEPVTLEDLQLLADLFYLPYEHGPKGAQMLREFQWLRANSSVVSVNCKGKDSEKIEEWRSRAAKFEEMCGLVMGMFTRLSNCANRTILYDMYSYVWDIKSIMSMVKSFVQWLGCRSHSSAQFLIGDQEPWAFRGGLAGEFQRLLPIDGANDLFFQPPPLTPTSKVYTIRPYFPKDEASVYKICREMYDDGVGLPFQSQPDLIGDKLVGGLLSLSLDYCFVLEDEDGICGYALGTVDVTPFIKKCKISWIPFMQEKYTKPNGDKELSEAEKIMLSFHEEQEVLPETFLANFPSLIKMDIHKKVTDPSVAKSMMACLLSSLKANGSRGAFCEVRPDDKRILEFYSKLGCFEIAKMEGFPKDVVILGRSL

SEQ ID NO: 836735 - protein, 581 aa, Homo sapiens
MNGVRKDVVMTDSEDSTVSIQIKLENEGSDEDIETDVLYSPQMALKLALTEWLQEFGVPHQYSSRQVAHSGAKASVVDGTPLVAAPSLNATTVVTTVYQEPIMSQGAALSGEPTTLTKEEEKKQPDEEPMDMVVEKQEETDHKNDNQILSEIVEAKMAEELKPMDTDKESIAESKSPEMSMQEDCISDIAPMQTDEQTNKEQFVPGPNEKPLYTAEPVTLEDLQLLADLFYLPYEHGPKGAQMLREFQWLRANSSVVSVNCKGKDSEKIEEWRSRAAKFEEMCGLVMGMFTRLSNCANRTILYDMYSYVWDIKSIMSMVKSFVQWLGCRSHSSAQFLIGDQEPWAFRGGLAGEFQRLLPIDGANDLFFQPPPLTPTSKVYTIRPYFPKDEASVYKICREMYDDGVGLPFQSQPDLIGDKLVGGLLSLSLDYCFVLEDEDGICGYALGTVDVTPFIKKCKISWIPFMQEKYTKPNGDKELSEAEKIMLSFHEEQEVLPETFLANFPSLIKMDIHKKVTDPSVAKSMMACLLSSLKANGSRGAFCEVRPDDKRILEFYSKLGCFEIAKMEGFPKDVVILGRSL

SEQ ID NO: 836736 - protein, 1061 aa, Homo sapiens
SASAVRINRKRAVEAAAEGELGAWRGNSGRPKIIGRAAEAENEDRTLGRLLPGNERSQPRSPLMLLAPQLKAEAAADKGLAPVPPPFSSGHSGPCEKEGEGQRGRGRSRRGAHLELKPSPGLRAGAPTDRGRGGPAEVAAAGGRRMVQKESQATLEERESELSSNPAASAGASLEPPAAPAPGEDNPAGAGGAAVAGAAGGARRFLCGVVEGFYGRPWVMEQRKELFRRLQKWELNTYLYAPKDDYKHRMFWREMYSVEEAEQLMTLISAAREYEIEFIYAISPGLDITFSNPKEVSTLKRKLDQVSQFGCRSFALLFDDIDHNMCAADKEVFSSFAHAQVSITNEIYQYLGEPETFLFCPTEYCGTFCYPNVSQSPYLRTVGEKLLPGIEVLWTGPKVVSKEIPVESIEEVSKIIKRAPVIWDNIHANDYDQKRLFLGPYKGRSTELIPRLKGVLTNPNCEFEANYVAIHTLATWYKSNMNGVRKDVVMTDSEDSTVSIQIKLENEGSDEDIETDVLYSPQMALKLALTEWLQEFGVPHQYSSRQVAHSGAKASVVDGTPLVAAPSLNATTVVTTVYQEPIMSQGAALSGEPTTLTKEEEKKQPDEEPMDMVVEKQEETDHKNDNQILSEIVEAKMAEELKPMDTDKESIAESKSPEMSMQEDCISDIAPMQTDEQTNKEQFVPGPNEKPLYTAEPVTLEDLQLLADLFYLPYEHGPKGAQMLREFQWLRANSSVVSVNCKGKDSEKIEEWRSRAAKFEEMCGLVMGMFTRLSNCANRTILYDMYSYVWDIKSIMSMVKSFVQWLGCRSHSSAQFLIGDQEPWAFRGGLAGEFQRLLPIDGANDLFFQPPPLTPTSKVYTIRPYFPKDEASVYKICREMYDDGVGLPFQSQPDLIGDKLVGGLLSLSLDYCFVLEDEDGICGYALGTVDVTPFIKKCKISWIPFMQEKYTKPNGDKELSEAEKIMLSFHEEQEVLPETFLANFPSLIKMDIHKKVTDPSVAKSMMACLLSSLKANGSRGAFCEVRPDDKRILEFYSKLGCFEIAKMEGFPKDVVILGRSL

SEQ ID NO: 836737 - protein, 1061 aa, Homo sapiens; identical to SEQ ID NO: 836736

SEQ ID NO: 836738 - protein, 1061 aa, Homo sapiens; identical to SEQ ID NO: 836736

SEQ ID NO: 836739 - protein, 822 aa, Homo sapiens
SASAVRINRKRAVEAAAEGELGAWRGNSGRPKIIGRAAEAENEDRTLGRLLPGNERSQPRSPLMLLAPQLKAEAAADKGLAPVPPPFSSGHSGPCEKEGEGQRGRGRSRRGAHLELKPSPGLRAGAPTDRGRGGPAEVAAAGGRRMVQKESQATLEERESELSSNPAASAGASLEPPAAPAPGEDNPAGAGGAAVAGAAGGARRFLCGVVEGFYGRPWVMEQRKELFRRLQKWELNTYLYAPKDDYKHRMFWREMYSVEEAEQLMTLISAAREYEIEFIYAISPGLDITFSNPKEVSTLKRKLDQVSQFGCRSFALLFDDIDHNMCAADKEVFSSFAHAQVSITNEIYQYLGEPETFLFCPTEYCGTFCYPNVSQSPYLRTVGEKLLPGIEVLWTGPKVVSKEIPVESIEEVSKIIKRAPVIWDNIHANDYDQKRLFLGPYKGRSTELIPRLKGVLTNPNCEFEANYVAIHTLATWYKSNMNGVRKDVVMTDSEDSTVSIQIKLENEGSDEDIETDVLYSPQMALKLALTEWLQEFGVPHQYSSRQVAHSGAKASVVDGTPLVAAPSLNATTVVTTVYQEPIMSQGAALSGEPTTLTKEEEKKQPDEEPMDMVVEKQEETDHKNDNQILSEIVEAKMAEELKPMDTDKESIAESKSPEMSMQEDCISDIAPMQTDEQTNKEQFVPGPNEKPLYTAEPVTLEDLQLLADLFYLPYEHGPKGAQMLREFQWLRANSSVVSVNCKGKDSEKIEEWRSRAAKFEEMCGLVMGMFTRLSNCANRTILYDMYSYVWDIKSIMSMVKSFVQWLGRCTRNNLFSSNILSL

SEQ ID NO: 836740 - protein, 1061 aa, Homo sapiens; identical to SEQ ID NO: 836736

SEQ ID NO: 836741 - protein, 1182 aa, Homo sapiens
SASAVRINRKRAVEAAAEGELGAWRGNSGRPKIIGRAAEAENEDRTLGRLLPGNERSQPRSPLMLLAPQLKAEAAADKGLAPVPPPFSSGHSGPCEKEGEGQRGRGRSRRGAHLELKPSPGLRAGAPTDRGRGGPAEVAAAGGRRMVQKESQATLEERESELSSNPAASAGASLEPPAAPAPGEDNPAGAGGAAVAGAAGGARRFLCGVVEGFYGRPWVMEQRKELFRRLQKWELNTYLYAPKDDYKHRMFWREMYSVEEAEQLMTLISAAREYEIEFIYAISPGLDITFSNPKEVSTLKRKLDQVSQFGCRSFALLFDDIDHNMCAADKEVFSSFAHAQVSITNEIYQYLGEPETFLFCPTEYCGTFCYPNVSQSPYLRTVGEKLLPGIEVLWTGPKVVSKEIPVESIEEVSKIIKRAPVIWDNIHANDYDQKRLFLGPYKGRSTELIPRLKGVLTNPNCEFEANYVAIHTLATWYKSNMNGVRKDVVMTDSEDSTVSIQIKLENEGSDEDIETDVLYSPQMALKLALTEWLQEFGVPHQYSSRQVAHSGAKASVVDGTPLVAAPSLNATTVVTTVYQEPIMSQGAALSGEPTTLTKEEEKKQPDEEPMDMVVEKQEETDHKNDNQILSEIVEAKMAEELKPMDTDKESIAESKSPEMSMQEDCISDIAPMQTDEQTNKEQFVPGPNEKPLYTAEPVTLEDLQLLADLFYLPYEHGPKGAQMLREFQWLRANSSVVSVNCKGKDSEKIEEWRSRAAKFEEMCGLVMGMFTRLSNCANRTILYDMYSYVWDIKSIMSMVKSFVQWLGCRSHSSAQFLIGDQEPWAFRGGLAGEFQRLLPIDGANDLFFQPPPLTPTSKVYTIRPYFPKDEASVYKICREMYDDGVGLPFQSQPDLIGDKLVGGLLSLSLDYCFVLEDEDGICGYALGTVDVTPFIKKCKISWIPFMQEKYTKPNGDKELSEAEKIMLSFHEEQEVLPETFLANFPSLIKMDIHKKVTDPSVAKSMMACLLSSLKANGSRGALCRSETSMTTPDTSGNFYTPQLRHGLTQTSPHNTAPRDFSHTGTVASYLRSGSPVHHSRTRTNWLKPRSPNQLLPFKPWPTLCSDNLGSNTIQRAPPVFPNLTPGNIPSCPPPVYAHPLARYRPPPEVSTILPTNNITGCSASPCRQMTHDTATSGKTSQS

SEQ ID NO: 836742 - protein, 586 aa, Homo sapiens
SASAVRINRKRAVEAAAEGELGAWRGNSGRPKIIGRAAEAENEDRTLGRLLPGNERSQPRSPLMLLAPQLKAEAAADKGLAPVPPPFSSGHSGPCEKEGEGQRGRGRSRRGAHLELKPSPGLRAGAPTDRGRGGPAEVAAAGGRRMVQKESQATLEERESELSSNPAASAGASLEPPAAPAPGEDNPAGAGGAAVAGAAGGARRFLCGVVEGFYGRPWVMEQRKELFRRLQKWELNTYLYAPKDDYKHRMFWREMYSVEEAEQLMTLISAAREYEIEFIYAISPGLDITFSNPKEVSTLKRKLDQVSQFGCRSFALLFDDIDHNMCAADKEVFSSFAHAQVSITNEIYQYLGEPETFLFCPTEYCGTFCYPNVSQSPYLRTVGEKLLPGIEVLWTGPKVVSKEIPVESIEEVSKIIKRAPVIWDNIHANDYDQKRLFLGPYKGRSTELIPRLKGVLTNPNCEFEANYVAIHTLATWYKSNMNGVRKDVVMTDSEDSTVSIQIKLENEGSDEDIETDVLYSPQMALKLALTEWLQEFGVPHQYSSRASATVELSSGTDGLFIADLLMPTSTTVSGHIAGTDGHILQK

SEQ ID NO: 836743 - protein, 284 aa, Homo sapiens
SASAVRINRKRAVEAAAEGELGAWRGNSGRPKIIGRAAEAENEDRTLGRLLPGNERSQPRSPLMLLAPQLKAEAAADKGLAPVPPPFSSGHSGPCEKEGEGQRGRGRSRRGAHLELKPSPGLRAGAPTDRGRGGPAEVAAAGGRRMVQKESQATLEERESELSSNPAASAGASLEPPAAPAPGEDNPAGAGGAAVAGAAGGARRFLCGVVEGFYGRPWVMEQRKELFRRLQKWELNTYLYAPKDDYKHRMFWREMYSVEEAGWSAVVRSRLTANLALPSSRDSA

SEQ ID NO: 836744 - protein, 1061 aa, Homo sapiens; identical to SEQ ID NO: 836736

SEQ ID NO: 836745 - protein, 838 aa, Homo sapiens
SASAVRINRKRAVEAAAEGELGAWRGNSGRPKIIGRAAEAENEDRTLGRLLPGNERSQPRSPLMLLAPQLKAEAAADKGLAPVPPPFSSGHSGPCEKEGEGQRGRGRSRRGAHLELKPSPGLRAGAPTDRGRGGPAEVAAAGGRRMVQKESQATLEERESELSSNPAASAGASLEPPAAPAPGEDNPAGAGGAAVAGAAGGARRFLCGVVEGFYGRPWVMEQRKELFRRLQKWELNTYLYAPKDDYKHRMFWREMYSVEEAEQLMTLISAAREYEIEFIYAISPGLDITFSNPKEVSTLKRKLDQVSQFGCRSFALLFDDIDHNMCAADKEVFSSFAHAQVSITNEIYQYLGEPETFLFCPTEYCGTFCYPNVSQSPYLRTVGEKLLPGIEVLWTGPKVVSKEIPVESIEEVSKIIKRAPVIWDNIHANDYDQKRLFLGPYKGRSTELIPRLKGVLTNPNCEFEANYVAIHTLATWYKSNMNGVRKDVVMTDSEDSTVSIQIKLENEGSDEDIETDVLYSPQMALKLALTEWLQEFGVPHQYSSRQVAHSGAKASVVDGTPLVAAPSLNATTVVTTVYQEPIMSQGAALSGEPTTLTKEEEKKQPDEEPMDMVVEKQEETDHKNDNQILSEIVEAKMAEELKPMDTDKESIAESKSPEMSMQEDCISDIAPMQTDEQTNKEQFVPGPNEKPLYTAEPVTLEDLQLLADLFYLPYEHGPKGAQMLREFQWLRANSSVVSVNCKGKDSEKIEEWRSRAAKFEEMCGLVMGMFTRLSNCANRTILYDMYSYVWDIKSIMSMVKSFVQWLGCRSHSSAQFLIGDQEPWAFRGGLAGEFQVSI

SEQ ID NO: 836746 - protein, 737 aa, Homo sapiens
MCAADKEVFSSFAHAQVSITNEIYQYLGEPETFLFCPTEYCGTFCYPNVSQSPYLRTVGEKLLPGIEVLWTGPKVVSKEIPVESIEEVSKIIKRAPVIWDNIHANDYDQKRLFLGPYKGRSTELIPRLKGVLTNPNCEFEANYVAIHTLATWYKSNMNGVRKDVVMTDSEDSTVSIQIKLENEGSDEDIETDVLYSPQMALKLALTEWLQEFGVPHQYSSRQVAHSGAKASVVDGTPLVAAPSLNATTVVTTVYQEPIMSQGAALSGEPTTLTKEEEKKQPDEEPMDMVVEKQEETDHKNDNQILSEIVEAKMAEELKPMDTDKESIAESKSPEMSMQEDCISDIAPMQTDEQTNKEQFVPGPNEKPLYTAEPVTLEDLQLLADLFYLPYEHGPKGAQMLREFQWLRANSSVVSVNCKGKDSEKIEEWRSRAAKFEEMCGLVMGMFTRLSNCANRTILYDMYSYVWDIKSIMSMVKSFVQWLGCRSHSSAQFLIGDQEPWAFRGGLAGEFQRLLPIDGANDLFFQPPPLTPTSKVYTIRPYFPKDEASVYKICREMYDDGVGLPFQSQPDLIGDKLVGGLLSLSLDYCFVLEDEDGICGYALGTVDVTPFIKKCKISWIPFMQEKYTKPNGDKELSEAEKIMLSFHEEQEVLPETFLANFPSLIKMDIHKKVTDPSVAKSMMACLLSSLKANGSRGAFCEVRPDDKRILEFYSKLGCFEIAKMEGFPKDVVILGRSL

SEQ ID NO: 836747 - protein, 906 aa, Homo sapiens
SASAVRINRKRAVEAAAEGELGAWRGNSGRPKIIGRAAEAENEDRTLGRLLPGNERSQPRSPLMLLAPQLKAEAAADKGLAPVPPPFSSGHSGPCEKEGEGQRGRGRSRRGAHLELKPSPGLRAGAPTDRGRGGPAEVAAAGGRRMVQKESQATLEERESELSSNPAASAGASLEPPAAPAPGEDNPAGAGGAAVAGAAGGARRFLCGVVEGFYGRPWVMEQRKELFRRLQKWELNTYLYAPKDDYKHRMFWREMYSVEEAEQLMTLISAAREYEIEFIYAISPGLDITFSNPKEVSTLKRKLDQVSQFGCRSFALLFDDIDHNMCAADKEVFSSFAHAQVSITNEIYQYLGEPETFLFCPTEYCGTFCYPNVSQSPYLRTVGEKLLPGIEVLWTGPKVVSKEIPVESIEEVSKIIKRAPVIWDNIHANDYDQKRLFLGPYKGRSTELIPRLKGVLTNPNCEFEANYVAIHTLATWYKSNMNGVRKDVVMTDSEDSTVSIQIKLENEGSDEDIETDVLYSPQMALKLALTEWLQEFGVPHQYSSRQVAHSGAKASVVDGTPLVAAPSLNATTVVTTVYQEPIMSQGAALSGEPTTLTKEEEKKQPDEEPMDMVVEKQEETDHKNDNQILSEIVEAKMAEELKPMDTDKESIAESKSPEMSMQEDCISDIAPMQTDEQTNKEQFVPGPNEKPLYTAEPVTLEDLQLLADLFYLPYEHGPKGAQMLREFQWLRANSSVVSVNCKGKDSEKIEEWRSRAAKFEEMCGLVMGMFTRLSNCANRTILYDMYSYVWDIKSIMSMVKSFVQWLGCRSHSSAQFLIGDQEPWAFRGGLAGEFQRLLPIDGANDLFFQPPPLTPTSKVYTIRPYFPKDEASVYKICREMYDDGVGLPFQSQPDLIGDKYVISIWI

SEQ ID NO: 836748 - protein, 105 aa, Homo sapiens
CKRGSSGRSYSVKRAVHACYRVTMRAARLSVADSDNTKENAMPSVAKSMMACLLSSLKANGSRGAFCEVRPDDKRILEFYSKLGCFEIAKMEGFPKDVVILGRSL

SEQ ID NO: 836749 - protein, 1061 aa, Homo sapiens; identical to SEQ ID NO: 836736

SEQ ID NO: 836750 - protein, 1061 aa, Homo sapiens; identical to SEQ ID NO: 836736

SEQ ID NO: 836751 - protein, 822 aa, Homo sapiens; identical to SEQ ID NO: 836739

SEQ ID NO: 836752 - protein, 1039 aa, Homo sapiens
SASAVRINRKRAVEAAAEGELGAWRGNSGRPKIIGRAAEAENEDRTLGRLLPGNERSQPRSPLMLLAPQLKAEAAADKGLAPVPPPFSSGHSGPCEKEGEGQRGRGRSRRGAHLELKPSPGLRAGAPTDRGRGGPAEVAAAGGRRMVQKESQATLEERESELSSNPAASAGASLEPPAAPAPGEDNPAGAGGAAVAGAAGGARRFLCGVVEGFYGRPWVMEQRKELFRRLQKWELNTYLYAPKDDYKHRMFWREMYSVEEAEQLMTLISAAREYEIEFIYAISPGLDITFSNPKEVSTLKRKLDQVSQFGCRSFALLFDDIDHNMCAADKEVFSSFAHAQVSITNEIYQYLGEPETFLFCPTEYCGTFCYPNVSQSPYLRTVGEKLLPGIEVLWTGPKVVSKEIPVESIEEVSKIIKRAPVIWDNIHANDYDQKRLFLGPYKGRSTELIPRLKGVLTNPNCEFEANYVAIHTLATWYKSNMNGVRKDVVMTDSEDSTVSIQIKLENEGSDEDIETDVLYSPQMALKLALTEWLQEFGVPHQYSSRQVAHSGAKASVVDGTPLVAAPSLNATTVVTTVYQEPIMSQGAALSGEPTTLTKEEEKKQPDEEPMDMVVEKQEETDHKNDNQILSEIVEAKMAEELKPMDTDKESIAESKSPEMSMQEDCISDIAPMQTDEQTNKEQFVPGPNEKPLYTAEPVTLEDLQLLADLFYLPYEHGPKGAQMLREFQWLRANSSVVSVNCKGKDSEKIEEWRSRAAKFEEMCGLVMGMFTRLSNCANRTILYDMYSYVWDIKSIMSMVKSFVQWLGCRSHSSAQFLIGDQEPWAFRGGLAGEFQRLLPIDGANDLFFQPPPLTPTSKVYTIRPYFPKDEASVYKICREMYDDGVGLPFQSQPDLIGDKLVGGLLSLSLDYCFVLEDEDGICGYALGTVDVTPFIKKCKISWIPFMQEKYTKPNGDKELSEAEKIMLSFHEEQEVLPETFLANFPSLIKMDIHKKVTDPSVAKSMMACLLSSLKANGEYIFVELVVFGQDRERTIYFWI

SEQ ID NO: 836753 - protein, 838 aa, Homo sapiens; identical to SEQ ID NO: 836745

SEQ ID NO: 836754 - protein, 512 aa, Homo sapiens
SASAVRINRKRAVEAAAEGELGAWRGNSGRPKIIGRAAEAENEDRTLGRLLPGNERSQPRSPLMLLAPQLKAEAAADKGLAPVPPPFSSGHSGPCEKEGEGQRGRGRSRRGAHLELKPSPGLRAGAPTDRGRGGPAEVAAAGGRRMVQKESQATLEERESELSSNPAASAGASLEPPAAPAPGEDNPAGAGGAAVAGAAGGARRFLCGVVEGFYGRPWVMEQRKELFRRLQKWELNTYLYAPKDDYKHRMFWREMYSVEEAEQLMTLISAAREYEIEFIYAISPGLDITFSNPKEVSTLKRKLDQVSQFGCRSFALLFDDIDHNMCAADKEVFSSFAHAQVSITNEIYQYLGEPETFLFCPTEYCGTFCYPNVSQSPYLRTVGEKLLPGIEVLWTGPKVVSKEIPVESIEEVSKIIKRAPVIWDNIHANDYDQKRLFLGPYKGRSTELIPRLKGVLTNPNCEFEANYVAIHTLATWYKSNMNGVRKDVVMTDSEDSAVDTQIMLIAVSSSKA

SEQ ID NO: 836755 - protein, 636 aa, Homo sapiens
MEGRGPYRIYDPGGSVPSGEASAAFERLVKENSRLKEKMQGIKMLGELLEESQMEATRLRQKAEELVKDNELLPPPSPSLGSFDPLAELTGKDSNVTASPTAPACPSDKPAPVQKPPSSGTSSEFEVVTPEEQNSPESSSHANAMALGPLPREDGNLMLHLQRLETTLSVCAEEPDHGQLFTHLGRMALEFNRLASKVHKNEQRTSILQTLCEQLRKENEALKAKLDKGLEQRDQAAERLREENLELKKLLMSNGNKEGASGRPGSPKMEGTGKKAVAGQQQASVTAGKVPEVVALGAAEKKVKMLEQQRSELLEVNKQWDQHFRSMKQQYEQKITELRQKLADLQKQVTDLEAEREQKQRDFDRKLLLAKSKIEMEETDKEQLTAEAKELRQKVKYLQDQLSPLTRQREYQEKEIQRLNKALEEALSIQTPPSSPPTAFGSPEGAGALLRKQELVTQNELLKQQVKIFEEDFQRERSDRERMNEEKEELKKQVEKLQAQVTLSNAQLKAFKDEEKAREALRQQKRKAKASGERYHVEPHPEHLCGAYPYAYPPMPAMVPHHGFEDWSQIRYPPPPMAMEHPPPLPNSRLFHLPEYTWRLPCGGVRNPNQSSQVMDPPTARPTEPESPKNDREGPQ

SEQ ID NO: 836756 - protein, 635 aa, Homo sapiens
MEGRGPYRIYDPGGSVPSGEASAAFERLVKENSRLKEKMQGIKMLGELLEESQMEATRLRQKAEELVKDNELLPPPSPSLGSFDPLAELTGKDSNVTASPTAPACPSDKPAPVQKPPSSGTSSEFEVVTPEEQNSPESSSHANAMALGPLPREDGNLMLHLQRLETTLSVCAEEPDHGQLFTHLGRMALEFNRLASKVHKNEQRTSILQTLCEQLRKENEALKAKLDKGLEQRDQAAERLREENLELKKLLMSNGNKEGASGRPGSPKMEGTGKKAVAGQQQASVTAGKVPEVVALGAAEKKVKMLEQQRSELLEVNKQWDQHFRSMKQQYEQKITELRQKLADLQKQVTDLEAEREQKQRDFDRKLLLAKSKIEMEETDKEQLTAEAKELRQKVKYLQDQLSPLTRQREYQEKEIQRLNKALEEALSIQTPPSSPPTAFGSPEGAGALLRKQELVTQNELLKQQVKIFEEDFQRERSDRERMNEEKEELKKQVEKLQAQVTLSNAQLKAFKDEEKAREALRQQKRKAKASGERYHVEPHPEHLCGAYPYAYPPMPAMVPHHGFEDWSQIRYPPPPMAMEHPPPLPNSRLFHLPEYTWRLPCGGVRNPNQSSQVMDPPTARPTEPEPADLRLPRN

SEQ ID NO: 836757 - protein, 583 aa, Homo sapiens
MEATRLRQKAEELVKDNELLPPPSPSLGSFDPLAELTGKDSNVTASPTAPACPSDKPAPVQKPPSSGTSSEFEVVTPEEQNSPESSSHANAMALGPLPREDGNLMLHLQRLETTLSVCAEEPDHGQLFTHLGRMALEFNRLASKVHKNEQRTSILQTLCEQLRKENEALKAKLDKGLEQRDQAAERLREENLELKKLLMSNGNKEGASGRPGSPKMEGTGKKAVAGQQQASVTAGKVPEVVALGAAEKKVKMLEQQRSELLEVNKQWDQHFRSMKQQYEQKITELRQKLADLQKQVTDLEAEREQKQRDFDRKLLLAKSKIEMEETDKEQLTAEAKELRQKVKYLQDQLSPLTRQREYQEKEIQRLNKALEEALSIQTPPSSPPTAFGSPEGAGALLRKQELVTQNELLKQQVKIFEEDFQRERSDRERMNEEKEELKKQVEKLQAQVTLSNAQLKAFKDEEKAREALRQQKRKAKASGERYHVEPHPEHLCGAYPYAYPPMPAMVPHHGFEDWSQIRYPPPPMAMEHPPPLPNSRLFHLPEYTWRLPCGGVRNPNQSSQVMDPPTARPTEPESPKNDREGPQ

SEQ ID NO: 836758 - protein, 636 aa, Homo sapiens; identical to SEQ ID NO: 836755

SEQ ID NO: 836759 - protein, 546 aa, Homo sapiens
MEGRGPYRIYDPGGSVPSGEASAAFERLVKENSRLKEKMQGIKMLGELLEESQMEATRLRQKAEELVKDNELLPPPSPSLGSFDPLAELTGKDSNVTASPTAPACPSDKPAPVQKPPSSTLCEQLRKENEALKAKLDKGLEQRDQAAERLREENLELKKLLMSNGNKEGASGRPGSPKMEGTGKKAVAGQQQASVTAGKVPEVVALGAAEKKVKMLEQQRSELLEVNKQWDQHFRSMKQQYEQKITELRQKLADLQKQVTDLEAEREQKQRDFDRKLLLAKSKIEMEETDKEQLTAEAKELRQKVKYLQDQLSPLTRQREYQEKEIQRLNKALEEALSIQTPPSSPPTAFGSPEGAGALLRKQELVTQNELLKQQVKIFEEDFQRERSDRERMNEEKEELKKQVEKLQAQVTLSNAQLKAFKDEEKAREALRQQKRKAKASGERYHVEPHPEHLCGAYPYAYPPMPAMVPHHGFEDWSQIRYPPPPMAMEHPPPLPNSRLFHLPEYTWRLPCGGVRNPNQSSQVMDPPTARPTEPESPKNDREGPQ

SEQ ID NO: 836760 - protein, 366 aa, Homo sapiens
MEGRGPYRIYDPGGSVPSGEASAAFERLVKKKVKMLEQQRSELLEVNKQWDQHFRSMKQQYEQKITELRQKLADLQKQVTDLEAEREQKQRDFDRKLLLAKSKIEMEETDKEQLTAEAKELRQKVKYLQDQLSPLTRQREYQEKEIQRLNKALEEALSIQTPPSSPPTAFGSPEGAGALLRKQELVTQNELLKQQVKIFEEDFQRERSDRERMNEEKEELKKQVEKLQAQVTLSNAQLKAFKDEEKAREALRQQKRKAKASGERYHVEPHPEHLCGAYPYAYPPMPAMVPHHGFEDWSQIRYPPPPMAMEHPPPLPNSRLFHLPEYTWRLPCGGVRNPNQSSQVMDPPTARPTEPESPKNDREGPQ

SEQ ID NO: 836761 - protein, 636 aa, Homo sapiens; identical to SEQ ID NO: 836755

SEQ ID NO: 836762 - protein, 634 aa, Homo sapiens
MEGRGPYRIYDPGGSVPSGEASAAFERLVKENSRLKEKMQGIKMLGELLEESQMEATRLRQKAEELVKDNELLPPPSPSLGSFDPLAELTGKDSNVTASPTAPACPSDKPAPVQKPPSSGTSSEFEVVTPEEQNSPESSSHANAMALGPLPREDGNLMLHLQRLETTLSVCAEEPDHGQLFTHLGRMALEFNRLASKVHKNEQRTSILQTLCEQLRKENEALKAKLDKGLEQRDQAAERLREENLELKKLLMSNGNKEGASGRPGSPKMEGTGKKAVAGQQQASVTAGKVPEVVALGAAEKKVKMLEQQRSELLEVNKQWDQHFRSMKQQYEQKITELRQKLADLQKQVTDLEAEREQKQRDFDRKLLLAKSKIEMEETDKEQLTAEAKELRQKVKYLQDQLSPLTRQREYQEKEIQRLNKALEEALSIQTPPSSPPTAFGSPEGAGALLRKQELVTQNELLKQQVKIFEEDFQRERSDRERMNEEKEELKKQVEKLQAQVTLSNAQLKAFKDEEKAREALRQQKRKAKASGERYHVEPHPEHLCGAYPYAYPPMPAMVPHHGFEDWSQIRYPPPPMAMEHPPPLPNSRLFHLQPRPPRGASLKLPGPEVQTLDPIAGGLWCQKPRLGWLSIPG

SEQ ID NO: 836763 - protein, 203 aa, Homo sapiens
MTGQVEGRVVVGRGALLRKQELVTQNELLKQQVKIFEEDFQRERSDRERMNEEKEELKKQVEKLQAQVTLSNAQLKAFKDEEKAREALRQQKRKAKASGERYHVEPHPEHLCGAYPYAYPPMPAMVPHHGFEDWSQIRYPPPPMAMEHPPPLPNSRLFHLPEYTWRLPCGGVRNPNQSSQVMDPPTARPTEPESPKNDREGPQ

SEQ ID NO: 836764 - protein, 182 aa, Homo sapiens
MEGRGPYRIYDPGGSVPSGEASAAFERLVKENSRLKEKMQGIKMLGELLEESQMEATRLRQKAREALRQQKRKAKASGERYHVEPHPEHLCGAYPYAYPPMPAMVPHHGFEDWSQIRYPPPPMAMEHPPPLPNSRLFHLPEYTWRLPCGGVRNPNQSSQVMDPPTARPTEPESPKNDREGPQ

SEQ ID NO: 836765 - protein, 548 aa, Homo sapiens [sequence omitted]

SEQ ID NO: 836766 - protein, 301 aa, Homo sapiens
MEGRGPYRIYDPGGSVPSGEASAAFERLVKENSRLKEKMQGIKMLGELLEESQMEATRLRQKAEELVKDNELLPPPSPSLGSFDPLAELTGKDSNVTASPTAPACPSDKPAPVQKPPSSGTSSEFEVVTPEEQNSPESSSHANAMALGPLPREDGNLMLHLQRLETTLSVCAEEPDHGQLFTHLGRMALEFNRLASKVHKNEQRTSILQTLCEQLRKENEALKAKLDKGLEQRDQAAERLREENLELKKLLMSNGNKEGASGRPGSPKMEGTGKKAVAGQQQKPSQMGEGHASHVRRGAPA

SEQ ID NO: 836767 - protein, 245 aa, Homo sapiens
MEGRGPYRIYDPGGSVPSGEASAAFERLVKENSRLKEKMQGIKMLGELLEESQMEATRLRQKAEELVKDNELLPPPSPSLGSFDPLAELTGKDSNVTASPTAPACPSDKPAPVQKPPSSGTSSEFEVVTPEEQNSPESSSHANAMALGPLPREDGNLMLHLQRLETTLSVCAEEPDHGQLFTHLGRMALEFNRLASKVHKNEQRTSILQTLCEQLRKENEALKAKLDKGLEQRDQAAERLREADL

SEQ ID NO: 836768 - protein, 280 aa, Homo sapiens
VSRGAFIGTAAPGAHTLVFSCPSPGELLEESQMEATRLRQKAEELVKDNELLPPPSPSLGSFDPLAELTGKDSNVTASPTAPACPSDKPAPVQKPPSSGTSSEFEVVTPEEQNSPESSSHANAMALGPLPREDGNLMLHLQRLETTLSVCAEEPDHGQLFTHLGRMALEFNRLASKVHKNEQRTSILQTLCEQLRKENEALKAKLDKGLEQRDQAAERLREENLELKKLLMSNGNKEGASGRPGSPKMEGTGKKAVAGQQQKPSQMGEGHASHVRRGAPA

SEQ ID NO: 836769 - protein, 148 aa, Homo sapiens
MEGRGPYRIYDPGGSVPSGEASAAFERLVKENSRLKEKMQGIKMLGELLEESQMEATRLRQKAEELVKDNELLPPPSPSLGSFDPLAELTGKDSNVTASPTAPACPSDKPAPVQKPPSSVSFIWSHGWRLPGWTSSPTDRYKNMKKEG

SEQ ID NO: 836770 - protein, 636 aa, Homo sapiens; identical to SEQ ID NO: 836755

SEQ ID NO: 836771 - protein, 108 aa, Homo sapiens
MLRGVTFTVAGLPNSAAFSRFQQRASVTAGKVPEVVALGAAEKKVKMLEQQRSELLEVNKQWDQHFRSMKQQYEQKISELCQNLPCMQKHGDDWVFVLDLSAGEPGLT

SEQ ID NO: 836772 - protein, 615 aa, Homo sapiens
VSRGAFIGTAAPGAHTLVFSCPSPGELLEESQMEATRLRQKAEELVKDNELLPPPSPSLGSFDPLAELTGKDSNVTASPTAPACPSDKPAPVQKPPSSGTSSEFEVVTPEEQNSPESSSHANAMALGPLPREDGNLMLHLQRLETTLSVCAEEPDHGQLFTHLGRMALEFNRLASKVHKNEQRTSILQTLCEQLRKENEALKAKLDKGLEQRDQAAERLREENLELKKLLMSNGNKEGASGRPGSPKMEGTGKKAVAGQQQASVTAGKVPEVVALGAAEKKVKMLEQQRSELLEVNKQWDQHFRSMKQQYEQKITELRQKLADLQKQVTDLEAEREQKQRDFDRKLLLAKSKIEMEETDKEQLTAEAKELRQKVKYLQDQLSPLTRQREYQEKEIQRLNKALEEALSIQTPPSSPPTAFGSPEGAGALLRKQELVTQNELLKQQVKIFEEDFQRERSDRERMNEEKEELKKQVEKLQAQVTLSNAQLKAFKDEEKAREALRQQKRKAKASGERYHVEPHPEHLCGAYPYAYPPMPAMVPHHGFEDWSQIRYPPPPMAMEHPPPLPNSRLFHLPEYTWRLPCGGVRNPNQSSQVMDPPTARPTEPESPKNDREGPQ

SEQ ID NO: 836773 - protein, 636 aa, Homo sapiens; identical to SEQ ID NO: 836755

SEQ ID NO: 836774 - protein, 334 aa, Homo sapiens
VLRSSCSYDVPPSTLRVLYILASHTPLCLCTQITELRQKLADLQKQVTDLEAEREQKQRDFDRKLLLAKSKIEMEETDKEQLTAEAKELRQKVKYLQDQLSPLTRQREYQEKEIQRLNKALEEALSIQTPPSSPPTAFGSPEGAGALLRKQELVTQNELLKQQVKIFEEDFQRERSDRERMNEEKEELKKQVEKLQAQVTLSNAQLKAFKDEEKAREALRQQKRKAKASGERYHVEPHPEHLCGAYPYAYPPMPAMVPHHGFEDWSQIRYPPPPMAMEHPPPLPNSRLFHLPEYTWRLPCGGVRNPNQSSQVMDPPTARPTEPESPKNDREGPQ

SEQ ID NO: 836775 - protein, 269 aa, Homo sapiens
DAWVAHASMEETDKEQLTAEAKELRQKVKYLQDQLSPLTRQREYQEKEIQRLNKALEEALSIQTPPSSPPTAFGSPEGAGALLRKQELVTQNELLKQQVKIFEEDFQRERSDRERMNEEKEELKKQVEKLQAQVTLSNAQLKAFKDEEKAREALRQQKRKAKASGERYHVEPHPEHLCGAYPYAYPPMPAMVPHHGFEDWSQIRYPPPPMAMEHPPPLPNSRLFHLPEYTWRLPCGGVRNPNQSSQVMDPPTARPTEPESPKNDREGPQ

SEQ ID NO: 836776 - protein, 634 aa, Homo sapiens
MEGRGPYRIYDPGGSVPSGEASAAFERLVKENSRLKEKMQGIKMLGELLEESQMEATRLRQKAEELVKDNELLPPPSPSLGSFDPLAELTGKDSNVTASPTAPACPSDKPAPVQKPPSSGTSSEFEVVTPEEQNSPESSSHANAMALGPLPREDGNLMLHLQRLETTLSVCAEEPDHGQLFTHLGRMALEFNRLASKVHKNEQRTSILQTLCEQLRKENEALKAKLDKGLEQRDQAAERLREENLELKKLLMSNGNKEGASGRPGSPKMEGTGKKAVAGQQQASVTAGKVPEVVALGAAEKKVKMLEQQRSELLEVNKQWDQHFRSMKQQYEQKITELRQKLADLQKQVTDLEAEREQKQRDFDRKLLLAKSKIEMEETDKEQLTAEAKELRQKVKYLQDQLSPLTRQREYQEKEIQRLNKALEEALSIQTPPSSPPTAFGSPEGAGALLRKQELVTQNELLKQQVKIFEEDFQRERSDRERMNEEKEELKKQVEKLQAQVTLSNAQLKAFKDEEKAREALRQQKRKAKASGERYHVEPHPEHLCGAYPYAYPPMPAMVPHHGFEDWSQIRYPGSDGARREWLPDKLEGLMPLSLLSGDAQAEPKLGPPLNPHFMAPEATLIQESLCPLGFNGL

SEQ ID NO: 836777 - protein, 273 aa, Homo sapiens
PAFTAHVAAFCAHVLAFRAHVPAFRVHVPAFHAHVPAFHAHVLAFCAHVPAFRAHVPAFRAHVLAFHAHVPAFRAHVPAFCAHVTTFHACVPSLPCPCSLPCSYIQPSMPMYPDFCTHVAAFHDHIPAFGTQPASLQRANILFRGDEMGVLCSLLQAKARRQPFLQASGERYHVEPHPEHLCGAYPYAYPPMPAMVPHHGFEDWSQIRYPPPPMAMEHPPPLPNSRLFHLPEYTWRLPCGGVRNPNQSSQVMDPPTARPTEPESPKNDREGPQ

SEQ ID NO: 836778 - protein, 526 aa, Homo sapiens
MEGRGPYRIYDPGGSVPSGEASAAFERLVKENSRLKEKMQGIKMLGELLEESQMEATRLRQKAEELVKDNELLPPPSPSLGSFDPLAELTGKDSNVTASPTAPACPSDKPAPVQKPPSSGTSSEFEVVTPEEQNSPESSSHANAMALGPLPREDGNLMLHLQRLETTLSVCAEEPDHGQLFTHLGRMALEFNRLASKVHKNEQRTSILQTLCEQLRKENEALKAKLDKGLEQRDQAAERLREENLELKKLLMSNGNKEGASGRPGSPKMEGTGKKAVAGQQQASVTAGKVPEVVALGAAEKKVKMLEQQRSELLEVNKQWDQHFRSMKQQYEQKITELRQKLADLQKQVTDLEAEREQKQRDFDRKLLLAKSKIEMEETDKEQLTAEAKELRQKVKYLQDQLSPLTRQREYQEKEIQRLNKALEEALSIQTPPSSPPTAFGSPEGAGALLRKQELVTQNELLKQQVKIFEEDFQRERSDRERMNEEKEELKKQVEKLQAQVTLSNAQKPSQMGEGHASHVRRGAPA

SEQ ID NO: 836779 - protein, 114 aa, Homo sapiens
IGRVACQSPGTFPGVGRPGQAPGTSSSSARVPCPRPGALGVLRGAGALPGPLPRPWIRGWTQQAGRCVPKLPVLGQAGTTAGAELPSWKGEDRTGSTTLGAACPQERHPQLLSA

SEQ ID NO: 836780 - protein, 148 aa, Homo sapiens; identical to SEQ ID NO: 836769

SEQ ID NO: 836781 - protein, 114 aa, Homo sapiens; identical to SEQ ID NO: 836779

SEQ ID NO: 836782 - protein, 69 aa, Homo sapiens
PLIARVDRLIWLAERVPSSLTAPCASLPKLPLGRRGRPSPIEEDRSSVKGIRVLRSPARTSKQALKVHL

SEQ ID NO: 836783 - protein, 323 aa, Homo sapiens
MKPSSQPVISLDPLPCILHQIGSPPTLRLPKTLNSSSVILTERHPLQTNAAFIYSPCGSLGNTRIISEEYIKWLTGYCKAYFYGLRVKLLEPVPVSVTRCSFRVNENTHNLQIHAGDILKFLKKKKPEDAFCVVGITMIDLYPRDSWNFVFGQASLTDGVGIFSFARYGSDFYSMHYKGKVKKLKKTSSSDYSIFDNYYIPEITSVLLLRSCKTLTHEIGHIFGLRHCQWLACLMQGSNHLEEADRRPLNLCPICLHKLQCAVGFSIVERYKALVRWIDDESSDTPGATPEHSHEDNGNLPKPVEAFKEWKEWIIKCLAVLQK

SEQ ID NO: 836784 - protein, 323 aa, Homo sapiens; identical to SEQ ID NO: 836783

SEQ ID NO: 836785 - protein, 323 aa, Homo sapiens; identical to SEQ ID NO: 836783

SEQ ID NO: 836786 - protein, 323 aa, Homo sapiens; identical to SEQ ID NO: 836783

SEQ ID NO: 836787 - protein, 323 aa, Homo sapiens; identical to SEQ ID NO: 836783

SEQ ID NO: 836788 - protein, 323 aa, Homo sapiens; identical to SEQ ID NO: 836783

SEQ ID NO: 836789 - protein, 323 aa, Homo sapiens; identical to SEQ ID NO: 836783

SEQ ID NO: 836790 - protein, 148 aa, Homo sapiens
MKPSSQPVISLDPLPCILHQIGSPPTLRLPKTLNSSSVILTERHPLQTNAAFIYSPCGSLGNTRIISEEYIKWLTGYCKAYFYGLRVKLLEPVPVSVTRCSFRVNENTHNLQIHAGDILKFLKKKKPEDAFCVVGITMIDLYPENIFK

SEQ ID NO: 836791 - protein, 265 aa, Homo sapiens
MKPSSQPVISLDPLPCILHQIGSPPTLRLPKTLNSSSVILTERHPLQTNAAFIYSPCGDILKFLKKKKPEDAFCVVGITMIDLYPRDSWNFVFGQASLTDGVGIFSFARYGSDFYSMHYKGKVKKLKKTSSSDYSIFDNYYIPEITSVLLLRSCKTLTHEIGHIFGLRHCQWLACLMQGSNHLEEADRRPLNLCPICLHKLQCAVGFSIVERYKALVRWIDDESSDTPGATPEHSHEDNGNLPKPVEAFKEWKEWIIKCLAVLQK

SEQ ID NO: 836792 - protein, 103 aa, Homo sapiens
MQIIRHSEQTLKTALISKNPVLVSQYEKLDAGEQRLMNEAFQPASDLFGPITLHSPSDWITSHPEAPQDFEQFFSDPYRSHGQHKTTVTHKPGNPQATVTQKY

SEQ ID NO: 836793 - protein, 161 aa, Homo sapiens
MPLKPAACRGRSHTGDPSDAGASVALENRAAEPPRAQARNRRLRGWTAGACSPLATLYSGRGGSRPLNSSSAPAQAAARSGAWHGWVVSWAGPTGRARRSGAARGVRGVAPVGVAWRSAKGRGAHAREGCRGWVVSRPVGSGRFAGAVRAGPGPLGRVAGS

SEQ ID NO: 836794 - protein, 69 aa, Homo sapiens; identical to SEQ ID NO: 836782

SEQ ID NO: 836795 - protein, 323 aa, Homo sapiens; identical to SEQ ID NO: 836783

SEQ ID NO: 836796 - protein, 323 aa, Homo sapiens; identical to SEQ ID NO: 836783

SEQ ID NO: 836797 - protein, 323 aa, Homo sapiens; identical to SEQ ID NO: 836783

SEQ ID NO: 836798 - protein, 323 aa, Homo sapiens; identical to SEQ ID NO: 836783

SEQ ID NO: 836799 - protein, 186 aa, Homo sapiens [sequence omitted]

SEQ ID NO: 836800 - protein, 397 aa, Homo sapiens
MGACLPRSRCRNNYGTSAKKINKEEAASSVVRRTPAALVLRGSEKTLECWVDNGWKSEVKRFQAKPCGSPFGSPLTLCNFFAFKSGDHLVLSRVYGVPPKGTFEDEVLRDDSLYRRDTDLQIKQQFIYSPCGSLGNTRIISEEYIKWLTGYCKAYFYGLRVKLLEPVPVSVTRCSFRVNENTHNLQIHAGDILKFLKKKKPEDAFCVVGITMIDLYPRDSWNFVFGQASLTDGVGIFSFARYGSDFYSMHYKGKVKKLKKTSSSDYSIFDNYYIPEITSVLLLRSCKTLTHEIGHIFGLRHCQWLACLMQGSNHLEEADRRPLNLCPICLHKLQCAVGFSIVERYKALVRWIDDESSDTPGATPEHSHEDNGNLPKPVEAFKEWKEWIIKCLAVLQK

SEQ ID NO: 836801 - protein, 186 aa, Homo sapiens [sequence omitted]

SEQ ID NO: 836802 - protein, 108 aa, Homo sapiens
SSSRRKPPLVPQAPAPGWKGRGGGAVNKVVYDDHGSQEEEDGDVEETQESEDNEEHEMEEDEADSDYLEELEDDDDASYCTESSFRSHSTYSSTPGTHPAQLLQTPSP

SEQ ID NO: 836803 - protein, 468 aa, Homo sapiens
MESAAALHFSRPASLLLLLLSLCALVSAQFIVVGPTDPILATVGENTTLRCHLSPEKNAEDMEVRWFRSQFSPAVFVYKGGRERTEEQMEEYRGRTTFVSKDISRGSVALVIHNITAQENGTYRCYFQEGRSYDEAILHLVVAGLGSKPLISMRGHEDGGIRLECISRGWYPKPLTVWRDPYGGVAPALKEVSMPDADGLFMVTTAVIIRDKSVRNMSCSINNTLLGQKKESVIFIPGYFLPSGLPIAVCIYWINKLQKEKKILSGEKEFERETREIALKELEKERVQKEEELQVKEKLQEELRWRRTFLHAVDVVLDPDTAHPDLFLSEDRRSVRRCPFRHLGESVPDNPERFDSQPCVLGRESFASGKHYWEVEVENVIEWTVGVCRDSVERKGEVLLIPQNGFWTLEMHKGQYRAVSSPDRILPLKESLCRVGVFLDYEAGDVSFYNMRDRSHIYTCPRSAFSRA

SEQ ID NO: 836804 - protein, 530 aa, Homo sapiens
MESAAALHFSRPASLLLLLLSLCALVSAQFIVVGPTDPILATVGENTTLRCHLSPEKNAEDMEVRWFRSQFSPAVFVYKGGRERTEEQMEEYRGRTTFVSKDISRGSVALVIHNITAQENGTYRCYFQEGRSYDEAILHLVVAGLGSKPLISMRGHEDGGIRLECISRGWYPKPLTVWRDPYGGVAPALKEVSMPDADGLFMVTTAVIIRDKSVRNMSCSINNTLLGQKKESVIFIPESFMPSVSPCAVALPIIVVILMIPIAVCIYWINKLQKEKKILSGEKEFERETREIALKELEKERVQKEEELQVKEEDNFKQAIAMAEEPFLHAVDVVLDPDTAHPDLFLSEDRRSVRRCPFRHLGESVPDNPERFDSQPCVLGRESFASGKHYWEVEVENVIEWTVGVCRDSVERKGEVLLIPQNGFWTLEMHKGQYRAVSSPDRILPLKESLCRVGVFLDYEAGDVSFYNMRDRSHIYTCPRSAFSVPVRPFFRLGCEDSPIFICPALTGANGVTVPEEGLTLHRVGTHQSL

SEQ ID NO: 836805 - protein, 604 aa, Homo sapiens
WKPRRPDFVSCISKHGDLGEREEQFFLLFWEGLRLVVPVPLGRLERRGTTGESSRTSGEKKKQRLILEAQFIVVGPTDPILATVGENTTLRCHLSPEKNAEDMEVRWFRSQFSPAVFVYKGGRERTEEQMEEYRGRTTFVSKDISRGSVALVIHNITAQENGTYRCYFQEGRSYDEAILHLVVAELLEAEVTEKSSQKQKVKSKTCLFEVGVDTPISRLGSKPLISMRGHEDGGIRLECISRGWYPKPLTVWRDPYGGVAPALKEVSMPDADGLFMVTTAVIIRDKSVRNMSCSINNTLLGQKKESVIFIPESFMPSVSPCAVALPIIVVILMIPIAVCIYWINKLQKEKKILSGEKEFERETREIALKELEKERVQKEEELQVKEEDNFKQAIAMAEEPFLHAVDVVLDPDTAHPDLFLSEDRRSVRRCPFRHLGESVPDNPERFDSQPCVLGRESFASGKHYWEVEVENVIEWTVGVCRDSVERKGEVLLIPQNGFWTLEMHKGQYRAVSSPDRILPLKESLCRVGVFLDYEAGDVSFYNMRDRSHIYTCPRSAFSVPVRPFFRLGCEDSPIFICPALTGANGVTVPEEGLTLHRVGTHQSL

SEQ ID NO: 836806 - protein, 563 aa, Homo sapiens
MESAAALHFSRPASLLLLLLSLCALVSAQFIVVGPTDPILATVGENTTLRCHLSPEKNAEDMEVRWFRSQFSPAVFVYKGGRERTEEQMEEYRGRTTFVSKDISRGSVALVIHNITAQENGTYRCYFQEGRSYDEAILHLVVAELLEAEVTEKSSQKQKVKSKTCLFEVGVDTPISRLGSKPLISMRGHEDGGIRLECISRGWYPKPLTVWRDPYGGVAPALKEVSMPDADGLFMVTTAVIIRDKSVRNMSCSINNTLLGQKKESVIFIPESFMPSVSPCAVALPIIVVILMIPIAVCIYWINKLQKEKKILSGEKEFERETREIALKELEKERVQKEEELQVKEEDNFKQAIAMAEEPFLHAVDVVLDPDTAHPDLFLSEDRRSVRRCPFRHLGESVPDNPERFDSQPCVLGRESFASGKHYWEVEVENVIEWTVGVCRDSVERKGEVLLIPQNGFWTLEMHKGQYRAVSSPDRILPLKESLCRVGVFLDYEAGDVSFYNMRDRSHIYTCPRSAFSVPVRPFFRLGCEDSPIFICPALTGANGVTVPEEGLTLHRVGTHQSL

SEQ ID NO: 836807 - protein, 527 aa, Homo sapiens
MESAAALHFSRPASLLLLLLSLCALVSAQFIVVGPTDPILATVGENTTLRCHLSPEKNAEDMEVRWFRSQFSPAVFVYKGGRERTEEQMEEYRGRTTFVSKDISRGSVALVIHNITAQENGTYRCYFQEGRSYDEAILHLVVAGLGSKPLISMRGHEDGGIRLECISRGWYPKPLTVWRDPYGGVAPALKEVSMPDADGLFMVTTAVIIRDKSVRNMSCSINNTLLGQKKESVIFIPESFMPSVSPCAVALPIIVVILMIPIAVCIYWINKLQKEKKILSGEKEFERETREIALKELEKERVQKEEELQVKEKLQEELRWRRTFLHAVDVVLDPDTAHPDLFLSEDRRSVRRCPFRHLGESVPDNPERFDSQPCVLGRESFASGKHYWEVEVENVIEWTVGVCRDSVERKGEVLLIPQNGFWTLEMHKGQYRAVSSPDRILPLKESLCRVGVFLDYEAGDVSFYNMRDRSHIYTCPRSAFSVPVRPFFRLGCEDSPIFICPALTGANGVTVPEEGLTLHRVGTHQSL

SEQ ID NO: 836808 - protein, 563 aa, Homo sapiens; identical to SEQ ID NO: 836806

SEQ ID NO: 836809 - protein, 284 aa, Homo sapiens
WKPRRPDFVSCISKHGDLGEREEQFFLLFWEGLRLVVPVPLGRLERRGTTGESSRTSGEKKKQRLILEGLLSLPALGAHGISCCPALLPASLPPPPPPQPVCTGLSVRRCPFRHLGESVPDNPERFDSQPCVLGRESFASGKHYWEVEVENVIEWTVGVCRDSVERKGEVLLIPQNGFWTLEMHKGQYRAVSSPDRILPLKESLCRVGVFLDYEAGDVSFYNMRDRSHIYTCPRSAFSVPVRPFFRLGCEDSPIFICPALTGANGVTVPEEGLTLHRVGTHQSL

SEQ ID NO: 836810 - protein, 263 aa, Homo sapiens
MALASVLERPLPVNQRGFFGLGGRADLLDLGPGSLSDGLSLAAPGWGVPEEPGIEMLHGTTTLAFKFRHGVIVAADSRATAGAYIASQTVKKVIEINPYLLGTMAGGAADCSFWERLLARQCRIYELRNKERISVAAASKLLANMVYQYKGMGLSMGTMICGWDKRGPGLYYVDSEGNRISGATFSVGSGSVYAYGVMDRGYSYDLEVEQAYDLARRAIYQATYRDAYSGGAVNLYHVREDGWIRVSSDNVADLHEKYSGSTP

SEQ ID NO: 836811 - protein, 263 aa, Homo sapiens; identical to SEQ ID NO: 836810

SEQ ID NO: 836812 - protein, 263 aa, Homo sapiens; identical to SEQ ID NO: 836810

SEQ ID NO: 836813 - protein, 263 aa, Homo sapiens; identical to SEQ ID NO: 836810

SEQ ID NO: 836814 - protein, 160 aa, Homo sapiens
MAGGAADCSFWERLLARQCRIYELRNKERISVAAASKLLANMVYQYKGMGLSMGTMICGWDKRGPGLYYVDSEGNRISGATFSVGSGSVYAYGVMDRGYSYDLEVEQAYDLARRAIYQATYRDAYSGGAVNLYHVREDGWIRVSSDNVADLHEKYSGSTP

SEQ ID NO: 836815 - protein, 238 aa, Homo sapiens
MALASVLERPLPVNQRGFFGLGGRADLLDLGPGSLSDGLSLAAPGWGVPEEPGIEMLHGTTTLAFKFRHGVIVAADSRATAGAADCSFWERLLARQCRIYELRNKERISVAAASKLLANMVYQYKGMGLSMGTMICGWDKRGPGLYYVDSEGNRISGATFSVGSGSVYAYGVMDRGYSYDLEVEQAYDLARRAIYQATYRDAYSGGAVNLYHVREDGWIRVSSDNVADLHEKYSGSTP

SEQ ID NO: 836816 - protein, 291 aa, Homo sapiens
MALASVLERPLPVNQRGFFGLGGRADLLDLGPGSLSDGLSLAAPGWGVPEEPGIEMLHGTTTLAFKFRHGVIVAADSRATAGAYIASQTVKKVIEINPYLLGTMAGGAADCSFWERLLARQCRIYELRNKERISVAAASKLLANMVYQYKGMGLSMGTMICGWDKRGPVSEVLCLKPKSFGMYLFCGCAERIGNMAGLYYVDSEGNRISGATFSVGSGSVYAYGVMDRGYSYDLEVEQAYDLARRAIYQATYRDAYSGGAVNLYHVREDGWIRVSSDNVADLHEKYSGSTP

SEQ ID NO: 836817 - protein, 110 aa, Homo sapiens [sequence omitted]

SEQ ID NO: 836818 - protein, 263 aa, Homo sapiens; identical to SEQ ID NO: 836810

SEQ ID NO: 836819 - protein, 263 aa, Homo sapiens; identical to SEQ ID NO: 836810

SEQ ID NO: 836820 - protein, 160 aa, Homo sapiens; identical to SEQ ID NO: 836814

SEQ ID NO: 836821 - protein, 160 aa, Homo sapiens; identical to SEQ ID NO: 836814

SEQ ID NO: 836822 - protein, 118 aa, Homo sapiens
MAYELDIKGVIFFFFLLTSSPFPGLYYVDSEGNRISGATFSVGSGSVYAYGVMDRGYSYDLEVEQAYDLARRAIYQATYRDAYSGGAVNLYHVREDGWIRVSSDNVADLHEKYSGSTP

SEQ ID NO: 836823 - protein, 110 aa, Homo sapiens [sequence omitted]

SEQ ID NO: 836824 - protein, 117 aa, Homo sapiens
GEKERGMACLYPSHVAIHQVLGEWEPVQGGKSSENDKWTMSDPGAEAPTCSRAASGVDKEQQGRLRPGVLGSTVSSHSLGHQNLSKDKTQCLWQQRARGIMCFRRKKGLYPMETVYS

SEQ ID NO: 836825 - protein, 200 aa, Homo sapiens
EPRWLNRNSSSLQLPVRPTQKILLWSRIKDLAHQFTQVQRDMFTLEDTLLGYLADDLTWCGEFNTSKINYQSCPDWRKDCSNNPVSVFWKTVSRRFAEAACDVVHVMLNGSRSKIFDKNSTFGSVEVHNLQPEKVQTLEAWVIHGGREDSRDLCQDPTIKELESIISKRNIQFSCKNIYRPDKFLQCVKNPEDSSCTSEI

SEQ ID NO: 836826 - protein, 300 aa, Homo sapiens
MANCEFSPVSGDKPCCRLSRRAQLCLGVSILVLILVVVLAVVVPRWRQQWSGPGTTKRFPETVLARCVKYTEIHPEMRHVDCQSVWDAFKGAFISKHPCNITEEDYQPLMKLGTQTVPCNKILLWSRIKDLAHQFTQVQRDMFTLEDTLLGYLADDLTWCGEFNTSKINYQSCPDWRKDCSNNPVSVFWKTVSRRFAEAACDVVHVMLNGSRSKIFDKNSTFGSVEVHNLQPEKVQTLEAWVIHGGREDSRDLCQDPTIKELESIISKRNIQFSCKNIYRPDKFLQCVKNPEDSSCTSEI

SEQ ID NO: 836827 - protein, 122 aa, Homo sapiens
MANCEFSPVSGDKPCCRLSRRAQLCLGVSILVLILVVVLAVVVPRWRQQWSGPGTTKRFPETVLARCVKYTEIHPEMRHVDCQSVWDAFKGAFISKHPCNITEEDYQPLMKLGTQTVPCNKK

SEQ ID NO: 836828 - protein, 280 aa, Homo sapiens
MANCEFSPVSGDKPCCRLSRRAQLCLGVSILVLILVVVLAVVVPRWRQQWSGPGTTKRFPETVLARCVKYTEIHPEMRHVDCQSVWDAFKGAFISKHPCNITEEDYQPLMKLGTQTVPCNKILLWSRIKDLAHQFTQVQRDMFTLEDTLLGYLADDLTWCGEFNTSKINYQSCPDWRKDCSNNPVSVFWKTVSRRFAEAACDVVHVMLNGSRSKIFDKNSTFGSVEVHNLQPEKVQTLEAWVIHGGREDSRDLCQDPTIKELESIISKRNIQFSCKNIYR

SEQ ID NO: 836829 - protein, 300 aa, Homo sapiens; identical to SEQ ID NO: 836826

SEQ ID NO: 836830 - protein, 294 aa, Homo sapiens
MANCEFSPVSGDKPCCRLSRRAQLCLGVSILVLILVVVLAVVVPRWRQQWSGPGTTKRFPETVLARCVKYTEIHPEMRHVDCQSVWDAFKGAFISKHPCNITEEDYQPLMKLGTQTVPCNKILLWSRIKDLAHQFTQVQRDMFTLEDTLLGYLADDLTWCEINYQSCPDWRKDCSNNPVSVFWKTVSRRFAEAACDVVHVMLNGSRSKIFDKNSTFGSVEVHNLQPEKVQTLEAWVIHGGREDSRDLCQDPTIKELESIISKRNIQFSCKNIYRPDKFLQCVKNPEDSSCTSEI

SEQ ID NO: 836831 - protein, 122 aa, Homo sapiens
MSRMQIVRYSEQTLKIAVISKNPVLVSQYEKVDAGEQRLMNEAFQPASDLFGPCILHQIGSPPTLRPPKTLNSSSVILTERYPLQTNAVFIYGPLDLYEAPELSVKNILNGSRATVKHISIA

SEQ ID NO: 836832 - protein, 177 aa, Homo sapiens
VERDEDVEGRTWRKPRGLAMGRRMSRVSGVEACWVRAVRRCCQSWAGQPGRRGGRQSRSVERDEDVGGTDVAEAAGTAGAECLWGAREAFPEAPGGRRGEARVPGEALLHPQPEPGLCLHGPEPTVRVAVGNQLGWPTSPGWPEMFWFWDHSVPGLQPTTVTILCAPCPSSPAASLD

SEQ ID NO: 836833 - protein, 204 aa, Homo sapiens
RGVARAGREWGGAQRACAMERRVARREGAWRQWAWRSAKRRGAHAREGCRGARVSGVEACWVRAVRRCCQSWAGQPGRRGGRQSRSVERDEDVGGTDVAEAAGTAGAECLWGAREAFPEAPGGRRGEARVPGEALLHPQPEPGLCLHGPEPTVRVAVGNQLGWPTSPGWPEMFWFWDHSVPGLQPTTVTILCAPCPSSPAASLD

SEQ ID NO: 836834 - protein, 204 aa, Homo sapiens; identical to SEQ ID NO: 836833

SEQ ID NO: 836835 - protein, 204 aa, Homo sapiens; identical to SEQ ID NO: 836833

SEQ ID NO: 836836 - protein, 204 aa, Homo sapiens; identical to SEQ ID NO: 836833

SEQ ID NO: 836837 - protein, 204 aa, Homo sapiens; identical to SEQ ID NO: 836833

SEQ ID NO: 836838 - protein, 204 aa, Homo sapiens; identical to SEQ ID NO: 836833

SEQ ID NO: 836839 - protein, 204 aa, Homo sapiens; identical to SEQ ID NO: 836833

SEQ ID NO: 836840 - protein, 204 aa, Homo sapiens; identical to SEQ ID NO: 836833

SEQ ID NO: 836841 - protein, 119 aa, Homo sapiens [sequence omitted]

SEQ ID NO: 836842 - protein, 204 aa, Homo sapiens; identical to SEQ ID NO: 836833

SEQ ID NO: 836843 - protein, 119 aa, Homo sapiens [sequence omitted]

SEQ ID NO: 836844 - protein, 119 aa, Homo sapiens [sequence omitted]

SEQ ID NO: 836845 - protein, 204 aa, Homo sapiens; identical to SEQ ID NO: 836833

SEQ ID NO: 836846 - protein, 68 aa, Homo sapiens
RGVARAGREWGGAQRACAMERRVARREGAWRQWAWRSAKRRGAHAREGCRGLVVEHLTLFKRKDENST

SEQ ID NO: 836847 - protein, 204 aa, Homo sapiens; identical to SEQ ID NO: 836833

SEQ ID NO: 836848 - protein, 204 aa, Homo sapiens; identical to SEQ ID NO: 836833

SEQ ID NO: 836849 - protein, 1170 aa, Homo sapiens
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPINGGWGPWSPWDICSVTCGGGVQKRSRLCNNPTPQFGGKDCVGDVTENQICNKQDCPIDGCLSNPCFAGVKCTSYPDGSWKCGACPPGYSGNGIQCTDVDECKEVPDACFNHNGEHRCENTDPGYNCLPCPPRFTGSQPFGQGVEHATANKQVCKPRNPCTDGTHDCNKNAKCNYLGHYSDPMYRCECKPGYAGNGIICGEDTDLDGWPNENLVCVANATYHCKKDNCPNLPNSGQEDYDKDGIGDACDDDDDNDKIPDDRDNCPFHYNPAQYDYDRDDVGDRCDNCPYNHNPDQADTDNNGEGDACAADIDGDGILNERDNCQYVYNVDQRDTDMDGVGDQCDNCPLEHNPDQLDSDSDRIGDTCDNNQDIDEDGHQNNLDNCPYVPNANQADHDKDGKGDACDHDDDNDGIPDDKDNCRLVPNPDQKDSDGDGRGDACKDDFDHDSVPDIDDICPENVDISETDFRRFQMIPLDPKGTSQNDPNWVVRHQGKELVQTVNCDPGLAVGYDEFNAVDFSGTFFINTERDDDYAGFVFGYQSSSRFYVVMWKQVTQSYWDTNPTRAQGYSGLSVKVVNSTTGPGEHLRNALWHTGNTPGQVRTLWHDPRHIGWKDFTAYRWRLSHRPKTGFIRVVMYEGKKIMADSGPIYDKTYAGGRLGLFVFSQEMVFFSDLKYECRDP

SEQ ID NO: 836850 - protein, 1170 aa, Homo sapiens; identical to SEQ ID NO: 836849

SEQ ID NO: 836851 - protein, 1407 aa, Homo sapiens
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPINGGWGPWSPWDICSVTCGGGVQKRSRLCNNPTPQFGGKDCVGDVTENQICNKQDCPIGEPLQPRMKRPRSFALLLNAAVSIRGDSSLVSPERFDCSKMQVDNIIPTSYRFPIPYNILHCVEVPSMAVWQLRPTIYCDCLSLLVSDGCLSNPCFAGVKCTSYPDGSWKCGACPPGYSGNGIQCTDVDECKEVPDACFNHNGEHRCENTDPGYNCLPCPPRFTGSQPFGQGVEHATANKQVQSTRRVNQRTGELSLTKITGSGRNVISTLHQKKKGEEMNVRSSFRNVIRKSMVNPAGEKQSSIFKNAALEYVVSRWTCKRLGAEQNSRKINIKQSLLIASGRMGRDRGNPHSSKWSLCLLRDDRDLDSCFHDISGFSKALCNSSMVYPQVCKPRNPCTDGTHDCNKNAKCNYLGHYSDPMYRCECKPGYAGNGIICGEDTDLDGWPNENLVCVANATYHCKKDNCPNLPNSGQEDYDKDGIGDACDDDDDNDKIPDDRDNCPFHYNPAQYDYDRDDVGDRCDNCPYNHNPDQADTDNNGEGDACAADIDGDGILNERDNCQYVYNVDQRDTDMDGVGDQCDNCPLEHNPDQLDSDSDRIGDTCDNNQDIDEDGHQNNLDNCPYVPNANQADHDKDGKGDACDHDDDNDGIPDDKDNCRLVPNPDQKDSDGDGRGDACKDDFDHDSVPDIDDICPENVDISETDFRRFQMIPLDPKGTSQNDPNWVVRHQGKELVQTVNCDPGLAVGYDEFNAVDFSGTFFINTERDDDYAGFVFGYQSSSRFYVVMWKQVTQSYWDTNPTRAQGYSGLSVKVVNSTTGPGEHLRNALWHTGNTPGQVRTLWHDPRHIGWKDFTAYRWRLSHRPKTGFIRVVMYEGKKIMADSGPIYDKTYAGGRLGLFVFSQEMVFFSDLKYECRDP

SEQ ID NO: 836852 - protein, 1170 aa, Homo sapiens; identical to SEQ ID NO: 836849

SEQ ID NO: 836853 - protein, 1152 aa, Homo sapiens
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPINGGWGPWSPWDICSVTCGGGVQKRSRLCNNPTPQFGGKDCVGDVTENQICNKQDCPIDGCLSNPCFAGVKCTSYPDGSWKCGACPPGYSGNGIQCTDVDECKEVPDACFNHNGEHRCENTDPGYNCLPCPPRFTGSQPFGQGVEHATANKQVCKPRNPCTDGTHDCNKNAKCNYLGHYSDPMYRCECKPGYAGNGIICGEDTDLDGWPNENLVCVANATYHCKKDNCPNLPNSGQEDYDKDGIGDACDDDDDNDKIPDDRDNCPFHYNPAQYDYDRDDVGDRCDNCPYNHNPDQADTDNNGEGDACAADIDGDGILNERDNCQYVYNVDQRDTDMDGVGDQCDNCPLEHNPDQLDSDSDRIGDTCDNNQDIDEDGHQNNLDNCPYVPNANQADHDKDGKGDACDHDDDNDGIPDDKDNCRLVPNPDQKDSDGDGRGDACKDDFDHDSVPDIDDICPENVDISETDFRRFQMIPLDPKGTSQNWLWALLPGYDEFNAVDFSGTFFINTERDDDYAGFVFGYQSSSRFYVVMWKQVTQSYWDTNPTRAQGYSGLSVKVVNSTTGPGEHLRNALWHTGNTPGQVRTLWHDPRHIGWKDFTAYRWRLSHRPKTGFIRVVMYEGKKIMADSGPIYDKTYAGGRLGLFVFSQEMVFFSDLKYECRDP

SEQ ID NO: 836854 - protein, 1102 aa, Homo sapiens
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPINGGWGPWSPWDICSVTCGGGVQKRSRLCNNPTPQFGGKDCVGDVTENQICNKQDCPIDGCLSNPCFAGVKCTSYPDGSWKCGACPPGYSGNGIQCTDVDECKEVPDACFNHNGEHRCENTDPGYNCLPCPPRFTGSQPFGQGVEHATANKQVCKPRNPCTDGTHDCNKNAKCNYLGHYSDPMYRCECKPGYAGNGIICGEDTDLDGWPNENLVCVANATYHCKKDNCPNLPNSGQEDYDKDGIGDACDDDDDNDKIPDDRDNCPFHYNPAQYDYDRDDVGDRCDNCPYNHNPDQADTDNNGEGDACAADIDGDGILNERDNCQYVYNVDQRDTDMDGVGDQCDNCPLEHNPDQLDSDSDRIGDTCDNNQDIDEDGHQNNLDNCPYVPNANQADHDKDGKGDACDHDDDNDGIPDDKDNCRLVPNPDQKDSDGDGRGDACKDDFDHDSVPDIDDICPENVDISETDFRRFQMIPLDPKGTSQNDPNWVVRHQGKELVQTVNCDPGLAVGYDEFNAVDFSGTFFINTERDDDYAGFVFGYQSSSRFYVVMWKQVTQSYWDTNPTRAQGYSGLSVKVVNSTTGPGEHLRNALWHTGNTPGQKQSPGTERELMGA

SEQ ID NO: 836855 - protein, 1170 aa, Homo sapiens; identical to SEQ ID NO: 836849

SEQ ID NO: 836856 - protein, 533 aa, Homo sapiens [sequence omitted]

SEQ ID NO: 836857 - protein, 427 aa, Homo sapiens
MRDKFQIQDNCPFHYNPAQYDYDRDDVGDRCDNCPYNHNPDQADTDNNGEGDACAADIDGDGILNERDNCQYVYNVDQRDTDMDGVGDQCDNCPLEHNPDQLDSDSDRIGDTCDNNQDIDEDGHQNNLDNCPYVPNANQADHDKDGKGDACDHDDDNDGIPDDKDNCRLVPNPDQKDSDGDGRGDACKDDFDHDSVPDIDDICPENVDISETDFRRFQMIPLDPKGTSQNDPNWVVRHQGKELVQTVNCDPGLAVGYDEFNAVDFSGTFFINTERDDDYAGFVFGYQSSSRFYVVMWKQVTQSYWDTNPTRAQGYSGLSVKVVNSTTGPGEHLRNALWHTGNTPGQVRTLWHDPRHIGWKDFTAYRWRLSHRPKTGFIRVVMYEGKKIMADSGPIYDKTYAGGRLGLFVFSQEMVFFSDLKYECRDP

SEQ ID NO: 836858 - protein, 227 aa, Homo sapiens
EDPRHLAPIRSDQYYDLHLGLDLIVFAFLMGEDASCCHQGKELVQTVNCDPGLAVGYDEFNAVDFSGTFFINTERDDDYAGFVFGYQSSSRFYVVMWKQVTQSYWDTNPTRAQGYSGLSVKVVNSTTGPGEHLRNALWHTGNTPGQVRTLWHDPRHIGWKDFTAYRWRLSHRPKTGFIRVVMYEGKKIMADSGPIYDKTYAGGRLGLFVFSQEMVFFSDLKYECRDP

SEQ ID NO: 836859 - protein, 115 aa, Homo sapiens
MNKTSSKHINNCFGFLLKKHLLASVGKVPIPLCLCHRAGCYCEAISEQWTQKHFQACQRREDSLELANKTTLTSSFRNTGSRGQSTKGRAHTRDDCMKKIWRNCYMFGTKSFSGD

SEQ ID NO: 836860 - protein, 855 aa, Homo sapiens
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPINGGWGPWSPWDICSVTCGGGVQKRSRLCNNPTPQFGGKDCVGDVTENQICNKQDCPIDGCLSNPCFAGVKCTSYPDGSWKCGACPPGYSGNGIQCTDVDECKEVPDACFNHNGEHRCENTDPGYNCLPCPPRFTGSQPFGQGVEHATANKQVCKPRNPCTDGTHDCNKNAKCNYLGHYSDPMYRCECKPGYAGNGIICGEDTDLDGWPNENLVCVANATYHCKKDNCPNLPNSGQEDYDKDGIGDACDDDDDNDKIPDDRDNCPFHYNPAQYDYDRDDVGDRCDNCPYNHNPDQADTDNNGEGDACAADIDGDGILNERDNCQYVYNVDQRDTDMDGVGDQCDNCPLEHNPDQVGGWTPFRVFQ

SEQ ID NO: 836861 - protein, 539 aa, Homo sapiens
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPINGGWGPWSPWDICSVTCGGGVQKRSRLCNNPTPQFGGKDCVGDAQNLW

SEQ ID NO: 836862 - protein, 214 aa, Homo sapiens [sequence omitted]

SEQ ID NO: 836863 - protein, 235 aa, Homo sapiens
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSS

SEQ ID NO: 836864 - protein, 123 aa, Homo sapiens
YLHPSHQMKRLLPLRTQEAGCKSIYLKFSFCFLPATSVLLTLDNNVVNGSSPAIRTNYIGHKTKDLQAICGISCDELSSMVLELRGLRTIVTTLQDSIRKVVSGLCTQPVSMNPGRFIADGPK

SEQ ID NO: 836865 - protein, 1170 aa, Homo sapiens; identical to SEQ ID NO: 836849

SEQ ID NO: 836866 - protein, 1170 aa, Homo sapiens; identical to SEQ ID NO: 836849

SEQ ID NO: 836867 - protein, 1320 aa, Homo sapiens
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPINGGWGPWSPWDICSVTCGGGVQKRSRLCNNPTPQFGGKDCVGDVTENQICNKQDCPIDGCLSNPCFAGVKCTSYPDGSWKCGACPPGYSGNGIQCTDVDECKEVPDACFNHNGEHRCENTDPGYNCLPCPPRFTGSQPFGQGVEHATANKQVQSTRRVNQRTGELSLTKITGSGRNVISTLHQKKKGEEMNVRSSFRNVIRKSMVNPAGEKQSSIFKNAALEEVVSRWTCKRLGAEQNSRKINIKQSLLIASGRMGRDRGNPHSSKWSLCLLRDDRDLDSCFHDISGFSKALCNSSMVYPQVCKPRNPCTDGTHDCNKNAKCNYLGHYSDPMYRCECKPGYAGNGIICGEDTDLDGWPNENLVCVANATYHCKKDNCPNLPNSGQEDYDKDGIGDACDDDDDNDKIPDDRDNCPFHYNPAQYDYDRDDVGDRCDNCPYNHNPDQADTDNNGEGDACAADIDGDGILNERDNCQYVYNVDQRDTDMDGVGDQCDNCPLEHNPDQLDSDSDRIGDTCDNNQDIDEDGHQNNLDNCPYVPNANQADHDKDGKGDACDHDDDNDGIPDDKDNCRLVPNPDQKDSDGDGRGDACKDDFDHDSVPDIDDICPENVDISETDFRRFQMIPLDPKGTSQNDPNWVVRHQGKELVQTVNCDPGLAVGYDEFNAVDFSGTFFINTERDDDYAGFVFGYQSSSRFYVVMWKQVTQSYWDTNPTRAQGYSGLSVKVVNSTTGPGEHLRNALWHTGNTPGQVRTLWHDPRHIGWKDFTAYRWRLSHRPKTGFIRVVMYEGKKIMADSGPIYDKTYAGGRLGLFVFSQEMVFFSDLKYECRDP

SEQ ID NO: 836868 - protein, 1510 aa, Homo sapiens
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPSKCEVRCKGEHGQQLCPAGCLASAACSSVGHRAGRLPTRETNRSKVLQAQQLLLMKNKLTLFPSILSMCQRSRGFLNGLRRVYDKGGDLKVDLNLLPVVHLLTVNGGWGPWSPWDICSVTCGGGVQKRSRLCNNPTPQFGGKDCVGDVTENQICNKQDCPIGGATQPRMKRPRSFALLLNAAVSIRGDSSLVSPERFDCSKMQVDNIIPTSYRFPIPYNILHCVEVPSMAVWQLRPTIYCDCLSLLVSDGCLSNPCFAGVKCTSYPDGSWKCGACPPGYSGNGIQCTDVDECKEVPDACFNHNGEHRCENTDPGYNCLPCPPRFTGSQPFGQGVEHATANKQVQSTRRVNQRTGELSLTKITGSGRNVIYTLHQKKKGEEMNVRSSFRNVIRKSMVNPAGEKQSSIFKNAALEEVVSRWTCKRLGAEQNSRKINIKQSLLIASGRMGRDRGNPHSSKWSLCLLRDDRDLDSCFHDISGFSKALCNSSMVYPQVCKPRNPCTDGTHDCNKNAKCNYLGHYSDPMYRCECKPGYAGNGIICGEDTDLDGWPNENLVCVANATYHCKKDNCPNLPNSGQEDYDKDGIGDACDDDDDNDKIPDDRDNCPFHYNPAQYDYDRDDVGDRCDNCPYNHNPDQADTDNNGEGDACAADIDGDGILNERDNCQYVYNVDQRDTDMDGVGDQCDNCPLEHNPDQLDSDSDRIGDTCDNNQDIDEDGHQNNLDNCPYVPNANQADHDKDGKGDACDHDDDNDGIPDDKDNCRLVPNPDQKDSDGDGRGDACKDDFDHDSVPDIDDICPENVDISETDFRRFQMIPLDPKGTSQNDPNWVVRHQGKELVQTVNCDPGLAVGYDEFNAVDFSGTFFINTERDDDYAGFVFGYQSSSRFYVVMWKQVTQSYWDTNPTRAQGYSGLSVKVVNSTTGPGEHLRNALWHTGNTPGQVRTLWHDPRHIGWKDFTAYRWRLSHRPKTGFIRVVMYEGKKIMADSGPIYDKTYAGGRLGLFVFSQEMVFFSDLKYECRDP

SEQ ID NO: 836869 - protein, 1102 aa, Homo sapiens; identical to SEQ ID NO: 836854

SEQ ID NO: 836870 - protein, 1114 aa, Homo sapiens
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPINGGWGPWSPWDICSVTCGGGVQKRSRLCNNPTPQFGGKDCVGDVTENQICNKQDCPIDGCLSNPCFAGVKCTSYPDGSWKCGACPPGYSGNGIQCTDVDECKEVPDACFNHNGEHRCENTDPGYNCLPCPPRFTGSQPFGQGVEHATANKQVCKPRNPCTDGTHDCNKNAKCNYLGHYSDPMYRCECKPGYAGNGIICGEDTDLDGWPNENLVCVANATYHCKKDNCPNLPNSGQEDYDKDGIGDACDDDDDNDKIPDDRDNCPFHYNPAQYDYDRDDVGDRCDNCPYNHNPDQADTDNNGEGDACAADIDGDGILNERDNCQYVYNVDQRDTDMDGVGDQCDNCPLEHNPDQLDSDSDRIGDTCDNNQDIDEDGHQNNLDNCPYVPNANQADHDKDGKGDACDHDDDNDGIPDDKDNCRLVPNPDQKDSDGDGRGDACKDDFDHDSVPDIDDICPENVDISETDFRRFQMIPLDPKGTSQNDPNWVVRHQGKELVQTVNCDPGLAVGYDEFNAVDFSGTFFINTERDDDYAGFVFGYQSSSRFYVVMWKQVTQSYWDTNPTRAQGYSGLSVKVVNSTTGPGEHLRNALWHTGNTPGQLKELCFNLSFSFSFRCAPCGMTLVT

SEQ ID NO: 836871 - protein, 1170 aa, Homo sapiens; identical to SEQ ID NO: 836849

SEQ ID NO: 836872 - protein, 758 aa, Homo sapiens
EFPPVRWPCPVPMAPVTTRFKQDGGWSHWSPWSSCSVTCGDGVITRIRLCNSPSPQMNGKPCEGEARETKACKKDACPINGGWGPWSPWDICSVTCGGGVQKRSRLCNNPTPQFGGKDCVGDVTENQICNKQDCPIDGCLSNPCFAGVKCTSYPDGSWKCGACPPGYSGNGIQCTDVDECKEVPDACFNHNGEHRCENTDPGYNCLPCPPRFTGSQPFGQGVEHATANKQVCKPRNPCTDGTHDCNKNAKCNYLGHYSDPMYRCECKPGYAGNGIICGEDTDLDGWPNENLVCVANATYHCKKDNCPNLPNSGQEDYDKDGIGDACDDDDDNDKIPDDRDNCPFHYNPAQYDYDRDDVGDRCDNCPYNHNPDQADTDNNGEGDACAADIDGDGILNERDNCQYVYNVDQRDTDMDGVGDQCDNCPLEHNPDQLDSDSDRIGDTCDNNQDIDEDGHQNNLDNCPYVPNANQADHDKDGKGDACDHDDDNDGIPDDKDNCRLVPNPDQKDSDGDGRGDACKDDFDHDSVPDIDDICPENVDISETDFRRFQMIPLDPKGTSQNDPNWVVRHQGKELVQTVNCDPGLAVGYDEFNAVDFSGTFFINTERDDDYAGFVFGYQSSSRFYVVMWKQVTQSYWDTNPTRAQGYSGLSVKVVNSTTGPGEHLRNALWHTGNTPGQVRTLWHDPRHIGWKDFTAYRWRLSHRPKTGFIRVVMYEGKKIMADSGPIYDKTYAGGRLGLFVFSQEMVFFSDLKYECRDP

SEQ ID NO: 836873 - protein, 1170 aa, Homo sapiens; identical to SEQ ID NO: 836849

SEQ ID NO: 836874 - protein, 1041 aa, Homo sapiens
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPINGGWGPWSPWDICSVTCGGGVQKRSRLCNNPTPQFGGKDCVGDVTENQICNKQDCPIDGCLSNPCFAGVKCTSYPDGSWKCGACPPGYSGNGIQCTDVDECKEVPDACFNHNGEHRCENTDPGYNCLPCPPRFTGSQPFGQGVEHATANKQVCKPRNPCTDGTHDCNKNAKCNYLGHYSDPMYRCECKPGYAGNGIICGEDTDLDGWPNENLVCVANATYHCKKDNCPNLPNSGQEDYDKDGIGDACDDDDDNDKIPDDRDNCPFHYNPAQYDYDRDDVGDRCDNCPYNHNPDQADTDNNGEGDACAADIDGDGILNERDNCQYVYNVDQRDTDMDGVGDQCDNCPLEHNPDQLDSDSDRIGDTCDNNQDIDEDGHQNNLDNCPYVPNANQADHDKDGKGDACDHDDDNDGIPDDKDNCRLVPNPDQKDSDGDGRGDACKDDFDHDSVPDIDDICPENVDISETDFRRFQMIPLDPKGTSQNDPNWVVRHQGKELVQTVNCDPGLAVGYDEFNAVDFSGTFFINGEERDMKIGVYTYTIILERYNGRTVR

SEQ ID NO: 836875 - protein, 685 aa, Homo sapiens
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPINGGWGPWSPWDICSVTCGGGVQKRSRLCNNPTPQFGGKDCVGDVTENQICNKQDCPIDGCLSNPCFAGVKCTSYPDGSWKCGACPPGYSGNGIQCTDVDECKEVPDACFNHNGEHRCENTDPGYNCLPCPPRFTGSQPFGQGVEHATANKQVQSTRRVNQRTGELSLTKITGSGRNVISYPSPKKKGRGDECTV

SEQ ID NO: 836876 - protein, 459 aa, Homo sapiens
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRCKHLSLSGTWRTDLSLLSSPRAAPQHVY

SEQ ID NO: 836877 - protein, 34 aa, Homo sapiens
MLSSLFPSHSLALQNSVTICKKVSCPIMPCSNAT

SEQ ID NO: 836878 - protein, 111 aa, Homo sapiens
MTQLHSDPGIYSPLSVVARSFHPNPLSPPLRTQPPTAGPSLESSLCVLSCLTESGGDNSVFDIFELTGAARKGSGRRLVKGPDPSSPAFRIEDANLIPPVPDDKFQDLVDA

SEQ ID NO: 836879 - protein, 131 aa, Homo sapiens
MPALEPGRRHACSRAQQARPGSPSTVPGGQAPVYEMAMARGATPRREGQRYPCWCKELQKLALLFRAHHDHCPLSARVAGTSWEVAEEPFAGAMRAEGVRAPPGARQANTSHSPTPDTSSSPQGPGNHEPW

SEQ ID NO: 836880 - protein, 41 aa, Homo sapiens
MRELHDNGTSYRLRRLGECAVLGEGVCWQSQGEVEEAVRRK

SEQ ID NO: 836881 - protein, 115 aa, Homo sapiens
MYRDVLSNLTASTLLPLQSIILKAARIMVLQYKYKLDYVIACFILFHNFPYLGLNLNSSPEAPMYPFESMLHHSCPRFRHRLPPFGSFNRPSSFLPKGLELTFLNATIFCSQFFM

SEQ ID NO: 836882 - protein, 351 aa, Homo sapiens
MAADDDNGDGTSLFDVFSASPLKNNDEGSLDIYAGLDSAVSDSASKSCVPSRNCLDLYEEILTEEGTAKEATYNDLQVEYGKCQLQMKELMKKFKEIQTQNFSLINENQSLKKNISALIKTARVEINRKDEEISNLHQRLSEFPHFRNNHKTARTFDTVKTKDLKSRSPHLDDCSKTDHRAKSDVSKDVHHSTSLPNLEKEGKPHSDKRSTSHLPTSVEKHCTNGVWSRSHYQVGEGSSNEDSRRGRKDIRHSQFNRGTERVRKDLSTGCGDGEPRILEASQRLQGHPEKYGKGEPKTESKSSKFKSNSDSDYKGERINSSWEKETPGERSHSRVDSQSDKKLERQSERSQ

SEQ ID NO: 836883 - protein, 190 aa, Homo sapiens
MAADDDNGDGTSLFDVFSASPLKNNDEGSLDIYAGLDSAVSDSASKSCVPSRNCLDLYEEILTEEGTAKEATYNDLQVEYGKCQLQMKELMKKFKEIQTQNFSLINENQSLKKNISALIKTARVEINRKDEEISNLHQRNDDREILLECQKRGPSFKTFAYLAAKLDKNPNQVSERFQQLMKLFEKSKCR

SEQ ID NO: 836884 - protein, 1269 aa, Homo sapiens
MDVLQTDVSQNFGLELDTKRNDNSDYCGISEGMEMKVALSTTVSETTESILQPSIEEADILPIMLSEDNNPKFEPSVIVTPLVESKSCHLEPCLPKETLDSSLQQTELMDHRMATGETNSVYHDDDNSVLSIDLNHLRPIPEAISPLNSPVRPVAKVLRNESPPQVPVYNNSHKDVFLPNSAHSTSKSQSDLNKENQKPIYKSDKCTEADTCKNSPLDELEEGEIRSDSETSKPQESFEKNSKRRVSADVRKSKTIPRRGKSTVCLDKDSRKTHVRIHQTNNKWNKRPDKSSRSSKTEKKDKVMSTSSLEKIVPIIAVPSSEQEIMHMLRMIRKHVRKNYMKFKAKFSLIQFHRIIESAILSFTSLIKHLNLHKISKSVTTLQKNLCDIIESKLKQVKKNGIVDRLFEQQLPDMKKKLWKFVDDQLDYLFAKLKKILVCDSKSFGRDSDEGKLEKTSKQNAQYSNSQKRSVDNSNRELLKEKLSKSEDPVHYKSLVGCKKSEENYQDQNNSSINTVKHDIKKNFNICFDNIKNSQSEERSLEVHCPSTPKSEKNEGSSIEDAQTSQHATLKPERSFEILTEQQASSLTFNLVSDAQMGEIFKSLLQGSDLLDSSVNCTEKSEWELKTPEKQLLETLKCESIPACTTEELVSGVASPCPKMISDDNWSLLSSEKGPSLSSGLSLPVHPDVLDESCMFEVSTNLPLSKDNVCSVEKSKPCVSSILLEDLAVSLTVPSPLKSDGHLSFLKPDMSSSSTPEEVISAHFSEDALLEEEDASEQDIHLALESDNSSSKSSCSSSWTSRSVAPGFQYHPNLPMHAVIMEKSNDHFIVKIRRATPSTSSGLKQSMMPDELLTSLPRHGKEADEGPEKEYISCQNTVFKSVEELENSNKNVDGSKSTHEEQSSMIQTQVPDIYEFLKDASDKMGHSDEVADECFKLHQVWETKVPESIEELPSMEEISHSVGEHLPNTYVDLTKDPVTETKNLGEFIEVTVLHIDQLGCSGGNLNQSAQILDNSLQADTVGAFIDLTQDASSEAKSEGNHPALAVEDLGCGVIQVDEDNCKEEKAQVANRPLKCIVEETYIDLTTESPSSCEVKKDELKSEPGSNCDNSELPGTLHNSHKKRRNISDLNHPHKKQRKETDLTNKEKTKKPTQDSCENTEAHQKKASKKKAPPVTKDPSSLKATPGIKDSSAALATSTSLSAKNVIKKKGEIIILWTRNDDREILLECQKRGPSFKTFAYLAAKLDKNPNQVSERFQQLMKLFEKSKCR

SEQ ID NO: 836885 - protein, 519 aa, Homo sapiens
MAADDDNGDGTSLFDVFSASPLKNNDEGSLDIYAGLDSAVSDSASKSCVPSRNCLDLYEEILTEEGTAKEATYNDLQVEYGKCQLQMKELMKKFKEIQTQNFSLINENQSLKKNISALIKTARVEINRKDEEISNLHQRLSEFPHFRNNHKTARTFDTVKTKDLKSRSPHLDDCSKTDHRAKSDVSKDVHHSTSLPNLEKEGKPHSDKRSTSHLPTSVEKHCTNGVWSRSHYQVGEGSSNEDSRRGRKDIRHSQFNRGTERVRKDLSTGCGDGEPRILEASQRLQGHPEKYGKGEPKTESKSSKFKSNSDSDYKGERINSSWEKETPGERSHSRVDSQSDKKLERQSERSQNINRKEVKSQDKEERKVDQKPKSVVKDQDHWRRSERASLPHSKNEITFSHNSSKYHLEERRGWEDCKRDKSVNSHSFQDGRCPSSLSNSRTHKNIDSKEVDAMHQWENTPLKAERHRTEDKRKREQESKEENRHIRNEKRVPTEHLQKTNKETKKTTTDLKKQNEPKT

SEQ ID NO: 836886 - protein, 1269 aa, Homo sapiens; identical to SEQ ID NO: 836884

SEQ ID NO: 836887 - protein, 1269 aa, Homo sapiens; identical to SEQ ID NO: 836884

SEQ ID NO: 836888 - protein, 92 aa, Homo sapiens
SRFRIHTRNLMSEGKTGRDCPLRAQEESPEAAVAKPSPAGAWGSGQGVSGAQGPHGEDMYVSAAVGGGDPWKEIVLLGSDGRKVEGRTVRRS

SEQ ID NO: 836889 - protein, 481 aa, Homo sapiens
AVCGETDEEAGESGGEGIFRERDEFVIRAEDIPSLKLALQTGREPPPIWRVQKALLQKFTPEIKDGQRQFCATSNYLGYFGDAKNRYQRLYVKFLENVNKKDYVRVCARKPWHRPPVPVRRSGQAKNPVSAGGSSAPPPKAPAPPPKPETPEKTTSEKPPEQTPETAMPEPPAPEKPSLLRPVEKEKEKEKVTRGERPLRGERATSGRQTRPERSLATGQPATSRLPKARPTKVKAEPPPKKRKKWLKEAGGNATAGGGPPGSSSDSESSPGAPSEDERAVPGRLLKTRAMREMYRSYVEMLVSTALDPDMIQALEDTHDELYLPPMRKIDGLLNEHKKKVLKRLSLSPALQDALHTFPQLQVEQSGEGSPEEGAVRLRPAGEPYNRKTLSKLKRSVVRAQEFKVELEKSGYYTLYHSLHHYKYHTFLRCRDQTLAIEGGAEDLGQEEVVQQCMRNQPWLEQLFDSFSDLLAQAQAHSRCG

SEQ ID NO: 836890 - protein, 405 aa, Homo sapiens
AVCGETDEEAGESGGEGIFRERDEFVIRAEDIPSLKLALQTGREPPPIWRVQKALLQKFTPEIKDGQRQFCATSNYLGYFGDAKNRYQRLYVKFLENVNKKDYVRVCARKPWHRPPVPVRRSGQAKNPVSAGGSSAPPPKAPAPPPKPETPEKTTSEKPPEQTPETAMPEPPAPEKPSLLRPVEKEKEKEKVTRGERPLRGERATSGRQTRPERSLATGQPATSRLPKARPTKVKAEPPPKKRKKWLKEAGGNATAGGGPPGSSSDSESSPGAPSEDERAVPGRLLKTRAMREMYRSYVEMLVSTALDPDMIQALEDTHDELYLPPMRKIDGLLNEHKKKVLKRLSLSPALQVPGGLGRGCLGPRVHMEKTCTCRPLLAGVILGRRSSFWAQMGEKLRAGLSGDL

SEQ ID NO: 836891 - protein, 308 aa, Homo sapiens
AVCGETDEEAGESGGEGIFRERDEFVIRAEDIPSLKLALQTGREPPPIWRVQKALLQKFTPEIKDGQRQFCATSNYLGYFGDAKNRYQRLYVKFLENVNKKDYVRVCARKPWHRPPVPVRRSGQAKNPVSAGGSSAPPPKAPAPPPKPETPEKTTSEKPPEQTPETAMPEPPAPEKPSLLRPVEKEKEKEKQTRPERSLATGQPATSRLPKARPTKVKAEPPPKKRKKWLKEAGGNATAGGGPPGSSSDSESSPGAPSEDERAVPGRLLKTRAMREMYRSYVEMLVSTALDPDMIQALEDTHGELRPG

SEQ ID NO: 836892 - protein, 481 aa, Homo sapiens; identical to SEQ ID NO: 836889

SEQ ID NO: 836893 - protein, 128 aa, Homo sapiens
VPVWLCMTVYDPETLEAELVPGLRTAVLLRVQALQEESRYLRAVLANETGLARLLSRLSGVGLRLTTSLFRDSPAGDHDYALPVGKQKQDLLEEDDSAGGVCLHVDKDKVSVEFCSACARKASSSLKM

SEQ ID NO: 836894 - protein, 354 aa, Homo sapiens
MRHSLTKLLAASGSNSPTRSESPEPAATCSLPSDLTRAAAGEEETAAAGSPGRKQQFGDEGELEAGRGSRGGVAVRAPSPEEMEEEAIASLPGEETEDMDFLSGLELADLLDPRQPDWHLDPGLSSPGPLSSSGGGSDSGGLWRGDDDDEAAAAEMQRFSDLLQRLLNGIGGCSSSSDSGSAEKRRRKSPGGGGGGGSGNDNNQAATKSPRKAAAAAARLNRLKKKEYVMGLESRVRGLAAENQELRAENRELGKRVQALQEESRYLRAVLANETGLARLLSRLSGVGLRLTTSLFRDSPAGDHDYALPVGKQKQDLLEEDDSAGGVCLHVDKDKVSVEFCSACARKASSSLKM

SEQ ID NO: 836895 - protein, 358 aa, Homo sapiens
MRHSLTKLLAASGSNSPTRSESPEPAATCSLPSDLTRAAAGEEETAAAGSPGRKQQFGDEGELEAGRGSRGGVAVRAPSPEEMEEEAIASLPGEETEDMDFLSGLELADLLDPRQPDWHLDPGLSSPGPLSSSGGGSDSGGLWRGDDDDEAAAAEMQRFSDLLQRLLNGIGGCSSSSDSGSAEKRRRKSPGGGGGGGSGNDNNQAATKSPRKAAAAAARLNRLKKKEYVMGLESRVRGLAAENQELRAENRELGKRVQALQEESRYLRAVLANETGLARLLSRLSGVGLRLTTSLFRDSPAGDHDYALPVGKQKQDLLEEDDSAGGVCLHVDKDKVSVEFCSACARKASSSLKIFFFR

SEQ ID NO: 836896 - protein, 266 aa, Homo sapiens
MYYSKLIKSIQFLTILSVFSACEARQQPDWHLDPGLSSPGPLSSSGGGSDSGGLWRGDDDDEAAAAEMQRFSDLLQRLLNGIGGCSSSSDSGSAEKRRRKSPGGGGGGGSGNDNNQAATKSPRKAAAAAARLNRLKKKEYVMGLESRVRGLAAENQELRAENRELGKRVQALQEESRYLRAVLANETGLARLLSRLSGVGLRLTTSLFRDSPAGDHDYALPVGKQKQDLLEEDDSAGGVCLHVDKDKVSVEFCSACARKASSSLKM

SEQ ID NO: 836897 - protein, 354 aa, Homo sapiens; identical to SEQ ID NO: 836894

SEQ ID NO: 836898 - protein, 354 aa, Homo sapiens; identical to SEQ ID NO: 836894

SEQ ID NO: 836899 - protein, 354 aa, Homo sapiens; identical to SEQ ID NO: 836894

SEQ ID NO: 836900 - protein, 354 aa, Homo sapiens; identical to SEQ ID NO: 836894

SEQ ID NO: 836901 - protein, 354 aa, Homo sapiens; identical to SEQ ID NO: 836894

SEQ ID NO: 836902 - protein, 354 aa, Homo sapiens; identical to SEQ ID NO: 836894

SEQ ID NO: 836903 - protein, 354 aa, Homo sapiens; identical to SEQ ID NO: 836894

SEQ ID NO: 836904 - protein, 354 aa, Homo sapiens; identical to SEQ ID NO: 836894

SEQ ID NO: 836905 - protein, 118 aa, Homo sapiens
IAARRIKYSGIELTREVKGLFKENYKPLLQELREDTSRWENIPCSWIERINITKMTILPKTIYRFNAISIKSLTFFTELEKTILKFIWNQKRARIARTFLSKKNKAGGITLPNFKLYY

SEQ ID NO: 836906 - protein, 336 aa, Homo sapiens
PRVPGPRRLVMSPQLDTKSPSAHAGLPATGGGGAAPSTGAQKCERQRRGRDCSCASGLPAASPRAADPRPLASAPLPGSGPRMRTPPALGSQGSEVTGPTFADGELIPREPGFFPEDEEEAMTLAPPEGPQELYTDSPMESTQSLEGSVGSPAEKDGGLGGLFLPEDKSLVHTPSMTTSDLSTHSTTSLISNEEQFEDYGEGDDVDCAPSSPCPDDETRTNVYSDLGSSVSSSAGQTPRKMRHVYNSELLDVYCSQCCKKINLLNDLEARLKNLKANSPNRKISSTAFGRQLMHSSNFSSSNGSTEDLFRDSIDSCDNDITEKVSSWKTGDETECM

SEQ ID NO: 836907 - protein, 36 aa, Homo sapiens
MGPQPLRALSLPPEEALSMVPGARPQACLEATTSGV

SEQ ID NO: 836908 - protein, 36 aa, Homo sapiens; identical to SEQ ID NO: 836907

SEQ ID NO: 836909 - protein, 36 aa, Homo sapiens; identical to SEQ ID NO: 836907

SEQ ID NO: 836910 - protein, 83 aa, Homo sapiens
RNTHKTKNTNKELAQVTSPACESDEAEAGLWPGPTFNSIPISLCICWISWLLFNLLLGISFMLHIMGLHWSDPGLWSHPHWED

SEQ ID NO: 836911 - protein, 617 aa, Homo sapiens
PRVPGPRRLVMSPQLDTKSPSAHAGLPATGGGGAAPSTGAQKCERQRRGRDCSCASGLPAASPRAADPRPLASAPLPGSGPRMRTPPALGSQGSEVTGPTFADGELIPREPGFFPEDEEEAMTLAPPEGPQELYTDSPMESTQSLEGSVGSPAEKDGGLGGLFLPEDKSLVHTPSMTTSDLSTHSTTSLISNEEQFEDYGEGDDVDCAPSSPCPDDETRTNVYSDLGSSVSSSAGQTPRKMRHVYNSELLDVYCSQCCKKINLLNDLEARLKNLKANSPNRKISSTAFGRQLMHSSNFSSSNGSTEDLFRDSIDSCDNDITEKVSFLEKKVTELENDSLTNGDLKSKLKQENTQLVHRVHELEEMVKDQETTAEQALEEEARRHREAYGKLEREKATEVELLNARVQQLEEENTELRTTVTRLKSQTEKLDEERQRMSDRLEDTSLRLKDEMDLYKRMMDKLRQNRLEFQKEREATQELIEDLRKELEHLQMYKLDCERPGRGRSASSGLGEFNARAREVELEHEVKRLKQENYKLRDQNDDLNGQILSLSLYEAKNLFAAQTKAQSLAAEIDTASRDELMEALKEQEEINFRLRQYMDKIILAILDHNPSILEIKH

SEQ ID NO: 836912 - protein, 36 aa, Homo sapiens; identical to SEQ ID NO: 836907

SEQ ID NO: 836913 - protein, 617 aa, Homo sapiens; identical to SEQ ID NO: 836911

SEQ ID NO: 836914 - protein, 663 aa, Homo sapiens
PRVPGPRRLVMSPQLDTKSPSAHAGLPATGGGGAAPSTGAQKCERQRRGRDCSCASGLPAASPRAADPRPLASAPLPGSGPRMRTPPALGSQGSEVTGPTFADGELIPREPGFFPEDEEEAMTLAPPEGPQELYTDSPMESTQSLEGSVGSPAEKDGGLGGLFLPEDKSLVHTPSMTTSDLSTHSTTSLISNEEQFEDYGEGDDVDCAPSSPCPDDETRTNVYSDLGSSVSSSAGQTPRKMRHVYNSELLDVYCSQCCKKINLLNDLEARLKNLKANSPNRKISSTAFGRQLMHSSNFSSSNGSTEDLFRDSIDSCDNDITEKVSFLEKKVTELENDSLTNGDLKSKLKQENTQLVHRVHELEEMVKDQETTAEQALEEEARRHREAYGKLEREKATEVELLNARVQQLEEENTELRTTVTRLKSQTEKLDEERQRMSDRLEDTSLRLKDEMDLYKRMMDKLRQNRLEFQKEREATQELIEDLRKELEHLQMYKLDCERPGRGRSASSGLGEFNARAREVELEHEVKRLKQENYKLRDQNDDLNGQILSLSLYEATNGSPEGAGGDQLPAEAVHGQDYPRHPGPQSLHPRDQTLRHGAGCRAALGPWDQGQTLPKDAGLSRASHSHCKCLSGHHALRVPVYMWGGCAHERGVSGRGCGQHPHG

SEQ ID NO: 836915 - protein, 621 aa, Homo sapiens
MHHHAQLIFLFFVETGSHCVASLELLTSSDPPTSACQSTGITGMSHHAWPGHISNGEILKILMIRLNPQTFWFDCCGCSPGMGFFKELLRKFQFNCVSYLGFLFVFIVFAKPGNPTEYGLAVTYLKFRGVWGWGEGFCSRLRFYMALSCPCVQLEATQNELTRSELRVHYLLENEVPSGSASPCALRGFKKLLVKMFFSFSFELARVYPRLFYFKLVEFFANCHREIPFHDFISDLLKHEQARHGGYTPVILALGRQWQADHLSSGVLNQPGQHSDTLSLPKVKKKKKKAQEPARGPKTVELSFGCALESPGEICKLLLSGLNPQRFGLNWCGVWSRHRDVLRPPQVMICSPRLRLPCPARSLARGRGNWSKWLLGLSSPWLNDSELSCWEGSFSCVEWSWPAGWEARCLQELVDPAVLTSLEVSRPEWVGRTLAWCPWNQWVACVGIYWLQAHLKEQVEQSQQGTDRWGCPPESSRRNSCHLFAIAEQEDILSLWVLLLVCFLTGLIKGVPARSLLAKPASSHTPDTPGASPLVLVFRGVGGGARGQKRGFLVPMRDLAEASRGQQGQVKLGRNEALCVLLCVVGFNALANLNLKTNSRPGTVAHTCNPSTLGGQGRWIA

SEQ ID NO: 836916 - protein, 617 aa, Homo sapiens; identical to SEQ ID NO: 836911

SEQ ID NO: 836917 - protein, 116 aa, Homo sapiens
GRDPDGFLRVERVAALGLRFGQGEEVEKLVKYLDPNDLGRINFKDFCRGVFAMKGCEELLKDVLSVESAGTLPCAPEIPDCVEQRPGLAMLPRMVSNSWPQASLPAGPPKALGLQS

SEQ ID NO: 836918 - protein, 504 aa, Homo sapiens
PRVPGPRRLVMSPQLDTKSPSAHAGLPATGGGGAAPSTGAQKCERQRRGRDCSCASGLPAASPRAADPRPLASAPLPGSGPRMRTPPALGSQGSEVTGPTFADGELIPREPGFFPEDEEEAMTLAPPEGPQELYTDSPMESTQSLEGSVGSPAEKDGGLGGLFLPEDKSLVHTPSMTTSDLSTHSTTSLISNEEQFEDYGEGDDVDCAPSSPCPDDETRTNVYSDLGSSVSSSAGQTPRKMRHVYNSELLDVYCSQCCKKINLLNDLEARLKNLKANSPNRKISSTAFGRQLMHSSNFSSSNGSTEDLFRDSIDSCDNDITEKVSFLEKKVTELENDSLTNGDLKSKLKQENTQLVHRVHELEEMVKDQETTAEQALEEEARRHREAYGKLEREKATEVELLNARVQQLEEENTELRTTVTRLKSQTEKLDEERQRMSDRLEDTSLRLKDEMDLYKRMMGARLGIFVPSGSPLRVRISPFTFPVFSTCSRFSVFTFRFSRDDLL

SEQ ID NO: 836919 - protein, 36 aa, Homo sapiens; identical to SEQ ID NO: 836907

SEQ ID NO: 836920 - protein, 36 aa, Homo sapiens; identical to SEQ ID NO: 836907

SEQ ID NO: 836921 - protein, 36 aa, Homo sapiens; identical to SEQ ID NO: 836907

SEQ ID NO: 836922 - protein, 776 aa, Homo sapiens
MNPEEQIVTWLISLGVLESPKKTICDPEEFLKSSLKNGVVLCKLINRLMPGSVEKFCLDPQTEADCINNINDFLKGCATLQVEIFDPDDLYSGVNFSKVLSTLLAVNKATEDQLSERPCGRSSSLSAANTSQTNPQGAVSSTVSGLQRQSKTVEMTENGSHQLIVKARFNFKQTNEDELSVCKGDIIYVTRVEEGGWWEGTLNGRTGWFPSNYVREIKSSERPLSPKAVKGFETAPLTKNYYTVVLQNILDTEKEYAKELQSLLVTYLRPLQSNNNLSTVEVTSLLGNFEEVCTFQQTLCQALEECSKFPENQHKVGGCLLSLMPHFKSMYLAYCANHPSAVNVLTQHSDELEQFMENQGASSPGILILTTNLSKPFMRLEKYVTLLQELERHMEDTHPDHQDILKAIVAFKTLMGQCQDLRKRKQLELQILSEPIQAWEGEDIKNLGNVIFMSQVMVQYGACEEKEERYLMLFSNVLIMLSASPRMSGFIYQGKIPIAGTVVTRLDEIEGNDCTFEITGNTVERIVVHCNNNQDFQEWLEQLNRLIRGPASCSSLSKTSSSSCSAHSSFSSTGQPRGPLEPPQIIKPWSLSCLRPAPPLRPSAALGYKERMSYILKESSKSPKTMKKFLHKRKTERKPSEEEYVIRKSTAALEEDAQILKVIEAYCTSANFQQGHGSSTRKDSIPQVLLPEEEKLIIEETRSNGQTIMEEKSLVDTVYALKDEVRELKQENKRMKQCLEEELKSRRDLEKLVRRLLKQTDECIRGESSSKTSILP

SEQ ID NO: 836923 - protein, 622 aa, Homo sapiens
MTENGSHQLIVKARFNFKQTNEDELSVCKGDIIYVTRVEEGGWWEGTLNGRTGWFPSNYVREIKSSERPLSPKAVKGFETAPLTKNYYTVVLQNILDTEKEYAKELQSLLVTYLRPLQSNNNLSTVEVTSLLGNFEEVCTFQQTLCQALEECSKFPENQHKVGGCLLSLMPHFKSMYLAYCANHPSAVNVLTQHSDELEQFMENQGASSPGILILTTNLSKPFMRLEKYVTLLQELERHMEDTHPDHQDILKAIVAFKTLMGQCQDLRKRKQLELQILSEPIQAWEGEDIKNLGNVIFMSQVMVQYGACEEKEERYLMLFSNVLIMLSASPRMSGFIYQGKIPIAGTVVTRLDEIEGNDCTFEITGNTVERIVVHCNNNQDFQEWLEQLNRLIRGPASCSSLSKTSSSSCSAHSSFSSTGQPRGPLEPPQIIKPWSLSCLRPAPPLRPSAALGYKERMSYILKESSKSPKTMKKFLHKRKTERKPSEEEYVIRKSTAALEEDAQILKVIEAYCTSANFQQGHGSSTRKDSIPQVLLPEEEKLIIEETRSNGQTIMEEKSLVDTVYALKDEVRELKQENKRMKQCLEEELKSRRDLEKLVRRLLKQTDECIRGESSSKTSILP

SEQ ID NO: 836924 - protein, 776 aa, Homo sapiens; identical to SEQ ID NO: 836922

SEQ ID NO: 836925 - protein, 68 aa, Homo sapiens
VSPWWRPRSGQGPSSGWVDLFPQPWHRLARPLAGPVTREGERLPGGGGGAAGVREQLEDRRAAAEPDI

SEQ ID NO: 836926 - protein, 67 aa, Homo sapiens
TENGSHQLIVKARFNFKQTNEDELSVCKGDIIYVTRVEEGGWWEGTLNGRTGWFPSNYVREIKSSGK

SEQ ID NO: 836927 - protein, 776 aa, Homo sapiens; identical to SEQ ID NO: 836922

SEQ ID NO: 836928 - protein, 267 aa, Homo sapiens
MNPEEQIVTWLISLGVLESPKKTICDPEEFLKSSLKNGVVLCKLINRLMPGSVEKFCLDPQTEADCINNINDFLKGCATLQVEIFDPDDLYSGVNFSKVLSTLLAVNKATEDQLSERPCGRSSSLSAANTSQTNPQGAVSSTVSGLQRQSKTVEMTENGSHQLIVKARFNFKQTNEDELSVCKGDIIYVTRVEEGGWWEGTLNGRTGWFPSNYVREIKSSGWSQTPGLQRSSCPGLPKCWDYRDGVPLLLLGLECNGAISAHHNLCL

SEQ ID NO: 836929 - protein, 276 aa, Homo sapiens
MNPEEQIVTWLISLGVLESPKKTICDPEEFLKSSLKNGVVLCKLINRLMPGSVEKFCLDPQTEADCINNINDFLKGCATLQVEIFDPDDLYSGVNFSKVLSTLLAVNKATEDQLSERPCGRSSSLSAANTSQTNPQGAVSSTVSGLQRQSKTVEMTENGSHQLIVKARFNFKQTNEDELSVCKGDIIYVTRVEEGGWWEGTLNGRTGWFPSNYVREIKSSERPLSPKAVKGFETAPLTKNYYTVVLQNILDTEKEYAKELQSLLVTYLRPLQSNNK

SEQ ID NO: 836930 - protein, 79 aa, Homo sapiens
FFTRCRALRSHTGVPQDTRPPAENLVLSLGSWYSKGPNTGAVTAIHALRRPSAQIIFRSVNIGLRIFCGFLHLHFCALS

SEQ ID NO: 836931 - protein, 408 aa, Homo sapiens
MATHSAQKPHQCMYCDKMFHRKDHLRNHLQTHDPNKEALHCSECGKNYNTKLGYRRHLAMHAASSGDLSCKVCLQTFESTQALLEHLKAHSRRVAGGAKEKKHPCDHCDRRFYTRKDVRRHLVVHTGRKDFLCQYCAQRFGRKDHLTRHVKKSHSQELLKIKTEPVDMLGLLSCSSTVSVKEELSPVLCMASRDVMGTKAFPGMLPMGMYGAHIPTMPSTGVPHSLVHNTLPMGMSYPLESSPISSPAQLPPKYQLGSTSYLPDKLPKVEVDSFLAELPGSLSLSSAEPQPASPQPAAAAALLDEALLAKSPANLSEALCAANVDFSHLLGFLPLNLPPCNPPGATGGLVMGYSQAEAQPLLTTLQAQPQDSPGAGGPLNFGPLHSLPPVFTSGLSSTTLPRFHQAFQ

SEQ ID NO: 836932 - protein, 496 aa, Homo sapiens
MTTFFTSVPPWIQDAKQEEEVGWKLVPRPRGREAESQVKCQCEISGTPFSNGEKLRPHSLPQPEQRPYSCPQLHCGKAFASKYKLYRHMATHSAQKPHQCMYCDKMFHRKDHLRNHLQTHDPNKEALHCSECGKNYNTKLGYRRHLAMHAASSGDLSCKVCLQTFESTQALLEHLKAHSRRVAGGAKEKKHPCDHCDRRFYTRKDVRRHLVVHTGRKDFLCQYCAQRFGRKDHLTRHVKKSHSQELLKIKTEPVDMLGLLSCSSTVSVKEELSPVLCMASRDVMGTKAFPGMLPMGMYGAHIPTMPSTGVPHSLVHNTLPMGMSYPLESSPISSPAQLPPKYQLGSTSYLPDKLPKVEVDSFLAELPGSLSLSSAEPQPASPQPAAAAALLDEALLAKSPANLSEALCAANVDFSHLLGFLPLNLPPCNPPGATGGLVMGYSQAEAQPLLTTLQAQPQDSPGAGGPLNFGPLHSLPPVFTSGLSSTTLPRFHQAFQ

SEQ ID NO: 836933 - protein, 564 aa, Homo sapiens
QWPDRRHYRGLRGPGGARARPGPQRGAPSAVKRLFSESCVGGCDRAESLCGADGEAFSITWPFAISLAMTTFFTSVPPWIQDAKQEEEVGWKLVPRPRGREAESQVKCQCEISGTPFSNGEKLRPHSLPQPEQRPYSCPQLHCGKAFASKYKLYRHMATHSAQKPHQCMYCDKMFHRKDHLRNHLQTHDPNKEALHCSECGKNYNTKLGYRRHLAMHAASSGDLSCKVCLQTFESTQALLEHLKAHSRRVAGGAKEKKHPCDHCDRRFYTRKDVRRHLVVHTGRKDFLCQYCAQRFGRKDHLTRHVKKSHSQELLKIKTEPVDMLGLLSCSSTVSVKEELSPVLCMASRDVMGTKAFPGMLPMGMYGAHIPTMPSTGVPHSLVHNTLPMGMSYPLESSPISSPAQLPPKYQLGSTSYLPDKLPKVEVDSFLAELPGSLSLSSAEPQPASPQPAAAAALLDEALLAKSPANLSEALCAANVDFSHLLGFLPLNLPPCNPPGATGGLVMGYSQAEAQPLLTTLQAQPQDSPGAGGPLNFGPLHSLPPVFTSGLSSTTLPRFHQAFQ

SEQ ID NO: 836934 - protein, 564 aa, Homo sapiens; identical to SEQ ID NO: 836933

SEQ ID NO: 836935 - protein, 408 aa, Homo sapiens; identical to SEQ ID NO: 836931

SEQ ID NO: 836936 - protein, 564 aa, Homo sapiens; identical to SEQ ID NO: 836933

SEQ ID NO: 836937 - protein, 106 aa, Homo sapiens
HACPHNIISFDTTPRRPPLWRQGRNGKKSEQHQRLSELLSWTVNPSHPLKKCPARRTVNNPGDSDLQLDLRWDITPRTPEEPQERKSQGKPLPRPYQTQNKIPFSY

SEQ ID NO: 836938 - protein, 723 aa, Homo sapiens
ARGALQIVSCCVSFFDRHSCQLQSQIDFSPSMFYFRGCGRWVAVSFTKQQFPLARLSSDSAAPRTPHFDVIVIGGGHAGTEAATAAARCGSRTLLLTHRVDTIGQMSCNPSFGGIGKGHLMREVDALDGLCSRICDQSGVHYKVLNRRKGPAVWGLRAQIDRKLYKQNMQKEILNTPLLTVQEGAVEDLILTEPEPEHTGKCRVSGVVLVDGSTVYAESVILTTGTFLRGMIVIGLETHPAGRLGDQPSIGLAQTLEKLGFVVGRLKTGTPPRIAKESINFSILNKHIPDNPSIPFSFTNETVWIKPEDQLPCYLTHTNPRVDEIVLKNLHLNSHVKETTRGPRYCPSIESKVLRFPNRLHQVWLEPEGMDSDLIYPQGLSMTLPAELQEKMITCIRGLEKAKVIQPGYGVQYDYLDPRQITPSLETHLVQRLFFAGQINGTTGYEEAAAQGVIAGINASLRVSRKPPFVVSRTEGYIGVLIDDLTTLGTSEPYRMFTSRVEFRLSLRPDNADSRLTLRGYKDAGCVSQQRYERACWMKSSLEEGISVLKSIEFLSSKWKKLIPEASISTSRSLPVRALDVLKYEEVDMDSLAKAVPEPLKKYTKCRELAERLKIEATYESVLFHQLQEIKGVQQDEALQLPKDLDYLTIRDVSLSHEVREKLHFSRPQTIGAASRIPGVTPAAIINLLRFVKTTQRRQSAMNESSKTDQYLCDADRLQEREL

SEQ ID NO: 836939 - protein, 762 aa, Homo sapiens
ARGALQIVSCCVSFFDRHSCQLQSQIDFSPSMFYFRGCGRWVAVSFTKQQFPLARLSSDSAAPRTPHFDVIVIGGGHAGTEAATAAARCGSRTLLLTHRVDTIGQMSCNPSFGGIGKGHLMREVDALDGLCSRICDQSGVHYKVLNRRKGPAVWGLRAQIDRKLYKQNMQKEILNTPLLTVQEGAVEDLILTEPEPEHTGKCRVSGVVLVDGSTVYAESVILTTGTFLRGMIVIGLETHPAGRLGDQPSIGLAQTLEKLGFVVGRLKTGTPPRIAKESINFSILNKHIPDNPSIPFSFTNETVWIKPEDQLPCYLTHTNPRVDEIVLKNLHLNSHVKETTRGPRYCPSIESKVLRFPNRLHQVWLEPEGMDSDLIYPQGLSMTLPAELQEKMITCIRGLEKAKVIQPGYGVQYDYLDPRQITPSLETHLVQRLFFAGQINGTTGYEEAAAQSVALLPGWSAVIMISQLQAILLPQPSLVAGTAGMHHNTQGVIAGINASLRVSRKPPFVVSRTEGYIGVLIDDLTTLGTSEPYRMFTSRVEFRLSLRPDNADSRLTLRGYKDAGCVSQQRYERACWMKSSLEEGISVLKSIEFLSSKWKKLIPEASISTSRSLPVRALDVLKYEEVDMDSLAKAVPEPLKKYTKCRELAERLKIEATYESVLFHQLQEIKGVQQDEALQLPKDLDYLTIRDVSLSHEVREKLHFSRPQTIGAASRIPGVTPAAIINLLRFVKTTQRRQSAMNESSKTDQYLCDADRLQEREL

SEQ ID NO: 836940 - protein, 656 aa, Homo sapiens
GTRRPADCLLLRQMSCNPSFGGIGKGHLMREVDALDGLCSRICDQSGVHYKVLNRRKGPAVWGLRAQIDRKLYKQNMQKEILNTPLLTVQEGAVEDLILTEPEPEHTGKCRVSGVVLVDGSTVYAESVILTTGTFLRGMIVIGLETHPAGRLGDQPSIGLAQTLEKLGFVVGRLKTGTPPRIAKESINFSILNKHIPDNPSIPFSFTNETVWIKPEDQLPCYLTHTNPRVDEIVLKNLHLNSHVKETTRGPRYCPSIESKVLRFPNRLHQVWLEPEGMDSDLIYPQGLSMTLPAELQEKMITCIRGLEKAKVIQPDGVLLLLPRMECNGAISAHHNLPLPGYGVQYDYLDPRQITPSLETHLVQRLFFAGQINGTTGYEEAAAQGVIAGINASLRVSRKPPFVVSRTEGYIGVLIDDLTTLGTSEPYRMFTSRVEFRLSLRPDNADSRLTLRGYKDAGCVSQQRYERACWMKSSLEEGISVLKSIEFLSSKWKKLIPEASISTSRSLPVRALDVLKYEEVDMDSLAKAVPEPLKKYTKCRELAERLKIEATYESVLFHQLQEIKGVQQDEALQLPKDLDYLTIRDVSLSHEVREKLHFSRPQTIGAASRIPGVTPAAIINLLRFVKTTQRRQSAMNESSKTDQYLCDADRLQEREL

SEQ ID NO: 836941 - protein, 643 aa, Homo sapiens
MSCNPSFGGIGKGHLMREVDALDGLCSRICDQSGVHYKVLNRRKGPAVWGLRAQIDRKLYKQNMQKEILNTPLLTVQEGAVEDLILTEPEPEHTGKCRVSGVVLVDGSTVYAESVILTTGTFLRGMIVIGLETHPAGRLGDQPSIGLAQTLEKLGFVVGRLKTGTPPRIAKESINFSILNKHIPDNPSIPFSFTNETVWIKPEDQLPCYLTHTNPRVDEIVLKNLHLNSHVKETTRGPRYCPSIESKVLRFPNRLHQVWLEPEGMDSDLIYPQGLSMTLPAELQEKMITCIRGLEKAKVIQPDGVLLLLPRMECNGAISAHHNLPLPGYGVQYDYLDPRQITPSLETHLVQRLFFAGQINGTTGYEEAAAQGVIAGINASLRVSRKPPFVVSRTEGYIGVLIDDLTTLGTSEPYRMFTSRVEFRLSLRPDNADSRLTLRGYKDAGCVSQQRYERACWMKSSLEEGISVLKSIEFLSSKWKKLIPEASISTSRSLPVRALDVLKYEEVDMDSLAKAVPEPLKKYTKCRELAERLKIEATYESVLFHQLQEIKGVQQDEALQLPKDLDYLTIRDVSLSHEVREKLHFSRPQTIGAASRIPGVTPAAIINLLRFVKTTQRRQSAMNESSKTDQYLCDADRLQEREL

SEQ ID NO: 836942 - protein, 174 aa, Homo sapiens
GSIGYGSLSGEYIVEEASISTSRSLPVRALDVLKYEEVDMDSLAKAVPEPLKKYTKCRELAERLKIEATYESVLFHQLQEIKGVQQDEALQLPKDLDYLTIRDVSLSHEVREKLHFSRPQTIGAASRIPGVTPAAIINLLRFVKTTQRRQSAMNESSKTDQYLCDADRLQEREL

SEQ ID NO: 836943 - protein, 596 aa, Homo sapiens
ARGALQIVSCCVSFFDRHSCQLQSQIDFSPSMFYFRGCGRWVAVSFTKQQFPLARLSSDSAAPRTPHFDVIVIGGGHAGTEAATAAARCGSRTLLLTHRVDTIGQMSCNPSFGGIGKGHLMREVDALDGLCSRICDQSGVHYKVLNRRKGPAVWGLRAQIDRKLYKQNMQKEILNTPLLTVQEGAVEDLILTEPEPEHTGKCRVSGVVLVDGSTVYAESVILTTGTFLRGMIVIGLETHPAGRLGDQPSIGLAQTLEKLGFVVGRLKTGTPPRIAKESINFSILNKHIPDNPSIPFSFTNETVWIKPEDQLPCYLTHTNPRVDEIVLKNLHLNSHVKETTRGPRYCPSIESKVLRFPNRLHQVWLEPEGMDSDLIYPQGLSMTLPAELQEKMITCIRGLEKAKVIQPGYGVQYDYLDPRQITPSLETHLVQRLFFAGQINGTTGYEEAAAQGVIAGINASLRVSRKPPFVVSRTEGYIGVLIDDLTTLGTSEPYRMFTSRVEFRLSLRPDNADSRLTLRGYKDAGCVSQQRYERACWMKSSLEEGISVLKSIEFLSSKWKKLIPEASISTSRSLPVRRGGRHLNPSYLGGRGRRIV

SEQ ID NO: 836944 - protein, 656 aa, Homo sapiens; identical to SEQ ID NO: 836940

SEQ ID NO: 836945 - protein, 596 aa, Homo sapiens; identical to SEQ ID NO: 836943

SEQ ID NO: 836946 - protein, 620 aa, Homo sapiens
ARGALQIVSCCVSFFDRHSCQLQSQIDFSPSMFYFRGCGRWVAVSFTKQQFPLARLSSDSAAPRTPHFDVIVIGGGHAGTEAATAAARCGSRTLLLTHRVDTIGQMSCNPSFGGIGKGHLMREVDALDGLCSRICDQSGVHYKVLNRRKGPAVWGLRAQIDRKLYKQNMQKEILNTPLLTVQEGAVEDLILTEPEPEHTGKCRVSGVVLVDGSTVYAESVILTTGTFLRGMIVIGLETHPAGRLGDQPSIGLAQTLEKLGFVVGRLKTGTPPRIAKESINFSILNKHIPDNPSIPFSFTNETVWIKPEDQLPCYLTHTNPRVDEIVLKNLHLNSHVKETTRGPRYCPSIESKVLRFPNRLHQVWLEPEGMDSDLIYPQGLSMTLPAELQEKMITCIRGLEKAKVIQPGYGVQYDYLDPRQITPSLETHLVQRLFFAGQINGTTGYEEAAAQGVIAGINASLRVSRKPPFVVSRTEGYIGVLIDDLTTLGTSEPYRMFTSRVEFRLSLRPDNADSRLTLRGYKDAGCVSQQRYERACWMKSSLEEGISVLKSIEFLSSKWKKLIPEASISTSRSLPVRALDVLKYEEVDMDSLAKAVPEPLKKYTKCRELAERLKIEDRGC

SEQ ID NO: 836947 - protein, 215 aa, Homo sapiens
ARGALQIVSCCVSFFDRHSCQLQSQIDFSPSMFYFRGCGRWVAVSFTKQQFPLARLSSDSAAPRTPHFDVIVIGGGHAGTEAATAAARCGSRTLLLTHRVDTIGQMSCNPSFGGIGKGHLMREVDALDGLCSRICDQSGVHYKVLNRRKGPAVWGLRAQIDRKLYKQNMQKEILNTPLLTVQEGAVEDLILTEPEPEHTGKCRVSGVVLGWSAVA

SEQ ID NO: 836948 - protein, 196 aa, Homo sapiens
MVGGLKRKHSDLEEEEERWEWSPAGLQSYQQALLRISLDKVQRSLGPRAPSLRRHVLIHNTLQQLQAALRLAPAPALPPEPLFLGEEDFSLSATIGSILRELDTSMDGTEPPQNPVTPLGLQNEVPPQPDPVFLEALSSRYLGDSGLDDFFLDIDTSAVEKEPARAPPEPPHNLFCAPGSWEWNELDHIMEIILGS

SEQ ID NO: 836949 - protein, 196 aa, Homo sapiens; identical to SEQ ID NO: 836948

SEQ ID NO: 836950 - protein, 196 aa, Homo sapiens; identical to SEQ ID NO: 836948

SEQ ID NO: 836951 - protein, 196 aa, Homo sapiens; identical to SEQ ID NO: 836948

SEQ ID NO: 836952 - protein, 196 aa, Homo sapiens; identical to SEQ ID NO: 836948

SEQ ID NO: 836953 - protein, 196 aa, Homo sapiens; identical to SEQ ID NO: 836948

SEQ ID NO: 836954 - protein, 132 aa, Homo sapiens
MEAVRMNWKERLWERQRDENKPGLALPCAHTGELCAPGCVSWYMRLSEGSWGALLAQRLRGRPRKPFFALVRVCCIFPSPGNGTQFFFFLCKIISITIGCAHENAFCFHRNVFSHSVLILISVKLSKHITKF

SEQ ID NO: 836955 - protein, 294 aa, Homo sapiens
MFTCFPKCLGFSPPVNVTVSPRSEESHTTTVSGGNGSVFQAGPQLQALANLEARRGSIGAALSSRDVSGLPVYAQSGEPRRLTQAQVAAFPGENALEHSSDQDTWDSLRSPGFCSPLSSGGGAESLPPGGPGHAEAGHLGKVCDFHLNHQQPSPTSVLPTEVAAPPLEKILSVDSVAVDCAYRTVPKPGPQPGPHGSLLTEGCLRSLSGDLNRFPCGMEVHSGQRELESVVAVGEAMAFEISNGSHELLSQGQKQIFIQTSDGLILSPPGTIVSQEEDIVTVTDAEGRACGWAR

SEQ ID NO: 836956 - protein, 202 aa, Homo sapiens
TRVRVPASAAMADAEPEAGGGSEDGGGGGGPAPPGQSGSVARVAPLGPEQLRQVLEQVTKAQPPPPPPPFVLRDAARRLRDAGQQAALQRGRGTEPPRLPRLLPPQVRRREGRGETEARRGPTPRGGVAACPGRPVSARVKTQGVPRLSFLGTAFGPHLSPPWHFHPRSLTLGAVAHAGPCAWNALVPSLPSQPCWGLLRAP

SEQ ID NO: 836957 - protein, 736 aa, Homo sapiens
MLLPTTIQPQTARKSQLPRGNSCLVGLHIASPQLLRVQPLVRTEPQSCFLSDLCQPPAQGFVQRPLPALQVVPAKRVPAPKAPDEQGSMLTPLSASDPLAVTSLSSSSAHPFISNLHTRHTEKLKKSLKVKTRSGRVSRPPKYKAKDYKFIKTEDLADGHLSDSDDYSELCVEEDEDQRERHALFDLSSCSLRPKSFKCQTCEKSYIGKGGLARHFKLNPGHGQLDPEMVLSEKASGSTLRGCTEERTLSLTSLGLSMPADPCEGGARSCLVTESARGGLQFLQQCDREDLVELALPQLAQVVTVYEFLLMKVEKDHLAKPFFPAIYKEFEELHKMVKKMCQDYLSSSGLCSQETLEINNDKVAESLGITEFLRKKEIHPDNLGPKHLSRDMDGEQLEGASSEKREREAAEEGLASVKRPRREALSNDTTESLAANSRGREKPRPLHALAAGFSPPVNVTVSPRSEESHTTTVSGGNGSVFQAGPQLQALANLEARRGSIGAALSSRDVSGLPVYAQSGEPRRLTQAQVAAFPGENALEHSSDQDTWDSLRSPGFCSPLSSGGGAESLPPGGPGHAEAGHLGKVCDFHLNHQQPSPTSVLPTEVAAPPLEKILSVDSVAVDCAYRTVPKPGPQPGPHGSLLTEGCLRSLSGDLNRFPCGMEVHSGQRELESVVAVGEAMAFEISNGSHELLSQGQKQIFIQTSDGLILSPPGTIVSQEEDIVTVTDAEGRACGWAR

SEQ ID NO: 836958 - protein, 426 aa, Homo sapiens
MKVEKDHLAKPFFPAIYKEFEELHKMVKKMCQDYLSSSGLCSQETLEINNDKVAESLGITEFLRKKEIHPDNLGPKHLSRDMDGEQLEGASSEKREREAAEEGLASVKRPRREALSNDTTESLAANSRGREKPRPLHALAAGFSPPVNVTVSPRSEESHTTTVSGGNGSVFQAGPQLQALANLEARRGSIGAALSSRDVSGLPVYAQSGEPRRLTQAQVAAFPGENALEHSSDQDTWDSLRSPGFCSPLSSGGGAESLPPGGPGHAEAGHLGKVCDFHLNHQQPSPTSVLPTEVAAPPLEKILSVDSVAVDCAYRTVPKPGPQPGPHGSLLTEGCLRSLSGDLNRFPCGMEVHSGQRELESVVAVGEAMAFEISNGSHELLSQGQKQIFIQTSDGLILSPPGTIVSQEEDIVTVTDAEGRACGWAR

SEQ ID NO: 836959 - protein, 677 aa, Homo sapiens
TRVRVPASAAMADAEPEAGGGSEDGGGGGGPAPPGQSGSVARVAPLGPEQLRQVLEQVTKAQPPPPPPPFVLRDAARRLRDAGQQAALQRGRGTEPPRLPRLLPPQQLEAICVKVTSGETKGQERPMLLPTTIQPQTARKSQLPRGNSCLVGLHIASPQLLRVQPLVRTEPQSCFLSDLCQPPAQGFVQRPLPALQVVPAKRVPAPKAPDEQGSMLTPLSASDPLAVTSLSSSSAHPFISNLHTRHTEKLKKSLKVKTRSGRVSRPPKYKAKDYKFIKTEDLADGHLSDSDDYSELCVEEDEDQRERHALFDLSSCSLRPKSFKCQTCEKSYIGKGGLARHFKLNPGHGQLDPEMVLSEKASGSTLRGCTEERTLSLTSLGLSMPADPCEGGARSCLVTESARGGLQNGQSVDVEETLPSEPENGALLRSERYQGPRRRACSETLAESRTAVLQQRRAAQLPGGPAAAGEQRASPSKARLKEFLQQCDREDLVELALPQLAQVVTVYEFLLMKVEKDHLAKPFFPAIYKEFEELHKMVKKMCQDYLSSSGLCSQETLEINNDKVAESLGITEFLRKKEIHPDNLGPKHLSRDMDGEQLEGASSEKREREAAEEGLASVKRPRREALSNDTTESLAANSRGREKPRPLHALAAGTIVSQEEDIVTVTDAEGRACGWAR

SEQ ID NO: 836960 - protein, 862 aa, Homo sapiens
TRVRVPASAAMADAEPEAGGGSEDGGGGGGPAPPGQSGSVARVAPLGPEQLRQVLEQVTKAQPPPPPPPFVLRDAARRLRDAGQQAALQRGRGTEPPRLPRLLPPQQLEAICVKVTSGETKGQERPMLLPTTIQPQTARKSQLPRGNSCLVGLHIASPQLLRVQPLVRTEPQSCFLSDLCQPPAQGFVQRPLPALQVVPAKRVPAPKAPDEQGSMLTPLSASDPLAVTSLSSSSAHPFISNLHTRHTEKLKKSLKVKTRSGRVSRPPKYKAKDYKFIKTEDLADGHLSDSDDYSELCVEEDEDQRERHALFDLSSCSLRPKSFKCQTCEKSYIGKGGLARHFKLNPGHGQLDPEMVLSEKASGSTLRGCTEERTLSLTSLGLSMPADPCEGGARSCLVTESARGGLQFLQQCDREDLVELALPQLAQVVTVYEFLLMKVEKDHLAKPFFPAIYKEFEELHKMVKKMCQDYLSSSGLCSQETLEINNDKVAESLGITEFLRKKEIHPDNLGPKHLSRDMDGEQLEGASSEKREREAAEEGLASVKRPRREALSNDTTESLAANSRGREKPRPLHALAAGFSPPVNVTVSPRSEESHTTTVSGGNGSVFQAGPQLQALANLEARRGSIGAALSSRDVSGLPVYAQSGEPRRLTQAQVAAFPGENALEHSSDQDTWDSLRSPGFCSPLSSGGGAESLPPGGPGHAEAGHLGKVCDFHLNHQQPSPTSVLPTEVAAPPLEKILSVDSVAVDCAYRTVPKPGPQPGPHGSLLTEGCLRSLSGDLNRFPCGMEVHSGQRELESVVAVGEAMAFEISNGSHELLSQGQKQIFIQTSDGLILSPPGTIVSQEEDIVTVTDAEGRACGWAR

SEQ ID NO: 836961 - protein, 937 aa, Homo sapiens
TRVRVPASAAMADAEPEAGGGSEDGGGGGGPAPPGQSGSVARVAPLGPEQLRQVLEQVTKAQPPPPPPPFVLRDAARRLRDAGQQAALQRGRGTEPPRLPRLLPPQQLEAICVKVTSGETKGQERPMLLPTTIQPQTARKSQLPRGNSCLVGLHIASPQLLRVQPLVRTEPQSCFLSDLCQPPAQGFVQRPLPALQVVPAKRVPAPKAPDEQGSMLTPLSASDPLAVTSLSSSSAHPFISNLHTRHTEKLKKSLKVKTRSGRVSRPPKYKAKDYKFIKTEDLADGHLSDSDDYSELCVEEDEDQRERHALFDLSSCSLRPKSFKCQTCEKSYIGKGGLARHFKLNPGHGQLDPEMVLSEKASGSTLRGCTEERTLSLTSLGLSMPADPCEGGARSCLVTESARGGLQNGQSVDVEETLPSEPENGALLRSERYQGPRRRACSETLAESRTAVLQQRRAAQLPGGPAAAGEQRASPSKARLKEFLQQCDREDLVELALPQLAQVVTVYEFLLMKVEKDHLAKPFFPAIYKEFEELHKMVKKMCQDYLSSSGLCSQETLEINNDKVAESLGITEFLRKKEIHPDNLGPKHLSRDMDGEQLEGASSEKREREAAEEGLASVKRPRREALSNDTTESLAANSRGREKPRPLHALAAGFSPPVNVTVSPRSEESHTTTVSGGNGSVFQAGPQLQALANLEARRGSIGAALSSRDVSGLPVYAQSGEPRRLTQAQVAAFPGENALEHSSDQDTWDSLRSPGFCSPLSSGGGAESLPPGGPGHAEAGHLGKVCDFHLNHQQPSPTSVLPTEVAAPPLEKILSVDSVAVDCAYRTVPKPGPQPGPHGSLLTEGCLRSLSGDLNRFPCGMEVHSGQRELESVVAVGEAMAFEISNGSHELLSQGQKQIFIQTSDGLILSPPGTIVSQEEDIVTVTDAEGRACGWAR

SEQ ID NO: 836962 - protein, 677 aa, Homo sapiens; identical to SEQ ID NO: 836959

SEQ ID NO: 836963 - protein, 488 aa, Homo sapiens
MDERNRQVTFTKRKFGLMKKAYELSVLCDCEIALIIFNSSNKLFQYASTDMDKVLLKYTEYNEPHESRTNSDIVEALNKKEHRGCDSPDPDTSYVLTPHTEEKYKKINEEFDNMMRNHKIAPGLPPQNFSMSVTVPVTSPNALSYTNPGSSLVSPSLAASSTLTDSSMLSPPQTTLHRNVSPGAPQRPPSTGNAGGMLSTTDLTVPNGAGSSPVGNGFVNSRASPNLIGATGANSLGKVMPTKSPPPPGGGNLGMNSRKPDLRVVIPPSSKGMMPPLNTQRISSSQATQPLATPVVSVTTPSLPPQGLVYSAMPTAYNTDYSLTSADLSALQGFNSPGMLSLGQVSAWQQHHLGQAALSSLVAGGQLSQGSNLSINTNQNISIKSEPISPPRDRMTPSGFQQQQQQQQQQQPPPPPQPQPQPPQPQPRQEMGRSPVDSLSSSSSSYDGSDREDPRGDFHSPIVLGRPPNTEDRESPSVKRMRMDAWVT

SEQ ID NO: 836964 - protein, 496 aa, Homo sapiens
MDERNRQVTFTKRKFGLMKKAYELSVLCDCEIALIIFNSSNKLFQYASTDMDKVLLKYTEYNEPHESRTNSDIVEALNKKEHRGCDSPDPDTSYVLTPHTEEKYKKINEEFDNMMRNHKIAPGLPPQNFSMSVTVPVTSPNALSYTNPGSSLVSPSLAASSTLTDSSMLSPPQTTLHRNVSPGAPQRPPSTGNAGGMLSTTDLTVPNGAGSSPVGNGFVNSRASPNLIGATGANSLGKVMPTKSPPPPGGGNLGMNSRKPDLRVVIPPSSKGMMPPLSEEEELELNTQRISSSQATQPLATPVVSVTTPSLPPQGLVYSAMPTAYNTDYSLTSADLSALQGFNSPGMLSLGQVSAWQQHHLGQAALSSLVAGGQLSQGSNLSINTNQNISIKSEPISPPRDRMTPSGFQQQQQQQQQQQPPPPPQPQPQPPQPQPRQEMGRSPVDSLSSSSSSYDGSDREDPRGDFHSPIVLGRPPNTEDRESPSVKRMRMDAWVT

SEQ ID NO: 836965 - protein, 496 aa, Homo sapiens; identical to SEQ ID NO: 836964

SEQ ID NO: 836966 - protein, 486 aa, Homo sapiens
MDERNRQVTFTKRKFGLMKKAYELSVLCDCEIALIIFNSSNKLFQYASTDMDKVLLKYTEYNEPHESRTNSDIVETLRKKGLNGCESPDADDYFEHSPLSEDRFSKLNEDSDFIFKRGPPGLPPQNFSMSVTVPVTSPNALSYTNPGSSLVSPSLAASSTLTDSSMLSPPQTTLHRNVSPGAPQRPPSTGNAGGMLSTTDLTVPNGAGSSPVGNGFVNSRASPNLIGATGANSLGKVMPTKSPPPPGGGNLGMNSRKPDLRVVIPPSSKGMMPPLNTQRISSSQATQPLATPVVSVTTPSLPPQGLVYSAMPTAYNTDYSLTSADLSALQGFNSPGMLSLGQVSAWQQHHLGQAALSSLVAGGQLSQGSNLSINTNQNISIKSEPISPPRDRMTPSGFQQQQQQQQQQQPPPPPQPQPQPPQPQPRQEMGRSPVDSLSSSSSSYDGSDREDPRGDFHSPIVLGRPPNTEDRESPSVKRMRMDAWVT

SEQ ID NO: 836967 - protein, 496 aa, Homo sapiens; identical to SEQ ID NO: 836964

SEQ ID NO: 836968 - protein, 537 aa, Homo sapiens
MDERNRQVTFTKRKFGLMKKAYELSVLCDCEIALIIFNSSNKLFQYASTDMDKVLLKYTEYNEPHESRTNSDIVETLRKKGLNGCESPDADDYFEHSPLSEDRFSKLNEDSDFIFKRGPVKYFYFTSTFYLLILFVNFIIYAALNKKEHRGCDSPDPDTSYVLTPHTEEKYKKINEEFDNMMRNHKIAPGLPPQNFSMSVTVPVTSPNALSYTNPGSSLVSPSLAASSTLTDSSMLSPPQTTLHRNVSPGAPQRPPSTGNAGGMLSTTDLTVPNGAGSSPVGNGFVNSRASPNLIGATGANSLGKVMPTKSPPPPGGGNLGMNSRKPDLRVVIPPSSKGMMPPLNTQRISSSQATQPLATPVVSVTTPSLPPQGLVYSAMPTAYNTDYSLTSADLSALQGFNSPGMLSLGQVSAWQQHHLGQAALSSLVAGGQLSQGSNLSINTNPSGFQQQQQQQQQQQPPPPPQPQPQPPQPQPRQEMGRSPVDSLSSSSSSYDGSDREDPRGDFHSPIVLGRPPNTEDRESPSVKRMRMDAWVT

SEQ ID NO: 836969 - protein, 158 aa, Homo sapiens
MPTAYNTDYSLTSADLSALQGFNSPGMLSLGQVSAWQQHHLGQAALSSLVAGGQLSQGSNLSINTNPSGFQQQQQQQQQQQPPPPPQPQPQPPQPQPRQEMGRSPVDSLSSSSSSYDGSDREDPRGDFHSPIVLGRPPNTEDRESPSVKRMRMDAWVT

SEQ ID NO: 836970 - protein, 555 aa, Homo sapiens
MDERNRQVTFTKRKFGLMKKAYELSVLCDCEIALIIFNSSNKLFQYASTDMDKVLLKYTEYNEPHESRTNSDIVETLRKKGLNGCESPDADDYFEHSPLSEDRFSKLNEDSDFIFKRGPVKYFYFTSTFYLLILFVNFIIYAALNKKEHRGCDSPDPDTSYVLTPHTEEKYKKINEEFDNMMRNHKIAPGLPPQNFSMSVTVPVTSPNALSYTNPGSSLVSPSLAASSTLTDSSMLSPPQTTLHRNVSPGAPQRPPSTGNAGGMLSTTDLTVPNGAGSSPVGNGFVNSRASPNLIGATGANSLGKVMPTKSPPPPGGGNLGMNSRKPDLRVVIPPSSKGMMPPLNTQRISSSQATQPLATPVVSVTTPSLPPQGLVYSAMPTAYNTDYSLTSADLSALQGFNSPGMLSLGQVSAWQQHHLGQAALSSLVAGGQLSQGSNLSINTNQNISIKSEPISPPRDRMTPSGFQQQQQQQQQQQPPPPPQPQPQPPQPQPRQEMGRSPVDSLSSSSSSYDGSDREDPRGDFHSPIVLGRPPNTEDRESPSVKRMRMDAWVT

SEQ ID NO: 836971 - protein, 131 aa, Homo sapiens
MDERNRQVTFTKRKFGLMKKAYELSVLCDCEIALIIFNSSNKLFQYASTDMDKVLLKYTEYNEPHESRTNSDIVETLRKKGLNGCESPDADDYFEHSPLSEDRFSKLNEDSDFIFKRGPVSTFTLPLLFIC

SEQ ID NO: 836972 - protein, 67 aa, Homo sapiens
APVWGSVRGCPGESRAERGGSGRREALVAGPGCGVCAPASCSGDTELHFVKKEQEFSARIISKCTFC

SEQ ID NO: 836973 - protein, 496 aa, Homo sapiens; identical to SEQ ID NO: 836964

SEQ ID NO: 836974 - protein, 488 aa, Homo sapiens; identical to SEQ ID NO: 836963

SEQ ID NO: 836975 - protein, 496 aa, Homo sapiens; identical to SEQ ID NO: 836964

SEQ ID NO: 836976 - protein, 496 aa, Homo sapiens; identical to SEQ ID NO: 836964

SEQ ID NO: 836977 - protein, 117 aa, Homo sapiens
ESLSELLHGLRVEIHMKITKCNYDAILLFFGSGTCSYYVGITFLIIFDPERSRSKNQDKTAKQKVCLFLAKRKRREGVLTSQGRERRSLIPGRCWEQGLQKTCAFAVRTFCRDTPGS

SEQ ID NO: 836978 - protein, 244 aa, Homo sapiens
MDVATGQEVAIKQMNLQQQPKKELIINEILVMRENKNPNIVNYLDSYLVGDELWVVMEYLAGGSLTDVVTETCMDEGQIAAVCRECLQALEFLHSNQVIHRDIKSDNILLGMDGSVKLTDFGFCAQITPEQSKRSTMVGTPYWMAPEVVTRKAYGPKVDIWSLGIMAIEMIEGEPPYLNENPLRALYLIATNGTPELQNPEKLSAIFRDFLNRCLEMDVEKRGSAKELLQIITASFPETGQTVI

SEQ ID NO: 836979 - protein, 131 aa, Homo sapiens
FTHTPDVSSVWKMQSVMKGRKNILPAVALLQSTKWEEAMNINVLGDNIMLSPTPVIAPRPEHTKSVYTRSVIEPLPVTPTRDVATSPISPTENNTTPPDALTRNTEKQKKKPKMSDEEILEKLRSIVSVGR

SEQ ID NO: 836980 - protein, 258 aa, Homo sapiens
MDVATGQEVAIKQMNLQQQPKKELIINEILVMRENKNPNIVNYLDSYLVGDELWVVMEYLAGGSLTDVVTETCMDEGQIAAVCRECLQALEFLHSNQVIHRDIKSDNILLGMDGSVKLTDFGFCAQITPEQSKRSTMVGTPYWMAPEVVTRKAYGPKVDIWSLGIMAIEMIEGEPPYLNENPLRALYLIATNGTPELQNPEKLSAIFRDFLNRCLEMDVEKRGSAKELLQHQFLKIAKPLSSLTPLIAAAKEATKNNH

SEQ ID NO: 836981 - protein, 266 aa, Homo sapiens
MDVATGQEVAIKQMNLQQQPKKELIINEILVMRENKNPNIVNYLDSYLVGDELWVVMEYLAGGSLTDVVTETCMDEGQIAAVCRECLQALEFLHSNQVIHRDIKSDNILLGMDGSVKLTDFGFCAQITPEQSKRSTMVGTPYWMAPEVVTRKAYGPKVDIWSLGIMAIEMIEGEPPYLNENPLRALYLIATNGTPELQNPEKLSAIFRDFLNRCLEMDVEKRGSAKELLQVRKLRFQVFSNFSMIAASIPEDCQAPLQPHSTDCCS

SEQ ID NO: 836982 - protein, 266 aa, Homo sapiens; identical to SEQ ID NO: 836981

SEQ ID NO: 836983 - protein, 258 aa, Homo sapiens; identical to SEQ ID NO: 836980

SEQ ID NO: 836984 - protein, 258 aa, Homo sapiens; identical to SEQ ID NO: 836980

SEQ ID NO: 836985 - protein, 258 aa, Homo sapiens; identical to SEQ ID NO: 836980

SEQ ID NO: 836986 - protein, 258 aa, Homo sapiens; identical to SEQ ID NO: 836980

SEQ ID NO: 836987 - protein, 258 aa, Homo sapiens; identical to SEQ ID NO: 836980

SEQ ID NO: 836988 - protein, 202 aa, Homo sapiens
MDVATGQEVAIKQMNLQQQPKKELIINEILVMRENKNPNIVNYLDSYLVGDELWVVMEYLAGGSLTDVVTETCMDEGQIAAVCRECLQALEFLHSNQVIHRDIKSDNILLGMDGSVKLTDFGFCAQITPEQSKRSTMVGTPYWMAPEVVTRKAYGPKVDIWSLGIMAIEMIEGEPPYLNENPLRRLLVPLHLAHPNIGGIPP

SEQ ID NO: 836989 - protein, 206 aa, Homo sapiens
MSNNGLDIQDKPPAPPMRNTSTMIGAGSKDAGTLNHGSKPLPPNPEEKKKKDRFYRSILPGDKTNKKKEKERPEISLPSDFEHTIHVGFDAVTGEFTGMPEQWARLLQTSNITKSEQKKNPQAVLDVLEFYNSKKTSNSQKYMSFTDKSAEDYNSSNALNVKAVSETPAVPPVSEDEDDDDDDVIPNTSDCSTPRAHKICIHTVCD

SEQ ID NO: 836990 - protein, 206 aa, Homo sapiens; identical to SEQ ID NO: 836989

SEQ ID NO: 836991 - protein, 161 aa, Homo sapiens
MSNNGLDIQDKPPAPPMRNTSTMIGAGSKDAGTLNHGSKPLPPNPEEKKKKDRFYRSILPGDKTNKKKEKERPEISLPSDFEHTIHVGFDAVTGEFTGMPEQWARLLQTSNITKSEQKKNPQAVLDVLEFYNSKKTSNSQKYMSFTGMRTASRAVSARDGF

SEQ ID NO: 836992 - protein, 258 aa, Homo sapiens; identical to SEQ ID NO: 836980

SEQ ID NO: 836993 - protein, 90 aa, Homo sapiens
MLSPTPVIAPRPEHTKSVYTRSVIEPLPVTPTRDVATSPISPTENNTTPPDALTRNTEKQKKKPKMSDEEILEKLRSIVSVGRYVRGPKS

SEQ ID NO: 836994 - protein, 266 aa, Homo sapiens; identical to SEQ ID NO: 836981

SEQ ID NO: 836995 - protein, 266 aa, Homo sapiens; identical to SEQ ID NO: 836981

SEQ ID NO: 836996 - protein, 266 aa, Homo sapiens; identical to SEQ ID NO: 836981

SEQ ID NO: 836997 - protein, 258 aa, Homo sapiens; identical to SEQ ID NO: 836980

SEQ ID NO: 836998 - protein, 258 aa, Homo sapiens; identical to SEQ ID NO: 836980

SEQ ID NO: 836999 - protein, 258 aa, Homo sapiens; identical to SEQ ID NO: 836980

SEQ ID NO: 837000 - protein, 258 aa, Homo sapiens; identical to SEQ ID NO: 836980

SEQ ID NO: 837001 - protein, 258 aa, Homo sapiens; identical to SEQ ID NO: 836980

SEQ ID NO: 837002 - protein, 206 aa, Homo sapiens; identical to SEQ ID NO: 836989

SEQ ID NO: 837003 - protein, 206 aa, Homo sapiens; identical to SEQ ID NO: 836989

SEQ ID NO: 837004 - protein, 113 aa, Homo sapiens
ESASVLHLGSWRLSCQEPSPAESSGAGGAGALWVPGWAGRGAALRRKQSPEMPGLAFPTRLVAIQKLKLASVVALKCRSRNVDAHVVSIVEGSTRGCDNAEEGTFDLARQWQS

SEQ ID NO: 837005 - protein, 615 aa, Homo sapiens
MENFELINKSIANPTQVKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKAVCSQEAMTGPCRAVMPRWYFDLSKGKCVRFIYGGCGGNRNNFESEDYCMAVCKAMIPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEGSGVGEQDGGLIGAEEKVINSKNKVDENMVIDETLDVKEMIFNAERVGGLEEERESVGPLREDFSLSSSALIGLLVIAVAIATVIVISLVMLRKRQYGTISHGIVEVDPMLTPEERHLNKMQNHGYENPTYKYLEQMQI

SEQ ID NO: 837006 - protein, 539 aa, Homo sapiens
MEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKVPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEGSGVGEQDGGLIGAEEKVINSKNKVDENMVIDETLDVKEMIFNAERVGGLEEERESVGPLREDFSLSSSALIGLLVIAVAIATVIVISLVMLRKRQYGTISHGIVEVDPMLTPEERHLNKMQNHGYENPTYKYLEQMQI

SEQ ID NO: 837007 - protein, 664 aa, Homo sapiens
MENFELINKSIANPTQVKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDPGNKYDTSLHIRKDKLSEFPTEADLEDFTEAAVDEDDEDEEEGEEVVEDRDYYYDTFKGDDYNEENPTEPGSDGTMSDKEITHDVKAVCSQEAMTGPCRAVMPRWYFDLSKGKCVRFIYGGCGGNRNNFESEDYCMAVCKAMIPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEGSGVGEQDGGLIGAEEKVINSKNKVDENMVIDETLDVKEMIFNAERVGGLEEERESVGPLREDFSLSSSALIGLLVIAVAIATVIVISLVMLRKRQYGTISHGIVEVDPMLTPEERHLNKMQNHGYENPTYKYLEQMQI

SEQ ID NO: 837008 - protein, 571 aa, Homo sapiens
MENFELINKSIANPTQVKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKVPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEDTQPELYHPMKKGSGVGEQDGGLIGAEEKVINSKNKVDENMVIDETLDVKEMIFNAERVGGLEEERESVGPLREDFSLSSSALIGLLVIAVAIATVIVISLVMLRKRQYGTISHGIVEVDPMLTPEERHLNKMQNHGYENPTYKYLEQMQI

SEQ ID NO: 837009 - protein, 567 aa, Homo sapiens
MEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKVPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEDTQPELYHPMKKAHVISLPELSVSRDPPGSGVGEQDGGLIGAEEKVINSKNKVDENMVIDETLDVKEMIFNAERVGGLEEERESVGPLREDFSLSSSALIGLLVIAVAIATVIVISLVMLRKRQYGTISHGIVEVDPMLTPEERHLNKMQNHGYENPTYKYLEQMQI

SEQ ID NO: 837010 - protein, 442 aa, Homo sapiens
MENFELINKSIANPTQVKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKVPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEGSGVGEQDGGLIGAEEKVINSH

SEQ ID NO: 837011 - protein, 508 aa, Homo sapiens
MENFELINKSIANPTQVKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKVPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIGSGVGEQDGGLIGAEEKVINSKNKVDENMVIDETLDVKEMIFNAERVGGLEEERESVGPLREDFSLSSSALIGLLVIAVAIATVIVISLVMLRKRQYGTISHGIVEVDPMLTPEERHLNKMQNHGYENPTYKYLEQMQI

SEQ ID NO: 837012 - protein, 482 aa, Homo sapiens
MENFELINKSIANPTQVKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKVPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEGSGVGEQDGGLIGAEEKVINSKNKVDENMVDPMLTPEERHLNKMQNHGYENPTYKYLEQMQI

SEQ ID NO: 837013 - protein, 615 aa, Homo sapiens; identical to SEQ ID NO: 837005

SEQ ID NO: 837014 - protein, 615 aa, Homo sapiens; identical to SEQ ID NO: 837005

SEQ ID NO: 837015 - protein, 615 aa, Homo sapiens; identical to SEQ ID NO: 837005

SEQ ID NO: 837016 - protein, 615 aa, Homo sapiens; identical to SEQ ID NO: 837005

SEQ ID NO: 837017 - protein, 518 aa, Homo sapiens
MENFELINKSIANPTQVKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKVPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEDTQPELYHPMKKGSGVGEQDGGLIGAEEKVINSKNKVDENMCRLLLSGLSPKALTLGLYFVPSPPPPPVTGLVTFTQRRPHQGRRPLAQERTRGGLFV

SEQ ID NO: 837018 - protein, 484 aa, Homo sapiens
MENFELINKSIANPTQVKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKAVCSQEAMTGPCRAVMPRWYFDLSKGKCVRFIYGGCGGNRNNFESEDYCMAVCKAMIPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDPRPLLCPLTSTPSCHRPCDIHSEKTTPRKAAAGPGENTGRFVCVKGK

SEQ ID NO: 837019 - protein, 424 aa, Homo sapiens
MENFELINKSIANPTQVKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKAVCSQEAMTGPCRAVMPRWYFDLSKGKCVRFIYGGCGGNRNNFESEDYCMAVCKAMIPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQPPVTGLVTFTQRRPHQGRRPLAQERTRGGLFV

SEQ ID NO: 837020 - protein, 615 aa, Homo sapiens; identical to SEQ ID NO: 837005

SEQ ID NO: 837021 - protein, 538 aa, Homo sapiens
MENFELINKSIANPTQVKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKVPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEDTQPELYHPMKKGSGVGEQDGGLIGAEEKVINSKNKVDENMVIDETLDVKEMIFNAERVGGLEEERESVGPLREDFSLSSSALIGLLVIAVAIATVIVISLVMLRKRQYGTISHGIVE

SEQ ID NO: 837022 - protein, 462 aa, Homo sapiens
MENFELINKSIANPTQVKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKVPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEGSGVGEQDGGLIGAEEKVINSKNKVDENMVSLFFLLPNTLYF

SEQ ID NO: 837023 - protein, 432 aa, Homo sapiens
MENFELINKSIANPTQVKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKVPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEDTQPERALHVTK

SEQ ID NO: 837024 - protein, 432 aa, Homo sapiens
MENFELINKSIANPTQVKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKVPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEDLECRAEKRQVV

SEQ ID NO: 837025 - protein, 352 aa, Homo sapiens
MENFELINKSIANPTQVKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKVPPTPLPTNDVDVYFETSADDNEHARFQKAKEQLEIRHRNRMDRVKKEWEEAELQAKNLPKAERQTLIQHFQAMVKALEKEAASEKQQLVETHLARVEHIFKKLIHNIVHVYGVHVIFCYMHRICNDQVRVFRVSITSSIYHIYMLGTFQVLSSSYFEICNTLLLTIVTLLCYKTLELISF

SEQ ID NO: 837026 - protein, 179 aa, Homo sapiens
MENFELINKSIANPTQVKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDVPHPSDVLIPVTFLIPVTSKS

SEQ ID NO: 837027 - protein, 668 aa, Homo sapiens
MENFELINKSIANPTQVKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKAVCSQEAMTGPCRAVMPRWYFDLSKGKCVRFIYGGCGGNRNNFESEDYCMAVCKAMRTEGVFRKKHFGPLSSPLWSQGGWKQPVFAVPFFQSSNVNQRLRLQRSGLYSTVPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEGSGVGEQDGGLIGAEEKVINSKNKVDENMVIDETLDVKEMIFNAERVGGLEEERESVGPLREDFSLSSSALIGLLVIAVAIATVIVISLVMLRKRQYGTISHGIVEVDPMLTPEERHLNKMQNHGYENPTYKYLEQMQI

SEQ ID NO: 837028 - protein, 615 aa, Homo sapiens; identical to SEQ ID NO: 837005

SEQ ID NO: 837029 - protein, 615 aa, Homo sapiens; identical to SEQ ID NO: 837005

SEQ ID NO: 837030 - protein, 615 aa, Homo sapiens; identical to SEQ ID NO: 837005

SEQ ID NO: 837031 - protein, 505 aa, Homo sapiens
MENFELINKSIANPTQVKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKVPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEGSGVGEQDGGLIGAEEKVINSKNKVDENMVIDETLDVKEMIFNTWSRCRFRWQGARQPWRRDAGGPEDPTIPIDCQAAAAARGCV

SEQ ID NO: 837032 - protein, 615 aa, Homo sapiens; identical to SEQ ID NO: 837005

SEQ ID NO: 837033 - protein, 615 aa, Homo sapiens; identical to SEQ ID NO: 837005

SEQ ID NO: 837034 - protein, 506 aa, Homo sapiens
MENFELINKSIANPTQVKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKVPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEGSGVGEQDGGLIGAEEKVINSKNKVDENMCRLLLSGLSPKALTLGLYFVPSPPPPPVTGLVTFTQRRPHQGRRPLAQERTRGGLFV

SEQ ID NO: 837035 - protein, 373 aa, Homo sapiens
MEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKVPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQCRLLLSGLSPKALTLGLYFVPSPPPPPVTGLVTFTQRRPHQGRRPLAQERTRGGLFV

SEQ ID NO: 837036 - protein, 506 aa, Homo sapiens
MEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKVPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEGSGVGEQDGGLIGAEEKVINSKNKVDENMVIDETLDVKEMIFNAERVGGLEEERESVGPLREDFSLSSSALIGLLVIAVAIATVIVISLVMLRKRQYGTISHGIVE

SEQ ID NO: 837037 - protein, 573 aa, Homo sapiens
MENFELINKSIANPTQVKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKVPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEDTQPELYHPMKKGSGVGEQDGGLIGAEEKVINSKNKVDENMVIDETLDVKEMIFNAERVGGLEEERESVGPLREDFSLSSSALIGLLVIAVAIATVIVISLVMLRKRQYGTISHGIVEVGSNCSPQEEGSTTKMEGPIGVFEEPTHKITLEGK

SEQ ID NO: 837038 - protein, 529 aa, Homo sapiens
MENFELINKSIANPTQVKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKVPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEDTQPELYHPMKKGSGVGEQDGGLIGAEEKVINSKNKVDENMIDETLPTNDVDVYFETSADDNEHARFQKAKEQLEIRHRNRMDRVKKEWEEAELQAKNLPKADEVADEG

SEQ ID NO: 837039 - protein, 440 aa, Homo sapiens
MENFELINKSIANPTQVKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKVPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIACFLSPALSSSDELLQEQRADMDQFTASISETPVDVRVSSEESEEIPPFHPFHPFPALPENEGVYGRRCHF

SEQ ID NO: 837040 - protein, 223 aa, Homo sapiens
MENFELINKSIANPTQVKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKAVCSQEAMTGPCRAVMPRWYFDLSKGKCVRFIYGGCSRWMTSVTQETAMSHI

SEQ ID NO: 837041 - protein, 718 aa, Homo sapiens
RCGSGIVKLLISIRAVRAGGGRRRACGFQPSTRALSVQTSQALGRRRAMAETKIIYHMDEEETPYLVKLPVAPERVTLADFKNVLSNRPVHAYKFFFKSMDQDFGVVKEEIFDDNAKLPCFNGRVVSWLVLAEGAHSDAGSQGTDSHTDLPPPLERTGGIGDSRPPSFHPNVASSRDGMDNETGTESMVSHRRERARRRNREEAARTNGHPRGDRRRDVGLPPDSASTALSSELESSSFVDSDEDGSTSRLSSSTEQSTSSRLIRKHKRRRRKQRLRQADRASSFSSITDSTMSLNIVTVTLNMERHHFLGISIVGQSNDRGDGGIYIGSIMKGGAVAADGRIEPGDMLLQVNDVNFENMSNDDAVRVLREIVSQTGPISLTVAKCWDPTPRSYFTVPRADPVRPIDPAAWLSHTAALTGALPRYELEEAPLTVKSDMSAVVRVMQLPDSGLEIRDRMWLKITIANAVIGADVVDWLYTHVEGFKERREARKYASSLLKHGFLRHTVNKITFSEQCYYVFGDLCSNLATLNLNSGSSGTSDQDTLAPLPHPAAPWPLGQGYPYQYPGPPPCFPPAYQDPGFSYGSGSTGSQQSEGSKSSGSTRSSRRAPGREKERRAAGAGGSGSESDHTAPSGVGSSWRERPAGQLSRGSSPRSQASATAPGLPPPHPTTKAYTVVGGPPGGPPVRELAAVPPELTGSRQSFQKAMGNPCEFFVDIM

SEQ ID NO: 837042 - protein, 718 aa, Homo sapiens; identical to SEQ ID NO: 837041

SEQ ID NO: 837043 - protein, 744 aa, Homo sapiens
RCGSGIVKLLISIRAVRAGGGRRRACGFQPSTRALSVQTSQALGRRRAMAETKIIYHMDEEETPYLVKLPVAPERVTLADFKNVLSNRPVHAYKFFFKSMDQDFGVVKEEIFDDNAKLPCFNGRVVSWLVLAEGAHSDAGSQGTDSHTDLPPPLERTGGIGDSRPPSFHPNVASSRDGMDNETGTESMVSHRRERARRRNREEAARTNGHPRGDRRRDVGLPPDSASTALSSELESSSFVDSDEDGSTSRLSSSTEQSTSSRLIRKHKRRRRKQRLRQADRASSFSSITDSTMSLNIVTVTLNMERHHFLGISIVGQSNDRGDGGIYIGSIMKGGAVAADGRIEPGDMLLQVNDVNFENMSNDDAVRVLREIVSQTGPISLTVAKCWDPTPRSYFTVPRADPVRPIDPAAWLSHTAALTGALPRYDGTSPCSSAVTRTSSSSLTSSVPGAPQLEEAPLTVKSDMSAVVRVMQLPDSGLEIRDRMWLKITIANAVIGADVVDWLYTHVEGFKERREARKYASSLLKHGFLRHTVNKITFSEQCYYVFGDLCSNLATLNLNSGSSGTSDQDTLAPLPHPAAPWPLGQGYPYQYPGPPPCFPPAYQDPGFSYGSGSTGSQQSEGSKSSGSTRSSRRAPGREKERRAAGAGGSGSESDHTAPSGVGSSWRERPAGQLSRGSSPRSQASATAPGLPPPHPTTKAYTVVGGPPGGPPVRELAAVPPELTGSRQSFQKAMGNPCEFFVDIM

SEQ ID NO: 837044 - protein, 687 aa, Homo sapiens
RCGSGIVKLLISIRAVRAGGGRRRACGFQPSTRALSVQTSQALGRRRAMAETKIIYHMDEEETPYLVKLPVAPERVTLADFKNVLSNRPVHAYKFFFKSMDQDFGVVKEEIFDDNAKLPCFNGRVVSWLVLAEGAHSDAGSQGTDSHTDLPPPLERTGGIGDSRPPSFHPNVASSRDGMDNETGTESMVSHRRERARRRNREEAARTNGHPRGDRRRDVGLPPDSASTALSSELESSSFVDSDEDGSTSRLSSSTEQSTSSRLIRKHKRRRRKQRLRQADRASSFSSITDSTMSLNIVTVTLNMERHHFLGISIVGQSNDRGDGGIYIGSIMKGGAVAADGRIEPGDMLLQVNDVNFENMSNDDAVRVLREIVSQTGPISLTVAKCWDPTPRSYFTVPRADPVRPIDPAAWLSHTAALTGALPRYELEEAPLTVKSDMSAVVRVMQLPDSGLEIRDRMWLKITIANAVIGADVVDWLYTHVEGFKERREARKYASSLLKHGFLRHTVNKITFSEQCYYVFGDLCSMAPVGLRIRTRWPRCPTRLPPGLWVRATPTSTRDPHPASRLPTRTRALAMAAAAPGVSRVKGAKAVGPPGAAAGPRAVRRSVGRRELGAVAVNRITRHRVGWGAAGESVRPASSAVAAAHAVRPRLPPRGSPRPTPRPRPIQWWGGHPGDPLSGSWLPSPRN

SEQ ID NO: 837045 - protein, 592 aa, Homo sapiens
RCGSGIVKLLISIRAVRAGGGRRRACGFQPSTRALSVQTSQALGRRRAMAETKIIYHMDEEETPYLVKLPVAPERVTLADFKNVLSNRPVHAYKFFFKSMDQDFGVVKEEIFDDNAKLPCFNGRVVSWLVLAEGAHSDAGSQGTDSHTDLPPPLERTGGIGDSRPPSFHPNVASSRDGMDNETGTESMVSHRRERARRRNREEAARTNGHPRGDRRRDVGLPPDSASTALSSELESSSFVDSDEDGSTSRLSSSTEQSTSSRLIRKHKRRRRKQRLRQADRASSFSSITDSTMSLNIVTVTLNMERHHFLGISIVGQSNDRGDGGIYIGSIMKGGAVAADGRIEPGDMLLQVNDVNFENMSNDDAVRVLREIVSQTGPISLTVAKCWDPTPRSYFTVPRADPVRPIDPAAWLSHTAALTGALPRYDGTSPCSSAVTRTSSSSLTSSVPGAPQLEEAPLTVKSDMSAVVRVMQLPDSGLEIRDRMWLKITIANAVIGADVVDWLYTHVEGFKERREARKYASSLLKHGFLRHTQGAPMCTAATGREVLGRWAVRWPVLGECTHCAHTSRPSWLLWPPRVCAVDTVSKSQRLDG

SEQ ID NO: 837046 - protein, 440 aa, Homo sapiens
RCGSGIVKLLISIRAVRAGGGRRRACGFQPSTRALSVQTSQALGRRRAMAETKIIYHMDEEETPYLVKLPVAPERVTLADFKNVLSNRPVHAYKFFFKSMDQDFGVVKEEIFDDNAKLPCFNGRVVSWLVLAEGAHSDAGSQGTDSHTDLPPPLERTGGIGDSRPPSFHPNVASSRDGMDNETGTESMVSHRRERARRRNREEAARTNGHPRGDRRRDVGLPPDSASTALSSELESSSFVDSDEDGSTSRLSSSTEQSTSSRLIRKHKRRRRKQRLRQADRASSFSSITDSTMSLNIVTVTLNMERHHFLGISIVGQSNDRGDGGIYIGSIMKGGAVAADGRIEPGDMLLQVNDVNFENMSNDDAVRVLREIVSQTGPISLTVAKCWDPTPRSYFTVPRADTVRWPNTVRWPNTVRWPNTVRWVGPTHRVSQDGLYLLTS

SEQ ID NO: 837047 - protein, 718 aa, Homo sapiens; identical to SEQ ID NO: 837041

SEQ ID NO: 837048 - protein, 800 aa, Homo sapiens
RCGSGIVKLLISIRAVRAGGGRRRACGFQPSTRALSVQTSQALGRRRAMAETKIIYHMDEEETPYLVKLPVAPERVTLADFKNVLSNRPVHAYKFFFKSMDQDFGVVKEEIFDDNAKLPCFNGRVVSWLVLAEGAHSDAGSQGTDSHTDLPPPLERTGGIGDSRPPSFHPNVASSRDGMDNETGTESMVSHRRERARRRNREEGTVVMSAQLWTPSLPGTPMSHVPTTAVPVPQPVAVLGWRHRPSEPTVELPAPRPTGMQHCPGSPKPMTSGRPCISSQPAAPTAARTNGHPRGDRRRDVGLPPDSASTALSSELESSSFVDSDEDGSTSRLSSSTEQSTSSRLIRKHKRRRRKQRLRQADRASSFSSITDSTMSLNIVTVTLNMERHHFLGISIVGQSNDRGDGGIYIGSIMKGGAVAADGRIEPGDMLLQVNDVNFENMSNDDAVRVLREIVSQTGPISLTVAKCWDPTPRSYFTVPRADPVRPIDPAAWLSHTAALTGALPRYELEEAPLTVKSDMSAVVRVMQLPDSGLEIRDRMWLKITIANAVIGADVVDWLYTHVEGFKERREARKYASSLLKHGFLRHTVNKITFSEQCYYVFGDLCSNLATLNLNSGSSGTSDQDTLAPLPHPAAPWPLGQGYPYQYPGPPPCFPPAYQDPGFSYGSGSTGSQQSEGSKSSGSTRSSRRAPGREKERRAAGAGGSGSESDHTAPSGVGSSWRERPAGQLSRGSSPRSQASATAPGLPPPHPTTKAYTVVGGPPGGPPVRELAAVPPELTGSRQSFQKAMGNPCEFFVDIM

SEQ ID NO: 837049 - protein, 430 aa, Homo sapiens
LGAGAGAWPRLMALPAERHHFLGISIVGQSNDRGDGGIYIGSIMKGGAVAADGRIEPGDMLLQVNDVNFENMSNDDAVRVLREIVSQTGPISLTVAKCWDPTPRSYFTVPRADPVRPIDPAAWLSHTAALTGALPRYELEEAPLTVKSDMSAVVRVMQLPDSGLEIRDRMWLKITIANAVIGADVVDWLYTHVEGFKERREARKYASSLLKHGFLRHTVNKITFSEQCYYVFGDLCSNLATLNLNSGSSGTSDQDTLAPLPHPAAPWPLGQGYPYQYPGPPPCFPPAYQDPGFSYGSGSTGSQQSEGSKSSGSTRSSRRAPGREKERRAAGAGGSGSESDHTAPSGVGSSWRERPAGQLSRGSSPRSQASATAPGLPPPHPTTKAYTVVGGPPGGPPVRELAAVPPELTGSRQSFQKAMGNPCEFFVDIM

SEQ ID NO: 837050 - protein, 435 aa, Homo sapiens
RCGSGIVKLLISIRAVRAGGGRRRACGFQPSTRALSVQTSQALGRRRAMAETKIIYHMDEEETPYLVKLPVAPERVTLADFKNVLSNRPVHAYKFFFKSMDQDFGVVKEEIFDDNAKLPCFNGRVVSWLVLAEGAHSDAGSQGTDSHTDLPPPLERTGGIGDSRPPSFHPNVASSRDGMDNETGTESMVSHRRERARRRNREEAARTNGHPRGDRRRDVGLPPDSASTALSSELESSSFVDSDEDGSTSRLSSSTEQSTSSRLIRKHKRRRRKQRLRQADRASSFSSITDSTMSLNIVTVTLNMERHHFLGISIVGQSNDRGDGGIYIGSIMKGGAVAADGRIEPGDMLLQVNDVNFENMSNDDAVRVLREIVSQTGPISLTVAKCWDPTPRSYFTVPRADPVRPIDPAAWLSHTAALTGALPRYGTCNPSYSGG

SEQ ID NO: 837051 - protein, 309 aa, Homo sapiens
APGRALSARAPRRRRAMAETKIIYHMDEEETPYLVKLPVAPERVTLADFKNVLSNRPVHAYKFFFKSMDQDFGVVKEEIFDDNAKLPCFNGRVVSWLVLAEGAHSDAGSQGTDSHTDLPPPLERTGGIGDSRPPSFHPNVASSRDGMDNETGTESMVSHRRERARRRNREEAARTNGHPRGDRRRDVGLPPDSASTALSSELESSSFVDSDEDGSTSRLSSSTEQSTSSRLIRKHKRRRRKQRLRQADRQGAPMCTAATGREVLGRWAVRWPVLGECTHCAHTSRPSWLLWPPRVCAVDTVSKSQRLDG

SEQ ID NO: 837052 - protein, 1559 aa, Homo sapiens
VAAAQGRSEGCGGVGYAHTLHLLPFAGSSVVLARARRTDRWTSGLVEMATLSLTVNSGDPPLGALLAVEHVKDDVSISVEEGKENILHVSENVIFTDVNSILRYLARVATTAGLYGSNLMEHTEIDHWLEFSATKLSSCDSFTSTINELNHCLSLRTYLVGNSLSLADLCVWATLKGNAAWQEQLKQKKAPVHVKRWFGFLEAQQAFQSVGTKWDVSTTKARVAPEKKQDVGKFVELPGAEMGKVTVRFPPEASGYLHIGHAKAALLNQHYQVNFKGKLIMRFDDTNPEKEKEDFEKVILEDVAMLHIKPDQFTYTSDHFETIMKYAEKLIQEGKAYVDDTPAEQMKAEREQRIESKHRKNPIEKNLQMWEEMKKGSQFGQSCCLRAKIDMSSNNGCMRDPTLYRCKIQPHPRTGNKYNVYPTYDFACPIVDSIEGVTHALRTTEYHDRDEQFYWIIEALGIRKPYIWEYSRLNLNNTVLSKRKLTWFVNEGLVDGWDDPRFPTVRGVLRRGMTVEGLKQFIAAQGSSRSVVNMEWDKIWAFNKKVIDPVAPRYVALLKKEVIPVNVPEAQEEMKEVAKHPKNPEVGLKPVWYSPKVFIEGADAETFSEGEMVTFINWGNLNITKIHKNADGKIISLDAKLNLENKDYKKTTKVTWLAETTHALPIPVICVTYEHLITKPVLGKDEDFKQYVNKNSKHEELMLGDPCLKDLKKGDIIQLQRRGFFICDQPYEPVSPYSCKEAPCVLIYIPDGHTKEMPTSGSKEKTKVEATKNETSAPFKERPTPSLNNNCTTSEDSLVLYNRVAVQGDVVRELKAKKAPKEDVDAAVKQLLSLKAEYKEKTGQEYKPGNPPAEIGQNISSNSSASILESKSLYDEVAAQGEVVRKLKAEKSPKAKINEAVECLLSLKAQYKEKTGKEYIPGQPPLSQSSDSSPTRNSEPAGLETPEAKVLFDKVASQGEVVRKLKTEKAPKDQVDIAVQELLQLKAQYKSLIGVEYKPVSATGAEDKDKKKKEKENKSEKQNKPQKQNDGQRKDPSKNQGGGLSSSGAGEGQGPKKQTRLGLEAKKEENLADWYSQVITKSEMIEYHDISGCYILRPWAYAIWEAIKDFFDAEIKKLGVENCYFPMFVSQSALEKEKTHVADFAPEVAWVTRSGKTELAEPIAIRPTSETVMYPAYAKWVQSHRDLPIKLNQWCNVVRWEFKHPQPFLRTREFLWQEGHSAFATMEEAAEEVLQILDLYAQVYEELLAIPVVKGRKTEKEKFAGGDYTTTIEAFISASGRAIQGGTSHHLGQNFSKMFEIVFEDPKIPGEKQFAYQNSWGLTTRTIGVMTMVHGDNMGLVLPPRVACVQVVIIPCGITNALSEEDKEALIAKCNDYRRRLLSVNIRVRADLRDNYSPGWKFNHWELKGVPIRLEVGPRDMKSCQFVAVRRDTGEKLTVAENEAETKLQAILEDIQVTLFTRASEDLKTHMVVANTMEDFQKILDSGKIVQIPFCGEIDCEDWIKKTTARDQDLEPGAPSMGAKSLCIPFKPLCELQPGAKCVCGKNPAKYYTLFGRSY

SEQ ID NO: 837053 - protein, 1318 aa, Homo sapiens
MGKVTVRFPPEASGYLHIGHAKAALLNQHYQVNFKGKLIMRFDDTNPEKEKEDFEKVILEDVAMLHIKPDQFTYTSDHFETIMKYAEKLIQEGKAYVDDTPAEQMKAEREQRIESKHRKNPIEKNLQMWEEMKKGSQFGQSCCLRAKIDMSSNNGCMRDPTLYRCKIQPHPRTGNKYNVYPTYDFACPIVDSIEGVTHALRTTEYHDRDEQFYWIIEALGIRKPYIWEYSRLNLNNTVLSKRKLTWFVNEGLVDGWDDPRFPTVRGVLRRGMTVEGLKQFIAAQGSSRSVVNMEWDKIWAFNKKVIDPVAPRYVALLKKEVIPVNVPEAQEEMKEVAKHPKNPEVGLKPVWYSPKVFIEGADAETFSEGEMVTFINWGNLNITKIHKNADGKIISLDAKLNLENKDYKKTTKVTWLAETTHALPIPVICVTYEHLITKPVLGKDEDFKQYVNKNSKHEELMLGDPCLKDLKKGDIIQLQRRGFFICDQPYEPVSPYSCKEAPCVLIYIPDGHTKEMPTSGSKEKTKVEATKNETSAPFKERPTPSLNNNCTTSEDSLVLYNRVAVQGDVVRELKAKKAPKEDVDAAVKQLLSLKAEYKEKTGQEYKPGNPPAEIGQNISSNSSASILESKSLYDEVAAQGEVVRKLKAEKSPKAKINEAVECLLSLKAQYKEKTGKEYIPGQPPLSQSSDSSPTRNSEPAGLETPEAKVLFDKVASQGEVVRKLKTEKAPKDQVDIAVQELLQLKAQYKSLIGVEYKPVSATGAEDKDKKKKEKENKSEKQNKPQKQNDGQRKDPSKNQGGGLSSSGAGEGQGPKKQTRLGLEAKKEENLADWYSQVITKSEMIEYHDISGCYILRPWAYAIWEAIKDFFDAEIKKLGVENCYFPMFVSQSALEKEKTHVADFAPEVAWVTRSGKTELAEPIAIRPTSETVMYPAYAKWVQSHRDLPIKLNQWCNVVRWEFKHPQPFLRTREFLWQEGHSAFATMEEAAEEVLQILDLYAQVYEELLAIPVVKGRKTEKEKFAGGDYTTTIEAFISASGRAIQGGTSHHLGQNFSKMFEIVFEDPKIPGEKQFAYQNSWGLTTRTIGVMTMVHGDNMGLVLPPRVACVQVVIIPCGITNALSEEDKEALIAKCNDYRRRLLSVNIRVRADLRDNYSPGWKFNHWELKGVPIRLEVGPRDMKSCQFVAVRRDTGEKLTVAENEAETKLQAILEDIQVTLFTRASEDLKTHMVVANTMEDFQKILDSGKIVQIPFCGEIDCEDWIKKTTARDQDLEPGAPSMGAKSLCIPFKPLCELQPGAKCVCGKNPAKYYTLFGRSY

SEQ ID NO: 837054 - protein, 1559 aa, Homo sapiens; identical to SEQ ID NO: 837052

SEQ ID NO: 837055 - protein, 972 aa, Homo sapiens
RLVEAGVNRPRIEGADAETFSEGEMVTFINWGNLNITKIHKNADGKIISLDAKLNLENKDYKKTTKVTWLAETTHALPIPVICVTYEHLITKPVLGKDEDFKQYVNKNSKHEELMLGDPCLKDLKKGDIIQLQRRGFFICDQPYEPVSPYSCKEAPCVLIYIPDGHTKEMPTSGSKEKTKVEATKNETSAPFKERPTPSLNNNCTTSEDSLVLYNRVAVQGDVVRELKAKKAPKEDVDAAVKQLLSLKAEYKEKTGQEYKPGNPPAEIGQNISSNSSASILESKSLYDEVAAQGEVVRKLKAEKSPKAKINEAVECLLSLKAQYKEKTGKEYIPGQPPLSQSSDSSPTRNSEPAGLETPEAKVLFDKVASQGEVVRKLKTEKAPKDQVDIAVQELLQLKAQYKSLIGVEYKPVSATGAEDKDKKKKEKENKSEKQNKPQKQNDGQRKDPSKNQGGGLSSSGAGEGQGPKKQTRLGLEAKKEENLADWYSQVITKSEMIEYHDISGCYILRPWAYAIWEAIKDFFDAEIKKLGVENCYFPMFVSQSALEKEKTHVADFAPEVAWVTRSGKTELAEPIAIRPTSETVMYPAYAKWVQSHRDLPIKLNQWCNVVRWEFKHPQPFLRTREFLWQEGHSAFATMEEAAEEVLQILDLYAQVYEELLAIPVVKGRKTEKEKFAGGDYTTTIEAFISASGRAIQGGTSHHLGQNFSKMFEIVFEDPKIPGEKQFAYQNSWGLTTRTIGVMTMVHGDNMGLVLPPRVACVQVVIIPCGITNALSEEDKEALIAKCNDYRRRLLSVNIRVRADLRDNYSPGWKFNHWELKGVPIRLEVGPRDMKSCQFVAVRRDTGEKLTVAENEAETKLQAILEDIQVTLFTRASEDLKTHMVVANTMEDFQKILDSGKIVQIPFCGEIDCEDWIKKTTARDQDLEPGAPSMGAKSLCIPFKPLCELQPGAKCVCGKNPAKYYTLFGRSY

SEQ ID NO: 837056 - protein, 1510 aa, Homo sapiens
VAAAQGRSEGCGGVGYAHTLHLLPFAGSSVVLARARRTDRWTSGLVEMATLSLTVNSGDPPLGALLAVEHVKDDVSISVEEGKENILHVSENVIFTDVNSILRYLARVATTAGLYGSNLMEHTEIDHWLEFSATKLSSCDSFTSTINELNHCLSLRTYLVGNSLSLADLCVWATLKGNAAWQEQLKQKKAPVHVKRWFGFLEAQQAFQSVGTKWDVSTTKARVAPEKKQDVGKFVELPGAEMGKVTVRFPPEASGYLHIGHAKAALLNQHYQVNFKGKLIMRFDDTNPEKEKEDFEKVILEDVAMLHIKPDQFTYTSDHFETIMKYAEKLIQEGKAYVDDTPAEQMKAEREQRIESKHRKNPIEKNLQMWEEMKKGSQFGQSCCLRAKIDMSSNNGCMRDPTLYRCKIQPHPRTGNKYNVYPTYDFACPIVDSIEGVTHALRTTEYHDRDEQFYWIIEALGIRKPYIWEYSRLNLNNTVLSKRKLTWFVNEGLVDGWDDPRFPTVRGVLRRGMTVEGLKQFIAAQGSSRSVVNMEWDKIWAFNKKVIDPVAPRYVALLKKEVIPVNVPEAQEEMKEVAKHPKNPEVGLKPVWYSPKVFIEGADAETFSEGEMVTFINWGNLNITKIHKNADGKIISLDAKLNLENKDYKKTTKVTWLAETTHALPIPVICVTYEHLITKPVLGKDEDFKQYVNKNSKHEELMLGDPCLKDLKKGDIIQLQRRGFFICDQPYEPVSPYSCKEAPCVLIYIPDGHTKEMPTSGSKEKTKVEATKNETSAPFKERPTPSLNNNCTTSEDSLVLYNRVAVQGDVVRELKAKKAPKEDVDAAVKQLLSLKAEYKEKTGQEYKPGNPPAEIGQNISSNSSASILESKSLYDEVAAQGEVVRKLKAEKSPKAKINEAVECLLSLKAQYKEKTGKEYIPGQPPLSQSSDSSPTRNSEPAGLETPEAKVLFDKVASQGEVVRKLKTEKAPKDQVDIAVQELLQLKAQYKSLIGVEYKPVSATGAEDKDKKKKEKENKSEKQNKPQKQNDGQRKDPSKNQGGGLSSSGAGEGQGPKKQTRLGLEAKKEENLADWYSQVITKSEMIEYHDISGCYILRPWAYAIWEAIKDFFDAEIKKLGVENCYFPMFVSQSALEKEKTHVADFAPEVAWVTRSGKTELAEPIAIRPTSETVMYPAYAKWVQSHRDLPIKLNQWCNVVRWEFKHPQPFLRTREFLWQEGHSAFATMEEAAEEVLQILDLYAQVYEELLAIPVVKGRKTEKEKFAGGDYTTTIEAFISASGRAIQGGTSHHLGQNFSKMFEIVFEDPKIPGEKQFAYQNSWGLTTRTIGVMTMVHGDNMGLVLPPRVACVQVVIIPCGITNALSEEDKEALIAKCNDYRRRLLSVNIRVRADLRDNYSPGWKFNHWELKGVPIRLEVGPRDMKSCQFVAVRRDTGEKLTVAENEAETKLQAILEDIQVTLFTRASEDLKTHMVVANTMEDFQKILDSGKIVQIPFCGEIDCEDWIKKTTAR

SEQ ID NO: 837057 - protein, 1413 aa, Homo sapiens
VAAAQGRSEGCGGVGYAHTLHLLPFAGSSVVLARARRTDRWTSGLVEMATLSLTVNSGDPPLGALLAVEHVKDDVSISVEEGKENILHVSENVIFTDVNSILRYLARVATTAGLYGSNLMEHTEIDHWLEFSATKLSSCDSFTSTINELNHCLSLRTYLVGNSLSLADLCVWATLKGNAAWQEQLKQKKAPVHVKRWFGFLEAQQAFQSVGTKWDVSTTKARVAPEKKQDVGKFVELPGAEMGKVTVRFPPEASGYLHIGHAKAALLNQHYQVNFKGKLIMRFDDTNPEKEKEDFEKVILEDVAMLHIKPDQFTYTSDHFETIMKYAEKLIQEGKAYVDDTPAEQMKAEREQRIESKHRKNPIEKNLQMWEEMKKGSQFGQSCCLRAKIDMSSNNGCMRDPTLYRCKIQPHPRTGNKYNVYPTYDFACPIVDSIEGVTHALRTTEYHDRDEQFYWIIEALGIRKPYIWEYSRLNLNNTVLSKRKLTWFVNEGLVDGWDDPRFPTVRGVLRRGMTVEGLKQFIAAQGSSRSVVNMEWDKIWAFNKKVIDPVAPRYVALLKKEVIPVNVPEAQEEMKEVAKHPKNPEVGLKPVWYSPKVFIEGADAETFSEGEMVTFINWGNLNITKIHKNADGKIISLDAKLNLENKDYKKTTKVTWLAETTHALPIPVICVTYEHLITKPVLGKDEDFKQYVNKNSKHEELMLGDPCLKDLKKGDIIQLQRRGFFICDQPYEPVSPYSCKEAPCVLIYIPDGHTKEMPTSGSKEKTKVEATKNETSAPFKERPTPSLNNNCTTSEDSLVLYNRVAVQGDVVRELKAKKAPKEDVDAAVKQLLSLKAEYKEKTGQEYKPGNPPAEIGQNISSNSSASILESKSLYDEVAAQGEVVRKLKAEKSPKAKINEAVECLLSLKAQYKEKTGKEYIPGQPPLSQSSDSSPTRNSEPAGLETPEAKVLFDKVASQGEVVRKLKTEKAPKDQVDIAVQELLQLKAQYKSLIGVEYKPVSATGAEDKDKKKKEKENKSEKQNKPQKQNDGQRKDPSKNQGGGLSSSGAGEGQGPKKQTRLGLEAKKEENLADWYSQVITKSEMIEYHDISGCYILRPWAYAIWEAIKDFFDAEIKKLGVENCYFPMFVSQSALEKEKTHVADFAPEVAWVTRSGKTELAEPIAIRPTSETVMYPAYAKWVQSHRDLPIKLNQWCNVVRWEFKHPQPFLRTREFLWQEGHSAFATMEEAAEEVLQILDLYAQVYEELLAIPVVKGRKTEKEKFAGGDYTTTIEAFISASGRAIQGGTSHHLGQNFSKMFEIVFEDPKIPGEKQFAYQNSWGLTTRTIGVMTMVHGDNMGLVLPPRVACVQVVIIPCGITNALSEEDKEALIAKCNDYRRRLLSVNIRVRADLRDNYSPGWKFNHWELKGVPID

SEQ ID NO: 837058 - protein, 478 aa, Homo sapiens
GLVRSEVLGCGCYILRPWAYAIWEAIKDFFDAEIKKLGVENCYFPMFVSQSALEKEKTHVADFAPEVAWVTRSGKTELAEPIAIRPTSETVMYPAYAKWVQSHRDLPIKLNQWCNVVRWEFKHPQPFLRTREFLWQEGHSAFATMEEAAEEVLQILDLYAQVYEELLAIPVVKGRKTEKEKFAGGDYTTTIEAFISASGRAIQGGTSHHLGQNFSKMFEIVFEDPKIPGEKQFAYQNSWGLTTRTIGVMTMVHGDNMGLVLPPRVACVQVVIIPCGITNALSEEDKEALIAKCNDYRRRLLSVNIRVRADLRDNYSPGWKFNHWELKGVPIRLEVGPRDMKSCQFVAVRRDTGEKLTVAENEAETKLQAILEDIQVTLFTRASEDLKTHMVVANTMEDFQKILDSGKIVQIPFCGEIDCEDWIKKTTARDQDLEPGAPSMGAKSLCIPFKPLCELQPGAKCVCGKNPAKYYTLFGRSY

SEQ ID NO: 837059 - protein, 1214 aa, Homo sapiens
VAAAQGRSEGCGGVGYAHTLHLLPFAGSSVVLARARRTDRWTSGLVEMATLSLTVNSGDPPLGALLAVEHVKDDVSISVEEGKENILHVSENVIFTDVNSILRYLARVATTAGLYGSNLMEHTEIDHWLEFSATKLSSCDSFTSTINELNHCLSLRTYLVGNSLSLADLCVWATLKGNAAWQEQLKQKKAPVHVKRWFGFLEAQQAFQSVGTKWDVSTTKARVAPEKKQDVGKFVELPGAEMGKVTVRFPPEASGYLHIGHAKAALLNQHYQVNFKGKLIMRFDDTNPEKEKEDFEKVILEDVAMLHIKPDQFTYTSDHFETIMKYAEKLIQEGKAYVDDTPAEQMKAEREQRIESKHRKNPIEKNLQMWEEMKKGSQFGQSCCLRAKIDMSSNNGCMRDPTLYRCKIQPHPRTGNKYNVYPTYDFACPIVDSIEGVTHALRTTEYHDRDEQFYWIIEALGIRKPYIWEYSRLNLNNTVLSKRKLTWFVNEGLVDGWDDPRFPTVRGVLRRGMTVEGLKQFIAAQGSSRSVVNMEWDKIWAFNKKVIDPVAPRYVALLKKEVIPVNVPEAQEEMKEVAKHPKNPEVGLKPVWYSPKVFIEGADAETFSEGEMVTFINWGNLNITKIHKNADGKIISLDAKLNLENKDYKKTTKVTWLAETTHALPIPVICVTYEHLITKPVLGKDEDFKQYVNKNSKHEELMLGDPCLKDLKKGDIIQLQRRGFFICDQPYEPVSPYSCKEAPCVLIYIPDGHTKEMPTSGSKEKTKVEATKNETSAPFKERPTPSLNNNCTTSEDSLVLYNRVAVQGDVVRELKAKKAPKEDVDAAVKQLLSLKAEYKEKTGQEYKPGNPPAEIGQNISSNSSASILESKSLYDEVAAQGEVVRKLKAEKSPKAKINEAVECLLSLKAQYKEKTGKEYIPGQPPLSQSSDSSPTRNSEPAGLETPEAKVLFDKVASQGEVVRKLKTEKAPKDQVDIAVQELLQLKAQYKSLIGVEYKPVSATGAEDKDKKKKEKENKSEKQNKPQKQNDGQRKDPSKNQGGGLSSSGAGEGQGPKKQTRLGLEAKKEENLADWYSQVITKSEMIEYHDISGCYILRPWAYAIWEAIKDFFDAEIKKLGVENCYFPMFVSQSSDSSPTRNSEPAGLETPEAKVLFDKVASQGEVVRKLKTEKAPKDQVDIAVQELLQLKAQYKSLIGVEYKPVSATGAEKDKKK

SEQ ID NO: 837060 - protein, 428 aa, Homo sapiens
VAAAQGRSEGCGGVGYAHTLHLLPFAGSSVVLARARRTDRWTSGLVEMATLSLTVNSGDPPLGALLAVEHVKDDVSISVEEGKENILHVSENVIFTDVNSILRYLARVATTAGLYGSNLMEHTEIDHWLEFSATKLSSCDSFTSTINELNHCLSLRTYLVGNSLSLADLCVWATLKGNAAWQEQLKQKKAPVHVKRWFGFLEAQQAFQSVGTKWDVSTTKARVAPEKKQDVGKFVELPGAEMGKVTVRFPPEASGYLHIGHAKAALLNQHYQVNFKGKLIMRFDDTNPEKEKEDFEKVILEDVAMLHIKPDQFTYTSDHFETIMKYAEKLIQEGKAYVDDTPAEQMKAEREQRIESKHRKNPIEKNLQMWEEMKKGSQFGQSCCLRAKIDMSSNNGCMRDPTLYRCKIQPHPRTGNKYNGLPHHNGFL

SEQ ID NO: 837061 - protein, 72 aa, Homo sapiens
DSARGREEVLQILDLYAQVYEELLAIPVVKGRKTEKEKFAGGDYTTTIEAFISASGRAIQGGTSHHLGQRLQ

SEQ ID NO: 837062 - protein, 1522 aa, Homo sapiens [sequence omitted]

SEQ ID NO: 837063 - protein, 1559 aa, Homo sapiens; identical to SEQ ID NO: 837052

SEQ ID NO: 837064 - protein, 954 aa, Homo sapiens
AARHFFLCIFVMLRLPQFIKIHKNADGKIISLDAKLNLENKDYKKTTKVTWLAETTHALPIPVICVTYEHLITKPVLGKDEDFKQYVNKNSKHEELMLGDPCLKDLKKGDIIQLQRRGFFICDQPYEPVSPYSCKEAPCVLIYIPDGHTKEMPTSGSKEKTKVEATKNETSAPFKERPTPSLNNNCTTSEDSLVLYNRVAVQGDVVRELKAKKAPKEDVDAAVKQLLSLKAEYKEKTGQEYKPGNPPAEIGQNISSNSSASILESKSLYDEVAAQGEVVRKLKAEKSPKAKINEAVECLLSLKAQYKEKTGKEYIPGQPPLSQSSDSSPTRNSEPAGLETPEAKVLFDKVASQGEVVRKLKTEKAPKDQVDIAVQELLQLKAQYKSLIGVEYKPVSATGAEDKDKKKKEKENKSEKQNKPQKQNDGQRKDPSKNQGGGLSSSGAGEGQGPKKQTRLGLEAKKEENLADWYSQVITKSEMIEYHDISGCYILRPWAYAIWEAIKDFFDAEIKKLGVENCYFPMFVSQSALEKEKTHVADFAPEVAWVTRSGKTELAEPIAIRPTSETVMYPAYAKWVQSHRDLPIKLNQWCNVVRWEFKHPQPFLRTREFLWQEGHSAFATMEEAAEEVLQILDLYAQVYEELLAIPVVKGRKTEKEKFAGGDYTTTIEAFISASGRAIQGGTSHHLGQNFSKMFEIVFEDPKIPGEKQFAYQNSWGLTTRTIGVMTMVHGDNMGLVLPPRVACVQVVIIPCGITNALSEEDKEALIAKCNDYRRRLLSVNIRVRADLRDNYSPGWKFNHWELKGVPIRLEVGPRDMKSCQFVAVRRDTGEKLTVAENEAETKLQAILEDIQVTLFTRASEDLKTHMVVANTMEDFQKILDSGKIVQIPFCGEIDCEDWIKKTTARDQDLEPGAPSMGAKSLCIPFKPLCELQPGAKCVCGKNPAKYYTLFGRSY

SEQ ID NO: 837065 - protein, 606 aa, Homo sapiens
LATLPLLPPRELKTEKAPKDQVDIAVQELLQLKAQYKSLIGVEYKPVSATGAEDKDKKKKEKENKSEKQNKPQKQNDGQRKDPSKNQGGGLSSSGAGEGQGPKKQTRLGLEAKKEENLADWYSQVITKSEMIEYHDISGCYILRPWAYAIWEAIKDFFDAEIKKLGVENCYFPMFVSQSALEKEKTHVADFAPEVAWVTRSGKTELAEPIAIRPTSETVMYPAYAKWVQSHRDLPIKLNQWCNVVRWEFKHPQPFLRTREFLWQEGHSAFATMEEAAEEVLQILDLYAQVYEELLAIPVVKGRKTEKEKFAGGDYTTTIEAFISASGRAIQGGTSHHLGQNFSKMFEIVFEDPKIPGEKQFAYQNSWGLTTRTIGVMTMVHGDNMGLVLPPRVACVQVVIIPCGITNALSEEDKEALIAKCNDYRRRLLSVNIRVRADLRDNYSPGWKFNHWELKGVPIRLEVGPRDMKSCQFVAVRRDTGEKLTVAENEAETKLQAILEDIQVTLFTRASEDLKTHMVVANTMEDFQKILDSGKIVQIPFCGEIDCEDWIKKTTARDQDLEPGAPSMGAKSLCIPFKPLCELQPGAKCVCGKNPAKYYTLFGRSY

SEQ ID NO: 837066 - protein, 476 aa, Homo sapiens [sequence omitted]

SEQ ID NO: 837067 - protein, 1005 aa, Homo sapiens
VAAAQGRSEGCGGVGYAHTLHLLPFAGSSVVLARARRTDRWTSGLVEMATLSLTVNSGDPPLGALLAVEHVKDDVSISVEEGKENILHVSENVIFTDVNSILRYLARVATTAGLYGSNLMEHTEIDHWLEFSATKLSSCDSFTSTINELNHCLSLRTYLVGNSLSLADLCVWATLKGNAAWQEQLKQKKAPVHVKRWFGFLEAQQAFQSVGTKWDVSTTKARVAPEKKQDVGKFVELPGAEMGKVTVRFPPEASGYLHIGHAKAALLNQHYQVNFKGKLIMRFDDTNPEKEKEDFEKVILEDVAMLHIKPDQFTYTSDHFETIMKYAEKLIQEGKAYVDDTPAEQMKAEREQRIESKHRKNPIEKNLQMWEEMKKGSQFGQSCCLRAKIDMSSNNGCMRDPTLYRCKIQPHPRTGNKYNVYPTYDFACPIVDSIEGVTHALRTTEYHDRDEQFYWIIEALGIRKPYIWEYSRLNLNNTVLSKRKLTWFVNEGLVDGWDDPRFPTVRGVLRRGMTVEGLKQFIAAQGSSRSVVNMEWDKIWAFNKKVIDPVAPRYVALLKKEVIPVNVPEAQEEMKEVAKHPKNPEVGLKPVWYSPKVFIEGADAETFSEGEMVTFINWGNLNITKIHKNADGKIISLDAKLNLENKDYKKTTKVTWLAETTHALPIPVICVTYEHLITKPVLGKDEDFKQYVNKNSKHEELMLGDPCLKDLKKGDIIQLQRRGFFICDQPYEPVSPYSCKEAPCVLIYIPDGHTKEMPTSGSKEKTKVEATKNETSAPFKERPTPSLNNNCTTSEDSLVLYNRVAVQGDVVRELKAKKAPKEDVDAAVKQLLSLKAEYKEKTGQEYKPGNPPAEIGQNISSNSSASILESKSLYDEVAAQGEVVRKLKAEKSPKAKINEAVECLLSLKAQYKEKTGKEYIPGQPPLSQSSDSSPTRNSEPAGLETPEAKVLFDKVASQGEVVRKLKTEKAPKDQVDIAVQELLLGDHVFSMCTCNIFPSYLKVKS

SEQ ID NO: 837068 - protein, 594 aa, Homo sapiens
MAPIGLKAVVGEKIMHDVIKKVKKKGEWKVLVVDQLSMRMLSSCCKMTDIMTEGITIVEDINKRREPLPSLEAVYLITPSEKSVHSLISDFKDPPTAKYRAAHVFFTDSCPDALFNELVKSRAAKVIKTLTEINIAFLPYESQVYSLDSADSFQSFYSPHKAQMKNPILERLAEQIATLCATLKEYPAVRYRGEYKDNALLAQLIQDKLDAYKADDPTMGEGPDKARSQLLILDRGFDPSSPVLHELTFQAMSYDLLPIENDVYKYETSGIGEARVKEVLLDEDDDLWIALRHKHIAEVSQEVTRSLKDFSSSKRMNTGEKTTMRDLSQMLKKMPQYQKELSKYSTHLHLAEDCMKHYQGTVDKLCRVEQDLAMGTDAEGEKIKDPMRAIVPILLDANVSTYDKIRIILLYIFLKNGITEENLNKLIQHAQIPPEDSEIITNMAHLGVPIVTDSTLRRRSKPERKERISEQTYQLSRWTPIIKDIMEDTIEDKLDTKHYPYISTRSSASFSTTAVSARYGHWHKNKAPGEYRSGPRLIIFILGGVSLNEMRCAYEVTQANGKWEVLIGSTHILTPQKLLDTLKKLNKTDEEISS

SEQ ID NO: 837069 - protein, 193 aa, Homo sapiens
MAPIGLKAVVGEKIMHDVIKKVKKKGEWKVLVVDQLSMRMLSSCCKMTDIMTEGITIVEDINKRREPLPSLEAVYLITPSEKSVHSLISDFKDPPTAKYRAAHVFFTDSCPDALFNELVKSRAAKVIKTLTEINIAFLPYESQVYSLDSADSFQSFYSPHKAQMKNPILERLAEQIATLCATLKEYPAVRYRG

SEQ ID NO: 837070 - protein, 198 aa, Homo sapiens
MAPIGLKAVVGESKWSRDPSSRRGLRLPRSPARPLPAAPRPPSGLPALRPGPEAPGPWGPVIQAPPAREEGFAPEYCTITSTCSATATRQDSNSAQEAQDTRRKANATVPKRAGAKSGGSDTKAISSTPVDRFKRRTDSCDLTDRLWALPPRVSIRGTIVLGTTEHTHGVTNEARTRLSATSPDEHTLSARTPEVSGD

SEQ ID NO: 837071 - protein, 594 aa, Homo sapiens; identical to SEQ ID NO: 837068

SEQ ID NO: 837072 - protein, 603 aa, Homo sapiens [sequence omitted]

SEQ ID NO: 837073 - protein, 316 aa, Homo sapiens
MAPIGLKAVVGEKIMHDVIKKVKKKGEWKVLVVDQLSMRMLSSCCKMTDIMTEGITIVEDINKRREPLPSLEAVYLITPSEKSVHSLISDFKDPPTAKYRAAHVFFTDSCPDALFNELVKSRAAKVIKTLTEINIAFLPYESQVYSLDSADSFQSFYSPHKAQMKNPILERLAEQIATLCATLKEYPAVRYRGEYKDNALLAQLIQDKLDAYKADDPTMGEGPDKARSQLLILDRGFDPSSPVLHELTFQAMSYDLLPIENDVYKYETSGIGEARVKEVLLDEDDDLWIALRHKHIAEVSQKVRQSLYNFSYHYRV

SEQ ID NO: 837074 - protein, 603 aa, Homo sapiens [sequence omitted]

SEQ ID NO: 837075 - protein, 153 aa, Homo sapiens
ATRSGVQEVTRSLKDFSSSKRMNTGEKTTMRDLSQMLKKMPQYQKELSKYSTHLHLAEDCMKHYQGTVDKLCRVEQDLAMGTDAEGEKIKDPMRAIVPILLDANVSTYDKIRIILLYIFLKNGITEGNLNNPFPPTVPRLLPGIKEHASGSYL

SEQ ID NO: 837076 - protein, 594 aa, Homo sapiens; identical to SEQ ID NO: 837068

SEQ ID NO: 837077 - protein, 534 aa, Homo sapiens
MAPIGLKAVVGEKIMHDVIKKVKKKGEWKVLVVDQLSMRMLSSCCKMTDIMTEGITIVEDINKRREPLPSLEAVYLITPSEKSVHSLISDFKDPPTAKYRAAHVFFTDSCPDALFNELVKSRAAKVIKTLTEINIAFLPYESQVYSLDSADSFQSFYSPHKAQMKNPILERLAEQIATLCATLKEYPAVRYRGEYKDNALLAQLIQDKLDAYKADDPTMGEGPDKARSQLLILDRGFDPSSPVLHELTFQAMSYDLLPIENDVYKYETSGIGEARVKEVLLDEDDDLWIALRHKHIAEVSQEVTRSLKDFSSSKRMNTGEKTTMRDLSQMLKKMPQYQKELSKYSTHLHLAEDCMKHYQGTVDKLCRVEQDLAMGTDAEGEKIKDPMRAIVPILLDANVSTYDKIRIILLYIFLKNGITEENLNKLIQHAQIPPEDSEIITNMAHLGVPIVTDSTLRRRSKPERKERISEQTYQLSRWTPIIKDIMEDTIEDKLDTKHYPYISTRSSASFSTTAVRIHTHPHPTETAGHTEETE

SEQ ID NO: 837078 - protein, 66 aa, Homo sapiens
PSPRVSRSLARLRGGELRLAQRAHLRRRRGPQASRDEEIGATSASLSEPAPRPLCSLHCGVLFSRL

SEQ ID NO: 837079 - protein, 872 aa, Homo sapiens
MHHTASSPQCTDEEPEAQRSEVAFLRSHSMKVMSQDLNLGSWALEPDCTAFCHTVLPSVTGWHLQGTFTQGPESAEAVSQDARHGVAWASSGFHRSLTVLRVEHAQPPAHCSLSAQISGVPVPKACPFFKTELKSPWKAPVKLPETGFLGMQAEGDPPWPTPRSPAEAPTRRKRLTTARSAESESWDHLVLQGDPRLPRTGERDRPHSDSSWGLCTGFSLGGVACYIAVPQRKGPAFSGMFSVLTPLCAPPLLLYKQLGDSKEQLRLGAVTHTRNPGTLGGRGGQGQEFKTSLANMVKPCLYKKYKINQTLWHVPVIPATQEADTGELLEPGGGGCSELRLCHCTPAWATERDSVSKKKKKKREKKKEQLTALGGCEWPPLKVFEKRPDAAVARPVLRGLVLPGTQAGWMAQLFLLQANAVLPLSHEIKVKRQIRLPAPLYPPERNDSRSFQIPQDLREKGWEEGQQHFAGKAADAFPAPVQLEGLEAGQTTLASPEVGPWRPKRLSGVCLLSALLPDPCKTNGTFLLQKHHLPSLLAVILFPVIILTGASFAHLFVALFVSHLLLKLPLGAGMRMQRDARYLLSHFSVEKTEARAERSQLRSCDSDPVLSALEAPCIMPTRVIPLGWTISGYEASEAGVEIVVLKSFIARLPHSSVSPGKGQAAVHRDLSVPEPHSDEEALEKHLIETFNFSGRAAEAVWKISGELTSVWAPGPGVRGPARCAFSGKQRACPGLPAPAPGGLCSLQLPSARFASSWQMPSDCPRASARVGLSCYDREAQGVLLREPKGTARSCMFYVHLPQPHPPWPTPQAPDHGHSRRGMEEKVVELSTENPEDRAHSFQAGKGTSLKNLDNQNYHSTFSFPARPSELRP

SEQ ID NO: 837080 - protein, 872 aa, Homo sapiens; identical to SEQ ID NO: 837079

SEQ ID NO: 837081 - protein, 124 aa, Homo sapiens
PSAPCGLRTLAAQPDPRQLCRRLTRSGSGSSEDSSAGCSDTMDLSFMAAQLPMMGGAFMDSPNEDFSTEYSLFNSSANVHAAANGQGQPEDPPRSSNDAVLLWIAIIATLGNIVVVGVVYAFTF

SEQ ID NO: 837082 - protein, 124 aa, Homo sapiens; identical to SEQ ID NO: 837081

SEQ ID NO: 837083 - protein, 872 aa, Homo sapiens; identical to SEQ ID NO: 837079

SEQ ID NO: 837084 - protein, 1379 aa, Homo sapiens [sequence omitted]

SEQ ID NO: 837085 - protein, 1379 aa, Homo sapiens [sequence omitted]

SEQ ID NO: 837086 - protein, 1379 aa, Homo sapiens [sequence omitted]

SEQ ID NO: 837087 - protein, 449 aa, Homo sapiens
MPGAPETAPGDGAGASRQRKLEALIRDPRSPINVESLLDGLNSLVLDLDFPALRKNKNIDNFLNRYEKIVKKIRGLQMKAEDYDVVKVIGRGAFGEVQLVRHKASQKVYAMKLLSKFEMIKRSDSAFFWEERDIMAFANSPWVVQLFYAFQDDRYLYMVMEYMPGGDLVNLMSNYDVPEKWAKFYTAEVVLALDAIHSMGLIHRDVKPDNMLLDKHGHLKLADFGTCMKMDETGMVHCDTAVGTPDYISPEVLKSQGGDGFYGRECDWWSVGVFLYEMLVGDTPFYADSLVGTYSKIMDHKNSLCFPEDAEISKHAKNLICAFLTDREVRLGRNGVEEIRQHPFFKNDQWHWDNIRETAAPVVPELSSDIDSSNFDDIEDDKGDVETFPIPKAFVGNQLPFIGFTYYRENLLLSDSPSCRENDSIQSRKNEESQGKSRGMLMLSDILKN

SEQ ID NO: 837088 - protein, 1379 aa, Homo sapiens [sequence omitted]

SEQ ID NO: 837089 - protein, 1379 aa, Homo sapiens [sequence omitted]

SEQ ID NO: 837090 - protein, 1379 aa, Homo sapiens [sequence omitted]

SEQ ID NO: 837091 - protein, 245 aa, Homo sapiens [sequence omitted]

SEQ ID NO: 837092 - protein, 234 aa, Homo sapiens
PTRPSLCSQAKPDPAAEGQVKQPPEPHKDLLAGEEGAAPGSQASTESSAHPPTAAPASPSGPGKALGVSLNATSGKSQSQSSATPSSGSQGQLPSGSGCGSRLSGRAQGQRRAQGSSHWSRQHTQPPGTSSSPSQSALPSSGPLQPPNVTSSPVSPMVQSPSSSNIPTQPPSKSSGKPEDAAPKTSGQRQKESSKQPASSASVPELVPCHSGTSLEYTSESTTEITCSWPHHRP

SEQ ID NO: 837093 - protein, 494 aa, Homo sapiens
LPAGSGQRRPWRRAMRRGRRGRPLLLCPPCPPIGPSGGPGADTGAGPEHRGSGCGKAVRVQRGGCPGPRASSSSQPRARRGHGRPEAARGALPGAKEPGHRSAGGAGGQDRGGEAVSGCRSRHSAKPVSAVRLRSVSAVQSHRICVPRICLNQSYREPKQGRRHCVAHLLGGVRPVWAGRVLQRSTPVLVPFLLRGQVRLPVVLHGSQALERGSHAVSARRASAVPKAPRGRRQNHERPQRASPGRGGRNNQERQAKPDPAAEGQVKQPPEPHKDLLAGEEGAAPGSQASTESSAHPPTAAPASPSGPGKALGVSLNATSGKSQSQSSATPSSGSQGQLPSGSGCGSRLSGRAQGQRRAQGSSHWSRQHTQPPGTSSSPSQSALPSSGPLQPPNVTSSPVSPMVQSPSSSNIPTQPPSKSSGKPEDAAPKTSGQRQKESSKQPASSASVPELVPCHSGTSLEYTSESTTEITCSWPHHRPPCLQHYWCLKHLAC

SEQ ID NO: 837094 - protein, 111 aa, Homo sapiens
QRHQRVFVNIPFFFFLFLVIPRLCHLSLSAFYLESMVGWSSSRSKTLTLASFSFLQPCPTWAPLTAPSLLGSMRLCPVTTSPRGPCCPASVVLLCPFSWPGQGWQDQLPPL

SEQ ID NO: 837095 - protein, 412 aa, Homo sapiens
GRATCGGGGGLGRVGAALPLRPRPPLPASPARPLLPAARQSQAPALGRPRARRPGTSVAAHADRCPPPPPQAALAAALGPAEAGMLEKLEFEDEAVEDSESGVYMRFMRSHKCYDIVPTSSKLVVFDTTLQVKKAFFALVANGVRAAPLWESKKQSFVGMLTITDFINILHRYYKSPMVQIYELEEHKIETWRELYLQETFKPLVNISPDASLFDAVYSLIKNKIHRLPVIDPISGNALYILTHKRILKFLQLFMSDMPKPAFMKQNLDELGIGTYHNIAFIHPDTPIIKALNIFVERRISALPVVDESGKVVDIYSKFDVINLAAEKTYNNLDITVTQALQHRSQYFEGVVKCNKLEILETIVDRIVRAEVHRLVVVNEADSIVGIISLSDILQALILTPAGAKQKETETE

SEQ ID NO: 837096 - protein, 599 aa, Homo sapiens
RLQSEGSGRGREGGDRTPEEFRRINFWLELWEALVMDTKKKKDVSSPGGSGGKKNASQKRRSLRVHIPDLSSFAMPLLDGDLEGSGKHSSRKVDSPFGPGSPSKGFFSRGPQPRPSSPMSAPVRPKTSPGSPKTVFPFSYQESPPRSPRRMSFSGIFRSSSKESSPNSNPATSPGGIRFFSRSRKTSGLSSSPSTPTQVTKQHTFPLESYKHEPERLENRIYASSSPPDTGQRFCPSSFQSPTRPPLASPTHYAPSKAAALAAALGPAEAGMLEKLEFEDEAVEDSESGVYMRFMRSHKCYDIVPTSSKLVVFDTTLQVKKAFFALVANGVRAAPLWESKKQSFVGMLTITDFINILHRYYKSPMVQIYELEEHKIETWRELYLQETFKPLVNISPDASLFDAVYSLIKNKIHRLPVIDPISGNALYILTHKRILKFLQLFMSDMPKPAFMKQNLDELGIGTYHNIAFIHPDTPIIKALNIFVERRISALPVVDESGKVVDIYSKFDVINLAAEKTYNNLDITVTQALQHRSQYFEGVVKCNKLEILETIVDRIVRAEVHRLVVVNEADSIVGIISLSDILQALILTPAGAKQKETETE

SEQ ID NO: 837097 - protein, 328 aa, Homo sapiens
MLEKLEFEDEAVEDSESGVYMRFMRSHKCYDIVPTSSKLVVFDTTLQVKKAFFALVANGVRAAPLWESKKQSFVGMLTITDFINILHRYYKSPMVQIYELEEHKIETWRELYLQETFKPLVNISPDASLFDAVYSLIKNKIHRLPVIDPISGNALYILTHKRILKFLQLFMSDMPKPAFMKQNLDELGIGTYHNIAFIHPDTPIIKALNIFVERRISALPVVDESGKVVDIYSKFDVINLAAEKTYNNLDITVTQALQHRSQYFEGVVKCNKLEILETIVDRIVRAEVHRLVVVNEADSIVGIISLSDILQALILTPAGAKQKETETE

SEQ ID NO: 837098 - protein, 282 aa, Homo sapiens
GRATCGGGGGLGRVGAALPLRPRPPLPASPARPLLPAARQSQAPALGRPRARRPGTSVAAHADRCPPPPPQAALAAALGPAEAGMLEKLEFEDEAVEDSESGVYMRFMRSHKCYDIVPTSSKLVVFDTTLQVKKAFFALVANGVRAAPLWESKKQSFVGMLTITDFINILHRYYKSPMVQIYELEEHKIETWRELYLQETFKPLVNISPDASLFDAVYSLIKNKIHRLPVIDPISGNALYILTHKRILKFLQLFMSDMPKPAFMKQNLDELGIGAISKSLLN

SEQ ID NO: 837099 - protein, 203 aa, Homo sapiens
GRATCGGGGGLGRVGAALPLRPRPPLPASPARPLLPAARQSQAPALGRPRARRPGTSVAAHADRCPPPPPQAALAAALGPAEAGMLEKLEFEDEAVEDSESGVYMRFMRSHKCYDIVPTSSKLVVFDTTLQVKKAFFALVANGVRAAPLWESKKQSFVGMLTITDFINILHRYYKSPMVQIYELEEHKIETWRGKHYWMFKIF

SEQ ID NO: 837100 - protein, 289 aa, Homo sapiens
RIELGTLQVKKAFFALVANGVRAAPLWESKKQSFVGMLTITDFINILHRYYKSPMVQIYELEEHKIETWRELYLQETFKPLVNISPDASLFDAVYSLIKNKIHRLPVIDPISGNALYILTHKRILKFLQLFMSDMPKPAFMKQNLDELGIGTYHNIAFIHPDTPIIKALNIFVERRISALPVVDESGKVVDIYSKFDVINLAAEKTYNNLDITVTQALQHRSQYFEGVVKCNKLEILETIVDRIVRAEVHRLVVVNEADSIVGIISLSDILQALILTPAGAKQKETETE

SEQ ID NO: 837101 - protein, 412 aa, Homo sapiens; identical to SEQ ID NO: 837095

SEQ ID NO: 837102 - protein, 491 aa, Homo sapiens
MSLVAYASSDESEPDEAEPEPEEEEAVAPTSGPALGGLFASLPAPKGPALLPPPPQMLAPAFPPPLLLPPPTGDPRLQPPPPLPFGLGGFPPPPGVSPAEAAGVGEGLGLGLPSPRGPGLNLPPPIGGAGPPLGLPKPKKRKEPVKIAAPELHKGDSDSEEDEPTKKKTILQGSSEGTGLSALLPQPKNLTVKETNRLLLPHAFSRKPSDGSPDTKPSRLASKTKTSSLAPVVGTTTTTPSPSAIKAAAKSAALQVTKQITQEEDDSDEEVAPENFFSLPEKAEPPGVEPYPYPIPTVPEELPPGTEPEPAFQDDAANAPLEFKMAAGSSGAPWMPKPGDDYSYNQFSTYGDANAAGAYYQDYYSGGYYPAQDPALVPPQEIAPDASFIDDEAFKRLQGKRNRGREEINFVEIKGDDQLSGAQQWMTKSLTEEKTMKSFSKKKGEQPTGQQRRKHQITYLIHQAKERELELKNTWSENKLSRRQTQAKYGF

SEQ ID NO: 837103 - protein, 113 aa, Homo sapiens
MSLVAYASSDESEPDEAEPEPEEEEAVAPTSGPALGGLFASLPAPKGPALLPPPPQMLAPAFPPAFVLPSGYIYIITGTEFSFAHSPYMFKGLTNPGKFYCVLYLLLVKAFYF

SEQ ID NO: 837104 - protein, 491 aa, Homo sapiens; identical to SEQ ID NO: 837102

SEQ ID NO: 837105 - protein, 491 aa, Homo sapiens; identical to SEQ ID NO: 837102

SEQ ID NO: 837106 - protein, 523 aa, Homo sapiens
MSLVAYASSDESEPDEAEPEPEEEEAVAPTSGPALGGLFASLPAPKGPALLPPPPQMLAPAFPPPLLLPPPTGDPRLQPPPPLPFGLGGFPPPPGVSPAEAAGVGEGLGLGLPSPRGPGLNLPPPIGGAGPPLGLPKPKKRKEPVKIAAPELHKGDSDSEEDEPTKKKTILQGSSEGTGLSALLPQPKNLTVKETNRLLLPHAFSRKPSDGSPDTKPSRLASKTKTSSLAPVVGTTTTTPSPSAIKAAAKSAALQVTKQITQEEDDSDEEVAPENFFSLPEKAEPPGVEPYPYPIPTVPEELPPGTEPEPAFQDDAANAPLEFKMAAGSSGAPWMPKPGDDYSYNQFSTYGDANAAGAYYQGLQQHLGHSPLRGIMRFLNSKSGKRTCFVPSFDYYSGGYYPAQDPALVPPQEIAPDASFIDDEAFKRLQGKRNRGREEINFVEIKGDDQLSGAQQWMTKSLTEEKTMKSFSKKKGEQPTGQQRRKHQITYLIHQAKERELELKNTWSENKLSRRQTQAKYGF

SEQ ID NO: 837107 - protein, 320 aa, Homo sapiens
MSLVAYASSDESEPDEAEPEPEEEEAVAPTSGPALGGLFASLPAPKGPALLPPPPQMLAPAFPPPLLLPPPTGDPRLQPPPPLPFGLGGFPPPPGVSPAEAAGVGEGLGLGLPSPRGPGLNLPPPIGGAGPPLGLPKPKKRKEPVKIAAPELHKGDSDSEEDEPTKKKTILQGSSEGTGLSALLPQPKNLTVKETNRLLLPHAFSRKPSDGSPDTKPSRLASKTKTSSLAPVVGTTTTTPSPSAIKAAAKSAALQVTKQITQEEDDSDEEVAPENFFSLPEKAEPPGVEPYPYPIPTVPEELPPGTEPRERRNQLCGDQR

SEQ ID NO: 837108 - protein, 491 aa, Homo sapiens; identical to SEQ ID NO: 837102

SEQ ID NO: 837109 - protein, 345 aa, Homo sapiens
MGSDGEFPSQSDSEEDEPTKKKTILQGSSEGTGLSALLPQPKNLTVKETNRLLLPHAFSRKPSDGSPDTKPSRLASKTKTSSLAPVVGTTTTTPSPSAIKAAAKSAALQVTKQITQEEDDSDEEVAPENFFSLPEKAEPPGVEPYPYPIPTVPEELPPGTEPEPAFQDDAANAPLEFKMAAGSSGAPWMPKPGDDYSYNQFSTYGDANAAGAYYQDYYSGGYYPAQDPALVPPQEIAPDASFIDDEAFKRLQGKRNRGREEINFVEIKGDDQLSGAQQWMTKSLTEEKTMKSFSKKKGEQPTGQQRRKHQITYLIHQAKERELELKNTWSENKLSRRQTQAKYGF

SEQ ID NO: 837110 - protein, 444 aa, Homo sapiens
MSLVAYASSDESEPDEAEPEPEEEEAVAPTSGPALGGLFASLPAPKGPALLPPPPQMLAPAFPPPLLLPPPTGDPRLQPPPPLPFGLGGFPPPPGVSPAEAAGVGEGLGLGLPSPRGPGLNLPPPIGGAGPPLGLPKPKKRKEPVKIAAPELHKGDSDSEEDEPTKKKTILQGSSEGTGLSALLPQPKNLTVKETNRLLLPHAFSRKPSDGSPDTKPSRLASKTKTSSLAPVVGTTTTTPSPSAIKAAAKSAALQVTKQITQEEDDSDEEVAPENFFSLPEKAEPPGVEPYPYPIPTVPEELPPGTEPEPAFQDDAANAPLEFKMAAGSSGAPWMPKPGDDYSYNQFSTYGDANAAGAYYQDYYSGGYYPAQDPALVPPQEIAPDASFIDDEAFKRLQGKRNRGREEINFVEIKGDDQSFTSGTPAALSPGSLSPRTQPSPLRE

SEQ ID NO: 837111 - protein, 349 aa, Homo sapiens
MSLVAYASSDESEPDEAEPEPEEEEAVAPTSGPALGGLFASLPAPKGPALLPPPPQMLAPAFPPPLLLPPPTGDPRLQPPPPLPFGLGGFPPPPGVSPAEAAGVGEGLGLGLPSPRGPGLNLPPPIGGAGPPLGLPKPKKRKEPVKIAAPELHKGDSDSEEDEPTKKKTILQGSSEGTGLSALLPQPKNLTVKETNRLLLPHAFSRKPSDGSPDTKPSRLASKTKTSSLAPVVGTTTTTPSPSAIKAAAKSAALQVTKQITQEEDDSDEEVAPENFFSLPEKAEPPGVEPYPYPIPTVPEELPPGTEPEPAFQDDAANAPLEFKMKLRRMNRFTVAELKQLVARPDVVK

SEQ ID NO: 837112 - protein, 178 aa, Homo sapiens
MSLVAYASSDESEPDEAEPPARAGKQAARVGSLTILPRLFRALLSPFFFPRRPQRGSPFVPSPPLQCLGAQPPPACFAPRVPRAFFSFSPLLFGLGAFSPPSERSPAKARRGQFGAAGALGLGLPPSPPGPPGPFKFLPPLPNLGRVAGPPRLGGLFPKAPKAKQKSSPRCKAFAGPP

SEQ ID NO: 837113 - protein, 112 aa, Homo sapiens
MSLVAYASSDESEPDEAEPEPEEEEAVAPTSGPALGGLFASLPAPKGPALLPPPPQMLAPAFPPPLLLPPPTGDPRLQPPPPLPLWEGGLTSYCSNELGLNLWDIGECIGPV

SEQ ID NO: 837114 - protein, 241 aa, Homo sapiens
MSLVAYASSDESEPDEAEPEPEEEEAVAPTSGPALGGLFASLPAPKGPALLPPPPQMLAPAFPPLSAATRRNASRSMHHLMLYNKSRVIEDRLLALRTPPHTHPTHTTTTRKAPATPHHTTMRNPSRAGGRAATPSHHPTAESQPCRHPPAAVPPPPRLPATRTPPPPPLRQQPPSHPHHNPPASEAAPTPPHRRRRAREKTDIPAEPCTRLARREPPPPPPADATPTPAHPHPNAAPATP

SEQ ID NO: 837115 - protein, 399 aa, Homo sapiens
MSLVAYASSDESEPDEAEPEPEEEEAVAPTSGPALGGLFASLPAPKGPALLPPPPQMLAPAFPPPLLLPPPTGDPRLQPPPPLPFGLGGFPPPPGVSPAEAAGVGEGLGLGLPSPRGPGLNLPPPIGGAGPPLGLPKPKKRKEPVKIAAPELHKGDSDSEEDEPTKKKTILQGSSEGTGLSALLPQPKNLTVKETNRLLLPHAFSRKPSDGSPDTKPSRLASKTKTSSLAPVVGTTTTTPSPSAIKAAAKSAALQVTKQITQEEDDSDEEVAPENFFSLPEKAEPPGVEPYPYPIPTVPEELPPGTEPEPAFQDDAANAPLEFKMAAGSSGAPWMPKPGDDYSYNQFSTYGDANAAGAYYQGLQQHLGHSPLRGIMRFLNSKSGKRTCFVPSFVSFIVS

SEQ ID NO: 837116 - protein, 167 aa, Homo sapiens
MAAGSSGAPWMPKPGDDYSYNQFSTYGDANAAGAYYQDYYSGGYYPAQDPALVPPQEIAPDASFIDDEAFKRLQGKRNRGREEINFVEIKGDDQLSGAQQWMTKSLTEEKTMKSFSKKKGEQPTGQQRRKHQITYLIHQAKERELELKNTWSENKLSRRQTQAKYGF

SEQ ID NO: 837117 - protein, 472 aa, Homo sapiens
MSLVAYASSDESEPDEAEPEPEEEEAVAPTSGPALGGLFASLPAPKGPALLPPPPQMLAPAFPPPLLLPPPTGDPRLQPPPPLPFGLGGFPPPPGVSPAEAAGVGEGLGLGLPSPRGPGLNLPPPIGGAGPPLGLPKPKKRKEPVKIAAPELHKGDSDSEEDEPTKKKTILQGSSEGTGLSALLPQPKNLTVKETNRLLLPHAFSRKPSDGSPDTKPSRLASKTKTSSLAPVVGTTTTTPSPSAIKAAAKSAALQVTKQITQEEDDSDEEVAPENFFSLPEKAEPPGVEPYPYPIPTVPEELPPGTEPEPAFQDDAANAPLEFKMAAGSSGAPWMPKPGDDYSYNQFSTYGDANAAGAYYQDYYSGGYYPAQDPALVPPQEIAPDASFIDDEAFKRLQGKRNRGREEINFVEIKGDDQLSGAQQWMTKSLTEEKTMKSFSKKKGEQPTGQQRRKHQITYLIHQIFDRFFLTS

SEQ ID NO: 837118 - protein, 435 aa, Homo sapiens
MSLVAYASSDESEPDEAEPEPEEEEAVAPTSGPALGGLFASLPAPKGPALLPPPPQMLAPAFPPPLLLPPPTGDPRLQPPPPLPFGLGGFPPPPGVSPAEAAGVGEGLGLGLPSPRGPGLNLPPPIGGAGPPLGLPKPKKRKEPVKIAAPELHKGDSDSEEDEPTKKKTILQGSSEGTGLSALLPQPKNLTVKETNRLLLPHAFSRKPSDGSPDTKPSRLASKTKTSSLAPVVGTTTTTPSPSAIKAAAKSAALQVTKQITQEEDDSDEEVAPENFFSLPEKAEPPGVEPYPYPIPTVPEELPPGTEPEPAFQDDAANAPLEFKMAAGSSGAPWMPKPGDDYSYNQFSTYGDANAAGAYYQDYYSGGYYPAQDPALVPPQEIAPDASFIDDEAFKRLQGKRNRGREEINFVEIKGDDQLSPGSLSPRTQPSPLRE

SEQ ID NO: 837119 - protein, 241 aa, Homo sapiens
MSLVAYASSDESEPDEAEPEPEEEEAVAPTSGPALGGLFASLPAPKGPALLPPPPQMLAPAFPPPLLLPPPTGDPRLQPPPPLPFGLGGFPPPPGVSPAEAAGVGEGLGLGLPSPRGPGLNLPPPIGGAGPPLGLPKPKKRKEPVKIAAPELHKGDSDSEEDEPTKKKTILQGSSEGTGLSALLPQPKNLTVKETNRLLLPHAFSRKPSDGSPAKPRISFPKDPALASARMNIFDRFFLTS

SEQ ID NO: 837120 - protein, 167 aa, Homo sapiens
STKLISSLPWMPKPGDDYSYNQFSTYGDANAAGAYYQDYYSGGYYPAQDPALVPPQEIAPDASFIDDEAFKRLQGKRNRGREEINFVEIKGDDQLSGAQQWMTKSLTEEKTMKSFSKKKGEQPTGQQRRKHQITYLIHQAKERELELKNTWSENKLSRRQTQAKYGF

SEQ ID NO: 837121 - protein, 60 aa, Homo sapiens
PARSEGVRWGGLLEPRRLLEGEQDQLRLNRMQPHPSHSPVGREPWEEKPNLSFPQASGAL

SEQ ID NO: 837122 - protein, 49 aa, Homo sapiens
MGKGEQEKPGGTAWQASALTRKFISTGMRVRNSSMSQDHSPHQWTLLEL

SEQ ID NO: 837123 - protein, 164 aa, Homo sapiens
MIWRRAALAGTRLVWSRSGSAGWLDRAAGAAGAAAAAASGMESNTSSSLENLATAPVNQIQETISDNCVVIFSKTSCSYCTMAKKLFHDMNVNYKVVELDLLEYGNQFQDALYKMTGERTVPRIFVNGTFIGGATDTHRLHKEGKLLPLVHQCYLKKSKRKEFQ

SEQ ID NO: 837124 - protein, 164 aa, Homo sapiens; identical to SEQ ID NO: 837123

SEQ ID NO: 837125 - protein, 164 aa, Homo sapiens; identical to SEQ ID NO: 837123

SEQ ID NO: 837126 - protein, 164 aa, Homo sapiens; identical to SEQ ID NO: 837123

SEQ ID NO: 837127 - protein, 165 aa, Homo sapiens
MNPRDKQVSRFSPLKDVYTWVALAGIQRSGSPGRTRSAARRMESNTSSSLENLATAPVNQIQETISDNCVVIFSKTSCSYCTMAKKLFHDMNVNYKVVELDLLEYGNQFQDALYKMTGERTVPRIFVNGTFIGGATDTHRLHKEGKLLPLVHQCYLKKSKRKEFQ

SEQ ID NO: 837128 - protein, 123 aa, Homo sapiens
LLFIANILCRTATAPVNQIQETISDNCVVIFSKTSCSYCTMAKKLFHDMNVNYKVVELDLLEYGNQFQDALYKMTGERTVPRIFVNGTFIGGATDTHRLHKEGKLLPLVHQCYLKKSKRKEFQ

SEQ ID NO: 837129 - protein, 141 aa, Homo sapiens
TDKLIIIIIINKKYSQAMESNTSSSLENLATAPVNQIQETISDNCVVIFSKTSCSYCTMAKKLFHDMNVNYKVVELDLLEYGNQFQDALYKMTGERTVPRIFVNGTFIGGATDTHRLHKEGKLLPLVHQCYLKKSKRKEFQ

SEQ ID NO: 837130 - protein, 580 aa, Homo sapiens
NPSSIPVCRRQAIDGFISAWVNNRLSVSRPDLCIFSSLVQSESGCANIVSAAPCQAEPQQYEVQFGRLRNFLTDSDSQHSHEVMPLLYPLFVYLHLNLVQNSPKSTVESFYSRFHGMFLQNASQKDVIEQLQTTQTIQDILSNFKLRAFLDNKYVVRLQEDSYNYLIRYLQSDNNTALCKVLTLHIHLDVQPAKRTDYQLYASGSSSRSENNGLEPPDMPSPILQNEAALEVLQESIKRVKDGPPSLTTICFYAFYNTEQLLNTAEISPDSKLLAAGFDNSCIKLWSLRSKKLKSEPHQVDVSRIHLACDILEEEDDEDDNAGTEMKILRGHCGPVYSTRFLADSSGLLSCSEDMSIRYWDLGSFTNTVLYQGHAYPVWDLDISPYSLYFASGSHDRTARLWSFDRTYPLRIYAGHLADVDCVKFHPNSNYLATGSTDKTVRLWSAQQGNSVRLFTGHRGPVLSLAFSPNGKYLASAGEDQRLKLWDLASGTLYKELRGHTDNITSLTFSPDSGLIASASMDNSVRVWDIRNTYCSAPADGSSSELVGVYTGQMSNVLSVQFMACNLLLVTGITQENQEH

SEQ ID NO: 837131 - protein, 189 aa, Homo sapiens
MKRVRTEQIQMAVSCYLKRRQYVDSDGPLKQGLRLSQTAEEMAANLTVQSESGCANIVSAAPCQAEPQQYEVQFGRLRNFLTDSDSQHSHEVMPLLYPLFVYLHLNLVQNSPKSTVESFYSRFHGMFLQNASQKDVIEQLQTTQTIQDILSNFKLRAFLDNKYVVRLQEDSYNYLIRYLQSDNNTALSG

SEQ ID NO: 837132 - protein, 100 aa, Homo sapiens
QAPDVSVILSLPPLKVMKRVRTEQIQMAVSCYLKRRQYVDSDGPLKQGLRLSQTAEEMAANLTGNGGGSSGGVSLEQENSRQYPCGITSPLLKTVPERAD

SEQ ID NO: 837133 - protein, 589 aa, Homo sapiens
MKRVRTEQIQMAVSCYLKRRQYVDSDGPLKQGLRLSQTAEEMAANLTVQSESGCANIVSAAPCQAEPQQYEVQFGRLRNFLTDSDSQHSHEVMPLLYPLFVYLHLNLVQNSPKSTVESFYSRFHGMFLQNASQKDVIEQLQTTQTIQDILSNFKLRAFLDNKYVVRLQEDSYNYLIRYLQSDNNTALCKVLTLHIHLDVQPAKRTDYQLYASGSSSRSENNGLEPPDMPSPILQNEAALEVLQESIKRVKDGPPSLTTICFYAFYNTEQLLNTAEISPDSKLLAAGFDNSCIKLWSLRSKKLKSEPHQVDVSRIHLACDILEEEDDEDDNAGTEMKILRGHCGPVYSTRFLADSSGLLSCSEDMSIRYWDLGSFTNTVLYQGHAYPVWDLDISPYSLYFASGSHDRTARLWSFDRTYPLRIYAGHLADVDCVKFHPNSNYLATGSTDKTVRLWSAQQGNSVRLFTGHRGPVLSLAFSPNGKYLASAGEDQRLKLWDLASGTLYKELRGHTDNITSLTFSPDSGLIASASMDNSVRVWDIRNTYCSAPADGSSSELVGVYTGQMSNVLSVQFMACNLLLVTGITQENQEH

SEQ ID NO: 837134 - protein, 203 aa, Homo sapiens
MKRVRTEQIQMAVSCYLKRRQYVDSDGPLKQGLRLSQTAEEMAANLTVQSESGCANIVSAAPCQAEPQQYEVQFGRLRNFLTDSDSQHSHEVMPLLYPLFVYLHLNLVQNSPKSTVESFYSRFHGMFLQNASQKDVIEQLQTTQTIQDILSNFKLRAFLDNKYVVRLQEDSYNYLIRYLQSDNNTALCKVLTLHIHLDSWHWF

SEQ ID NO: 837135 - protein, 68 aa, Homo sapiens
PFREQRQGPGLGSLEGGGLEPLEVRTLAPPLVTGYKDKGNQICANRGGVCGVTRLGLAMQGPYVIWAL

SEQ ID NO: 837136 - protein, 501 aa, Homo sapiens
RIQRPLNSSKGTMPLRDETLREVWASDSGHEEESLSPEAPRRPKQRPAPAQRLRKKRTEAPESPCPTGSKPRKPGEEEEEEEDEEDEEEEAEEKKEKILLPPKKPLREKSSADLKERRAKAQGPRGDLGSPDPPPKPLRVRNKEAPAGEGTKMRKTKKKGSGEADKDPSGSPASARKSPAAMFLVGEGSPDKKALKKKGTPKGARKEEEEEEEAATVIKNSNQKGKAKGKGKKKAKEERAPSPPVEVDEPREFVLRPAPQGRTVRCRLTRDKKGMDRGMYPSYFLHLDTEKKVFLLAGRKRKRSKTANYLISIDPTNLSRGGENFIGKLRSNLLGNRFTVFDNGQNPQRGYSTNVASLRQELAAVIYETNVLGFRGPRRMTVIIPGMSAENERVPIRPRNASDGLLVRWQNKTLESLIELHNKPPVWNDDSGSYTLNFQGRVTQASVKNFQIVHADDPDYIVLQFGRVAEDAFTLDYRYPLCALQAFAIALSSFDGKLACE

SEQ ID NO: 837137 - protein, 554 aa, Homo sapiens
RIQRPLNSSKGTMPLRDETLREVWASDSGHEEESLSPEAPRRPKQRPAPAQRLRKKRTEAPESPCPTGSKPRKPGAGRTGRPREEPSPDPAQARAPQTVYARFLRDPEAKKRDPRETFLVARAPDAEDEEEEEEEDEEDEEEEAEEKKEKILLPPKKPLREKSSADLKERRAKAQGPRGDLGSPDPPPKPLRVRNKEAPAGEGTKMRKTKKKGSGEADKDPSGSPASARKSPAAMFLVGEGSPDKKALKKKGTPKGARKEEEEEEEAATVIKNSNQKGKAKGKGKKKAKEERAPSPPVEVDEPREFVLRPAPQGRTVRCRLTRDKKGMDRGMYPSYFLHLDTEKKVFLLAGRKRKRSKTANYLISIDPTNLSRGGENFIGKLRSNLLGNRFTVFDNGQNPQRGYSTNVASLRQELAAVIYETNVLGFRGPRRMTVIIPGMSAENERVPIRPRNASDGLLVRWQNKTLESLIELHNKPPVWNDDSGSYTLNFQGRVTQASVKNFQIVHADDPDYIVLQFGRVAEDAFTLDYRYPLCALQAFAIALSSFDGKLACE

SEQ ID NO: 837138 - protein, 542 aa, Homo sapiens
MPLRDETLREVWASDSGHEEESLSPEAPRRPKQRPAPAQRLRKKRTEAPESPCPTGSKPRKPGAGRTGRPREEPSPDPAQARAPQTVYARFLRDPEAKKRDPRETFLVARAPDAEDEEEEEEEDEEDEEEEAEEKKEKILLPPKKPLREKSSADLKERRAKAQGPRGDLGSPDPPPKPLRVRNKEAPAGEGTKMRKTKKKGSGEADKDPSGSPASARKSPAAMFLVGEGSPDKKALKKKGTPKGARKEEEEEEEAATVIKNSNQKGKAKGKGKKKAKEERAPSPPVEVDEPREFVLRPAPQGRTVRCRLTRDKKGMDRGMYPSYFLHLDTEKKVFLLAGRKRKRSKTANYLISIDPTNLSRGGENFIGKLRSNLLGNRFTVFDNGQNPQRGYSTNVASLRQELAAVIYETNVLGFRGPRRMTVIIPGMSAENERVPIRPRNASDGLLVRWQNKTLESLIELHNKPPVWNDDSGSYTLNFQGRVTQASVKNFQIVHADDPDYIVLQFGRVAEDAFTLDYRYPLCALQAFAIALSSFDGKLACE

SEQ ID NO: 837139 - protein, 101 aa, Homo sapiens
SLVVVGSIQVRHGCWKHFANQGEEFTALFPPPRSGTPKGARKEEEEEEEAATVIKNSNQKGKAKGKGKKVGAQRGRGLRSLQGAEAGAWTWEPRGWGLGAT

SEQ ID NO: 837140 - protein, 865 aa, Homo sapiens
ADNASKLAAMLNTCSFQKPEQLQQQKSVFEICPSPAENNIQGTTKLASGEEFCSGSSSNLQAPGGSSERYLKQNEMNGAYFKQSSVFTKDSFSATTTPPPPSQLLLSPPPPLPQVPQLPSEGKSTLNGGVLEEHHHYPNQSNTTLLREVKIEGKPEAPPSQSPNPSTHVCSPSPMLSERPQNNCVNRNDIQTAGTMTVPLCSEKTRPMSEHLKHNPPIFGSSGELQDNCQQLMRNKEQEILKGRDKEQTRDLVPPTQHYLKPGWIELKAPRFHQAESHLKRNEASLPSILQYQPNLSNQMTSKQYTGNSNMPGGLPRQAYTQKTTQLEHKSQMYQVEMNQGQSQGTVDQHLQFQKPSHQVHFSKTDHLPKAHVQSLCGTRFHFQQRADSQTEKLMSPVLKQHLNQQASETEPFSNSHLLQHKPHKQAAQTQPSQSSHLPQNQQQQQKLQIKNKEEILQTFPHPQSNNDQQREGSFFGQTKVEECFHGENQYSKSSEFETHNVQMGLEEVQNINRRNSPYSQTMKSSACKIQVSCSNNTHLVSENKEQTTHPELFAGNKTQNLHHMQYFPNNVIPKQDLLHRCFQEQEQKSQQASVLQGYKNRNQDMSGQQAAQLAQQRYLIHNHANVFPVPDQGGSHTQTPPQKDTQKHAALRWHLLQKQEQQQTQQPQTESCHSQMHRPIKVEPGCKPHACMHTAPPENKTWKKVTKQENPPASCDNVQQKSIIETMEQHLKQFHAKSLFDHKALTLKSQKQVKVEMSGPVTVLTRQTTAAELDSHTPALEQQTTSSEKTPTKRTAASVLNNFIESPSKLLDTPIKNLLDTPVKTQYDFPSCRCVGKCQKCTETHGVYPELANLSSDMGFSFFF

SEQ ID NO: 837141 - protein, 143 aa, Homo sapiens
MLEWLQVVRTFSLLIPARYVFDASAGLSFTPQYYIPLTAVCHLSILVNSISRHANFTLSAITVKTKLPPPITNVPPHLSPSLPCYSRFQAKLNLSAPMSLFPTAPVAYGRPPSYSHYSGSPSGRHLYFIFYPPAVTTARARSR

SEQ ID NO: 837142 - protein, 400 aa, Homo sapiens
MNGQLDLSGKLIIKAQLGEDIRRIPIHNEDITYDELVLMMQRVFRGKLLSNDEVTIKYKDEDGDLITIFDSSDLSFAIQCSRILKLTLFVNGQPRPLESSQVKYLRRELIELRNKVNRLLDSLEPPGEPGPSTNIPENDTVDGREEKSASDSSGKQSTQVMAASMSAFDPLKNQDEINKNVMSAFGLTDDQVSGPPSAPAEDRSGTPDSIASSSSAAHPPGVQPQQPPYTGAQTQAGQIEGQMYQQYQQQAGYGAQQPQAPPQQPQQYGIQYSASYSQQTGPQQPQQFQGYGQQPTSQAPAPAFSGQPQQLPAQPPQQYQASNYPAQTYTAQTSQPTNYTVAPASQPGMAPSQPGAYQPRPGFTSLPGSTMTPPPSGPNPYARNRPPFGQGYTQPGPGYR

SEQ ID NO: 837143 - protein, 400 aa, Homo sapiens; identical to SEQ ID NO: 837142

SEQ ID NO: 837144 - protein, 400 aa, Homo sapiens; identical to SEQ ID NO: 837142

SEQ ID NO: 837145 - protein, 400 aa, Homo sapiens; identical to SEQ ID NO: 837142

SEQ ID NO: 837146 - protein, 400 aa, Homo sapiens; identical to SEQ ID NO: 837142

SEQ ID NO: 837147 - protein, 400 aa, Homo sapiens; identical to SEQ ID NO: 837142

SEQ ID NO: 837148 - protein, 373 aa, Homo sapiens
MNGQLDLSGKLIIKAQLGEDIRRIPIHNEDITYDELVLMMQRVFRGKLLSNDEVTIKYKDEDGDLITIFDSSDLSFAIQCSRILKLTLFVNGQPRPLESSQVKYLRRELIELRNKVNRLLDSLEPPGEPGPSTNIPENDTVDGREEKSASDSSGKQSTQVMAASMSGPPSAPAEDRSGTPDSIASSSSAAHPPGVQPQQPPYTGAQTQAGQIEGQMYQQYQQQAGYGAQQPQAPPQQPQQYGIQYSASYSQQTGPQQPQQFQGYGQQPTSQAPAPAFSGQPQQLPAQPPQQYQASNYPAQTYTAQTSQPTNYTVAPASQPGMAPSQPGAYQPRPGFTSLPGSTMTPPPSGPNPYARNRPPFGQGYTQPGPGYR

SEQ ID NO: 837149 - protein, 158 aa, Homo sapiens
MYQQYQQQAGYGAQQPQAPPQQPQQYGIQYSASYSQQTGPQQPQQFQGYGQQPTSQAPAPAFSGQPQQLPAQPPQQYQASNYPAQTYTAQTSQPTNYTVAPASQPGMAPSQPGAYQPRPGFTSLPGSTMTPPPSGPNPYARNRPPFGQGYTQPGPGYR

SEQ ID NO: 837150 - protein, 386 aa, Homo sapiens
MNGQLDLSGKLIIKAQLGEDIRRIPIHNEDITYDELVLMMQRVFRGKLLSNDEVTIKYKDEDGDLITIFDSSDLSFAIQCSRILKLTLFVNGQPRPLESSQVKYLRRELIELRNKVNRLLDSLEPPGEPGPSTNIPENDTVDGREEKSASDSSGKQSTQVMAASMSAFDPLKNQDEINKNVMSAFGLTDDQVSGPPSAPAEDRSGTPDSIASSSSAAHPPGVQPQQPPYTGAQTQAGQIEGQMYQQYQQQAGYGAQQPQAPPQQPQQYGIQYSASYSQQTGPQQPQQFQGYGQQPTSQAPAPAFSGQPQQLPAQPPQQYQASNYPAQTYTAQTSQPTNYTVAPASQPGMLGLPQVDLTSLRGYLRLLCSLHQGLLKMAVCRLSKRW

SEQ ID NO: 837151 - protein, 261 aa, Homo sapiens
MNGQLDLSGKLIIKAQLGEDIRRIPIHNEDITYDELVLMMQRVFRGKLLSNDEVTIKYKDEDGDLITIFDSSDLSFAIQCSRILKLTLFVNGQPRPLESSQVKYLRRELIELRNKVNRLLDSLEPPGEPGPSTNIPENDTVDGREEKSASDSSGKQSTQVMAASMSAFDPLKNQDEINKNVMSAFGLTDDQVSGPPSAPAEDRSGTPDSIASSSSAAHPPGVQPQQPPYTGAQTQAGQIDQQFSTGRYGASKRAHFRLKVV

SEQ ID NO: 837152 - protein, 105 aa, Homo sapiens
LDIPLIRLQAIVSRLDLNNLSSSRDMASNQLPRHQLLPFLVSLNNCLLSRHSSTRRAIILHKLTLPKLLSLLIILWLLPLNLEWLQANLGPINQDQVLLHFLEVP

SEQ ID NO: 837153 - protein, 71 aa, Homo sapiens
PPPPGGVGLWRLSLFDSAGPPSAPAEDRSGTPDSIASSSSAAHPPGVQPQQPPYTGAQTQAGQIEGKIEFR

SEQ ID NO: 837154 - protein, 400 aa, Homo sapiens; identical to SEQ ID NO: 837142

SEQ ID NO: 837155 - protein, 400 aa, Homo sapiens; identical to SEQ ID NO: 837142

SEQ ID NO: 837156 - protein, 400 aa, Homo sapiens; identical to SEQ ID NO: 837142

SEQ ID NO: 837157 - protein, 400 aa, Homo sapiens; identical to SEQ ID NO: 837142

SEQ ID NO: 837158 - protein, 400 aa, Homo sapiens; identical to SEQ ID NO: 837142

SEQ ID NO: 837159 - protein, 400 aa, Homo sapiens; identical to SEQ ID NO: 837142

SEQ ID NO: 837160 - protein, 400 aa, Homo sapiens; identical to SEQ ID NO: 837142

SEQ ID NO: 837161 - protein, 223 aa, Homo sapiens
RRGESNLKGVKNKENLGPPSAPAEDRSGTPDSIASSSSAAHPPGVQPQQPPYTGAQTQAGQIEGQMYQQYQQQAGYGAQQPQAPPQQPQQYGIQYSASYSQQTGPQQPQQFQGYGQQPTSQAPAPAFSGQPQQLPAQPPQQYQASNYPAQTYTAQTSQPTNYTVAPASQPGMAPSQPGAYQPRPGFTSLPGSTMTPPPSGPNPYARNRPPFGQGYTQPGPGYR

SEQ ID NO: 837162 - protein, 220 aa, Homo sapiens
RTPLRITTEEVARGPPSAPAEDRSGTPDSIASSSSAAHPPGVQPQQPPYTGAQTQAGQIEGQMYQQYQQQAGYGAQQPQAPPQQPQQYGIQYSASYSQQTGPQQPQQFQGYGQQPTSQAPAPAFSGQPQQLPAQPPQQYQASNYPAQTYTAQTSQPTNYTVAPASQPGMAPSQPGAYQPRPGFTSLPGSTMTPPPSGPNPYARNRPPFGQGYTQPGPGYR

SEQ ID NO: 837163 - protein, 194 aa, Homo sapiens
PPPPYTNSPTHRLRGTPGHPVLLQKIVQEHPTALLPPPQQLTHQAFSHSSHHIQELRLKQVRLKVRCTNSTSNRPAMVHSSRRLHLSSLNSMVFSIQQAIVSRLDLNNLSSSRDMASNQLPRHQLLPFLVSLNNCLLSRHSSTRRAIILHKLTLPKLLSLLIILWLLPLNLEWLQANLGPINQDQVLLHFLEVP

SEQ ID NO: 837164 - protein, 158 aa, Homo sapiens; identical to SEQ ID NO: 837149

SEQ ID NO: 837165 - protein, 195 aa, Homo sapiens
PHTLHTTTRSTRPLSRALGHPVLLQKIVQEHPTALLPPPQQLTHQAFSHSSHHIQELRLKQVRLKVRCTNSTSNRPAMVHSSRRLHLSSLNSMVFSIQQAIVSRLDLNNLSSSRDMASNQLPRHQLLPFLVSLNNCLLSRHSSTRRAIILHKLTLPKLLSLLIILWLLPLNLEWLQANLGPINQDQVLLHFLEVP

SEQ ID NO: 837166 - protein, 187 aa, Homo sapiens [sequence omitted]

SEQ ID NO: 837167 - protein, 228 aa, Homo sapiens
MNGQLDLSGKLIIKAQLGEDIRRIPIHNEDITYDELVLMMQRVFRGKLLSNDEVTIKYKDEDGDLITIFDSSDLSFAIQCSRILKLTLFVNGQPRPLESSQVKYLRRELIELRNKVNRLLDSLEPPGEPGPSTNIPENDTVDGREEKSASDSSGKQSTQVMAASMSAFDPLKNQDEINKNVMSAFGLTDDQVSGPPSAPAEDRSGTPDSIASSSSAASTVWYSVFSKL

SEQ ID NO: 837168 - protein, 138 aa, Homo sapiens
RTEEDKKLEVKEGNAGGDGVATSKEISNSCSVGWYGLVTEEYQVLETYTGQSEQRSRCTVPSEERVQELSTLYRSLSVKEREEGLGKHGVFLLTENSACGGGKKSVGGRQGGNLPQREEERADLGVYVEKVLSPCSGG

SEQ ID NO: 837169 - protein, 404 aa, Homo sapiens
MPSSSDTALGGGGGLSWAEKRLEERRKRRRFLSPQQPPLLLPLLQPQLLQPPPPPPPLLFLAAPGTAAAAAAAAAASSSCFSPGPPLEVKRLARGKRRAGGRQKRRRGPRAGQEAEKRRVFSLPQPQQDGGGGASSGGGVTPLVEYEDVSSQSEQGLLLGGASAATAATAAGGTGGSGGSPASSSGTQRRGEGSERRPRRDRRSSSGRSKERHREHRRRDGQRGGSEASKSRSRHSHSGEERAEVAKSGSSSSSGGRRKSASATSSSSSSRKDRDSKAHRSRTKSSKEPPSAYKEPPKAYREDKTEPKAYRRRRSLSPLGGRDDSPVSHRASQSLRSRKSPSPAGGGSSPYSRRLPRSPSPYSRRRSPSYSRHSSYERGGDVSPSPYSSSSWRRSRSPYSPVLR

SEQ ID NO: 837170 - protein, 966 aa, Homo sapiens
MPSSSDTALGGGGGLSWAEKRLEERRKRRRFLSPQQPPLLLPLLQPQLLQPPPPPPPLLFLAAPGTAAAAAAAAAASSSCFSPGPPLEVKRLARGKRRAGGRQKRRRGPRAGQEAEKRRVFSLPQPQQDGGGGASSGGGVTPLVEYEDVSSQSEQGLLLGGASAATAATAAGGTGGSGGSPASSSGTQRRGEGSERRPRRDRRSSSGRSKERHREHRRRDGQRGGSEASKSRSRHSHSGEERAEVAKSGSSSSSGGRRKSASATSSSSSSRKDRDSKAHRSRTKSSKEPPSAYKEPPKAYREDKTEPKAYRRRRSLSPLGGRDDSPVSHRASQSLRSRKSPSPAGGGSSPYSRRLPRSPSPYSRRRSPSYSRHSSYERGGDVSPSPYSSSSWRRSRSPYSPVLRRSGKSRSRSPYSSRHSRSRSRHRLSRSRSRHSSISPSTLTLKSSLAAELNKNKKARAAEAARAAEAAKAAEATKAAEAAAKAAKASNTSTPTKGNTETSASASQTNHVKDVKKIKIEHAPSPSSGGTLKNDKAKTKPPLQVTKVENNLIVDKATKKAVIVGKESKSAATKEESVSLKEKTKPLTPSIGAKEKEQHVALVTSTLPPLPLPPMLPEDKEADSLRGNISVKAVKKEVEKKLRCLLADLPLPPELPGGDDLSKSPEEKKTATQLHSKRRPKICGPRYGETKEKDIDWGKRCVDKFDIIGIIGEGTYGQVYKARDKDTGEMVALKKVRLDNEKEGFPITAIREIKILRQLTHQSIINMKEIVTDKEDALDFKKDKGAFYLVFEYMDHDLMGLLESGLVHFNENHIKSFMRQLMEGLDYCHKKNFLHRDIKCSNILLNNRGQIKLADFGLARLYSSEESRPYTNKVITLWYRPPELLLGEERYTPAIDVWSCGCILGELFTKKPIFQANQELAQLELISRICGSPCPAVWPDVIKLPYFNTMKPKKQYRRKLREEFVL

SEQ ID NO: 837171 - protein, 1452 aa, Homo sapiens
MPSSSDTALGGGGGLSWAEKRLEERRKRRRFLSPQQPPLLLPLLQPQLLQPPPPPPPLLFLAAPGTAAAAAAAAAASSSCFSPGPPLEVKRLARGKRRAGGRQKRRRGPRAGQEAEKRRVFSLPQPQQDGGGGASSGGGVTPLVEYEDVSSQSEQGLLLGGASAATAATAAGGTGGSGGSPASSSGTQRRGEGSERRPRRDRRSSSGRSKERHREHRRRDGQRGGSEASKSRSRHSHSGEERAEVAKSGSSSSSGGRRKSASATSSSSSSRKDRDSKAHRSRTKSSKEPPSAYKEPPKAYREDKTEPKAYRRRRSLSPLGGRDDSPVSHRASQSLRSRKSPSPAGGGSSPYSRRLPRSPSPYSRRRSPSYSRHSSYERGGDVSPSPYSSSSWRRSRSPYSPVLRRSGKSRSRSPYSSRHSRSRSRHRLSRSRSRHSSISPSTLTLKSSLAAELNKNKKARAAEAARAAEAAKAAEATKAAEAAAKAAKASNTSTPTKGNTETSASASQTNHVKDVKKIKIEHAPSPSSGGTLKNDKAKTKPPLQVTKVENNLIVDKATKKAVIVGKESKSAATKEESVSLKEKTKPLTPSIGAKEKEQHVALVTSTLPPLPLPPMLPEDKEADSLRGNISVKAVKKEVEKKLRCLLADLPLPPELPGGDDLSKSPEEKKTATQLHSKRRPKICGPRYGETKEKDIDWGKRCVDKFDIIGIIGEGTYGQVYKARDKDTGEMVALKKVRLDNEKEGFPITAIREIKILRQLTHQSIINMKEIVTDKEDALDFKKDKGAFYLVFEYMDHDLMGLLESGLVHFNENHIKSFMRQLMEGLDYCHKKNFLHRDIKCSNILLNNRGQIKLADFGLARLYSSEESRPYTNKVITLWYRPPELLLGEERYTPAIDVWSCGCILGELFTKKPIFQANQELAQLELISRICGSPCPAVWPDVIKLPYFNTMKPKKQYRRKLREEFVFIPAAALDLFDYMLALDPSKRCTAEQALQCEFLRDVEPSKMPPPDLPLWQDCHELWSKKRRRQKQMGMTDDVSTIKAPRKDLSLGLDDSRTNTPQGVLPSSQLKSQGSSNVAPGEKQTDPSTPQQESSKPLGGIQPSSQTIQPKVETDAAQAAVQSAFAVLLTQLIKAQQSKQKDVLLEERENGSGHEASLQLRPPPEPSTPVSGQDDLIQHQDMRILELTPEPDRPRILPPDQRPPEPPEPPPVTEEDLDYRTENQHVPTTSSSLTDPHAGVKAALLQLLAQHQPQDDPKREGGIDYQAGDTYVSTSDYKDNFGSSSFSSAPYVSNDGLGSSSAPPLERRSFIGNSDIQSLDNYSTASSHSGGPPQPSAFSESFPSSVAGYGDIYLNAGPMLFSGDKDHRFEYSHGPIAVLANSSDPSTGPESTHPLPAKMHNYNYGGNLQENPSGPSLMHGQTWTSPAQGPGYSQGYRGHISTSTGRGRGRGLPY

SEQ ID NO: 837172 - protein, 1222 aa, Homo sapiens
MPSSSDTALGGGGGLSWAEKRLEERRKRRRFLSPQQPPLLLPLLQPQLLQPPPPPPPLLFLAAPGTAAAAAAAAAASSSCFSPGPPLEVKRLARGKRRAGGRQKRRRGPRAGQEAEKRRVFSLPQPQQDGGGGASSGGGVTPLVEYEDVSSQSEQGLLLGGASAATAATAAGGTGGSGGSPASSSGTQRRGEGSERRPRRDRRSSSGRSKERHREHRRRDGQRGGSEASKSRSRHSHSGEERAEVAKSGSSSSSGGRRKSASATSSSSSSRKDRDSKAHRSRTKSSKEPPSAYKEPPKAYREDKTEPKAYRRRRSLSPLGGRDDSPVSHRASQSLRSRKSPSPAGGGSSPYSRRLPRSPSPYSRRRSPSYSRHSSYERGGDVSPSPYSSSSWRRSRSPYSPVLRRSGKSRSRSPYSSRHSRSRSRHRLSRSRSRHSSISPSTLTLKSSLAAELNKNKKARAAEAARAAEAAKAAEATKAAEAAAKAAKASNTSTPTKGNTETSASASQTNHVKDVKKIKIEHAPSPSSGGTLKNDKAKTKPPLQVTKVENNLIVDKATKKAVIVGKESKSAATKEESVSLKEKTKPLTPSIGAKEKEQHVALVTSTLPPLPLPPMLPEDKEADSLRGNISVKAVKKEVEKKLRCLLADLPLPPELPGGDDLSKSPEEKKTATQLHSKRRPKICGPRYGETKEKDIDWGKRCVDKFDIIGIIGEGTYGQVYKARDKDTGEMVALKKVRLDNEKEGFPITAIREIKILRQLTHQSIINMKEIVTDKEDALDFKKDKGAFYLVFEYMDHDLMGLLESGLVHFNENHIKSFMRQLMEGLDYCHKKNFLHRDIKCSNILLNNRGQIKLADFGLARLYSSEESRPYTNKVITLWYRPPELLLGEERYTPAIDVWSCGCILGELFTKKPIFQANQELAQLELISRICGSPCPAVWPDVIKLPYFNTMKPKKQYRRKLREEFVFIPAAALDLFDYMLALDPSKRCTAEQALQCEFLRDVEPSKMPPPDLPLWQDCHELWSKKRRRQKQMGMTDDVSTIKAPRKDLSLGLDDSRTNTPQGVLPSSQLKSQGSSNVAPGEKQTDPSTPQQESSKPLGGIQPSSQTIQPKVETDAAQAAVQSAFAVLLTQLIKAQQSKQKDVLLEERENGSGHEASLQLRPPPEPSTPVSGQDDLIQHQDMRILELTPEPDRPRILPPDQRPPEPPEPPPVTEEDLDYLERLF

SEQ ID NO: 837173 - protein, 1465 aa, Homo sapiens
MPSSSDTALGGGGGLSWAEKRLEERRKRRRFLSPQQPPLLLPLLQPQLLQPPPPPPPLLFLAAPGTAAAAAAAAAASSSCFSPGPPLEVKRLARGKRRAGGRQKRRRGPRAGQEAEKRRVFSLPQPQQDGGGGASSGGGVTPLVEYEDVSSQSEQGLLLGGASAATAATAAGGTGGSGGSPASSSGTQRRGEGSERRPRRDRRSSSGRSKERHREHRRRDGQRGGSEASKSRSRHSHSGEERAEVAKSGSSSSSGGRRKSASATSSSSSSRKDRDSKAHRSRTKSSKEPPSAYKEPPKAYREDKTEPKAYRRRRSLSPLGGRDDSPVSHRASQSLRSRKSPSPAGGGSSPYSRRLPRSPSPYSRRRSPSYSRHSSYERGGDVSPSPYSSSSWRRSRSPYSPVLRRSGKSRSRSPYSSRHSRSRSRHRLSRSRSRHSSISPSTLTLKSSLAAELNKNKKARAAEAARAAEAAKAAEATKAAEAAAKAAKASNTSTPTKGNTETSASASQTNHVKDVKKIKIEHAPSPSSGGTLKNDKAKTKPPLQVTKVENNLIVDKATKKAVIVGKESKSAATKEESVSLKEKTKPLTPSIGAKEKEQHVALVTSTLPPLPLPPMLPEDKEADSLRGNISVKAVKKEVEKKLRCLLADLPLPPELPGGDDLSKSPEEKKTATQLHSKRRPKICGPRYGETKEKDIDWGKRCVDKFDIIGIIGEGTYGQVYKARDKDTGEMVALKKVRLDNEKEGFPITAIREIKILRQLTHQSIINMKEIVTDKEDALDFKKDKGAFYLVFEYMDHDLMGLLESGLVHFNENHIKSFMRQLMEGLDYCHKKNFLHRDIKCSNILLNNRGQIKLADFGLARLYSSEESRPYTNKVITLWYRPPELLLGEERYTPAIDVWSCGCILGELFTKKPIFQANQELAQLELISRICGSPCPAVWPDVIKLPYFNTMKPKKQYRRKLREEFVFIPAAALDLFDYMLALDPSKRCTAEQALQCEFLRDVEPSKMPPPDLPLWQDCHELWSKKRRRQKQMGMTDDVSTIKAPRKDLSLGLDDSRTNTPQGVLPSSQLKSQGSSNVAPGEKQTDPSTPQQESSKPLGGIQPSSQTIQPKVETDAAQAAVQSAFAVLLTQLIKAQQSKQKDVLLEERENGSGHEASLQLRPPPEPSTPVSGQDDLIQHQDMRILELTPEPDRPRILPPDQRPPEPPEPPPVTEEDLDYRTENQHVPTTSSSLTDPHAGVKAALLQLLAQHQPQDDPKREGGIDYQAGDTYVSTSDYKDNFGSSSFSSAPYVSNDGLGSSSAPPLERRSFIGNSDIQSLDNYSTASSHSGGPPQPSAFSESFPSSVAGYGDIYLNAGPMLFSGDKDHRFEYSHGPIAVLANSSDPSTGPESTHPLPAKMHNYNYGGNLQENPSGPSLMHGQTWTSPAQGPGYSQGYRRIAVNAGSKGCSELRSRHCTPAWATDLDSI

SEQ ID NO: 837174 - protein, 1397 aa, Homo sapiens
MPSSSDTALGGGGGLSWAEKRLEERRKRRRFLSPQQPPLLLPLLQPQLLQPPPPPPPLLFLAAPGTAAAAAAAAAASSSCFSPGPPLEVKRLARGKRRAGGRQKRRRGPRAGQEAEKRRVFSLPQPQQDGGGGASSGGGVTPLVEYEDVSSQSEQGLLLGGASAATAATAAGGTGGSGGSPASSSGTQRRGEGSERRPRRDRRSSSGRSKERHREHRRRDGQRGGSEASKSRSRHSHSGEERAEVAKSGSSSSSGGRRKSASATSSSSSSRKDRDSKAHRSRTKSSKEPPSAYKEPPKAYREDKTEPKAYRRRRSLSPLGGRDDSPVSHRASQSLRSRKSPSPAGGGSSPYSRRLPRSPSPYSRRRSPSYSRHSSYERGGDVSPSPYSSSSWRRSRSPYSPVLRRSGKSRSRSPYSSRHSRSRSRHRLSRSRSRHSSISPSTLTLKSSLAAELNKNKKARAAEAARAAEAAKAAEATKAAEAAAKAAKASNTSTPTKGNTETSASASQTNHVKDVKKIKIEHAPSPSSGGTLKNDKAKTKPPLQVTKVENNLIVDKATKKAVIVGKESKSAATKEESVSLKEKTKPLTPSIGAKEKEQHVALVTSTLPPLPLPPMLPEDKEADSLRGNISVKAVKKEVEKKLRCLLADLPLPPELPGGDDLSKSPEEKKTATQLHSKRRPKICGPRYGETKEKDIDWGKRCVDKFDIIGIIGEGTYGQVYKARDKDTGEMVALKKVRLDNEKEGFPITAIREIKILRQLTHQSIINMKEIVTDKEDALDFKKDKGAFYLVFEYMDHDLMGLLESGLVHFNENHIKSFMRQLMEGLDYCHKKNFLHRDIKCSNILLNNRGQIKLADFGLARLYSSEESRPYTNKVITLWYRPPELLLGEERYTPAIDVWSCGCILGELFTKKPIFQANQELAQLELISRICGSPCPAVWPDVIKLPYFNTMKPKKQYRRKLREEFVFIPAAALDLFDYMLALDPSKRCTAEQALQCEFLRDVEPSKMPPPDLPLWQDCHELWSKKRRRQKQMGMTDDVSTIKAPRKDLSLGLDDSRTNTPQGVLPSSQLKSQGSSNVAPGEKQTDPSTPQQESSKPLGGIQPSSQTIQPKVETDAAQAAVQSAFAVLLTQLIKAQQSKQKDVLLEERENGSGHEASLQLRPPPEPSTPVSGQDDLIQHQDMRILELTPEPDRPRILPPDQRPPEPPEPPPVTEEDLDYRTENQHVPTTSSSLTDPHAGVKAALLQLLAQHQPQDDPKREGGIDYQAGDTYVSTSDYKDNFGSSSFSSAPYVSNDGLGSSSAPPLERRSFIGNSDIQSLDNYSTASSHSGGPPQPSAFSESFPSSVAGYGDIYLNAGPMLFSGDKDHRFEYSHGPIAVLARNLPGAKKPPWPGAIYYGT

SEQ ID NO: 837175 - protein, 246 aa, Homo sapiens
MYSSYQSHHCCESQGLQAIWKTVIQGCPQHPPGSSQPGGVGSAVIQAQRQVLRGIDYQAGDTYVSTSDYKDNFGSSSFSSAPYVSNDGLGSSSAPPLERRSFIGNSDIQSLDNYSTASSHSGGPPQPSAFSESFPSSVAGYGDIYLNAGPMLFSGDKDHRFEYSHGPIAVLANSSDPSTGPESTHPLPAKMHNYNYGGNLQENPSGPSLMHGQTWTSPAQGPGYSQGYRGHISTSTGRGRGRGLPY

SEQ ID NO: 837176 - protein, 938 aa, Homo sapiens
MPSSSDTALGGGGGLSWAEKRLEERRKRRRFLSPQQPPLLLPLLQPQLLQPPPPPPPLLFLAAPGTAAAAAAAAAASSSCFSPGPPLEVKRLARGKRRAGGRQKRRRGPRAGQEAEKRRVFSLPQPQQDGGGGASSGGGVTPLVEYEDVSSQSEQGLLLGGASAATAATAAGGTGGSGGSPASSSGTQRRGEGSERRPRRDRRSSSGRSKERHREHRRRDGQRGGSEASKSRSRHSHSGEERAEVAKSGSSSSSGGRRKSASATSSSSSSRKDRDSKAHRSRTKSSKEPPSAYKEPPKAYREDKTEPKAYRRRRSLSPLGGRDDSPVSHRASQSLRSRKSPSPAGGGSSPYSRRLPRSPSPYSRRRSPSYSRHSSYERGGDVSPSPYSSSSWRRSRSPYSPVLRRSGKSRSRSPYSSRHSRSRSRHRLSRSRSRHSSISPSTLTLKSSLAAELNKNKKARAAEAARAAEAAKAAEATKAAEAAAKAAKASNTSTPTKGNTETSASASQTNHVKDVKKIKIEHAPSPSSGGTLKNDKAKTKPPLQVTKVENNLIVDKATKKAVIVGKESKSAATKEESVSLKEKTKPLTPSIGAKEKEQHVALVTSTLPPLPLPPMLPEDKEADSLRGNISVKAVKKEVEKKLRCLLADLPLPPELPGGDDLSKSPEEKKTATQLHSKRRPKICGPRYGETKEKDIDWGKRCVDKFDIIGIIGEGTYGQVYKARDKDTGEMVALKKVRLDNEKEGFPITAIREIKILRQLTHQSIINMKEIVTDKEDALDFKKDKGAFYLVFEYMDHDLMGLLESGLVHFNENHIKSFMRQLMEGLDYCHKKNFLHRDIKCSNILLNNRGQIKLADFGLARLYSSEESRPYTNKVITLWYRPPELLLGEERYTPAIDVWSCGCILGELFTKKPIFQANQELAQLELIRHEENEVSDKQI

SEQ ID NO: 837177 - protein, 691 aa, Homo sapiens
MPSSSDTALGGGGGLSWAEKRLEERRKRRRFLSPQQPPLLLPLLQPQLLQPPPPPPPLLFLAAPGTAAAAAAAAAASSSCFSPGPPLEVKRLARGKRRAGGRQKRRRGPRAGQEAEKRRVFSLPQPQQDGGGGASSGGGVTPLVEYEDVSSQSEQGLLLGGASAATAATAAGGTGGSGGSPASSSGTQRRGEGSERRPRRDRRSSSGRSKERHREHRRRDGQRGGSEASKSRSRHSHSGEERAEVAKSGSSSSSGGRRKSASATSSSSSSRKDRDSKAHRSRTKSSKEPPSAYKEPPKAYREDKTEPKAYRRRRSLSPLGGRDDSPVSHRASQSLRSRKSPSPAGGGSSPYSRRLPRSPSPYSRRRSPSYSRHSSYERGGDVSPSPYSSSSWRRSRSPYSPVLRRSGKSRSRSPYSSRHSRSRSRHRLSRSRSRHSSISPSTLTLKSSLAAELNKNKKARAAEAARAAEAAKAAEATKAAEAAAKAAKASNTSTPTKGNTETSASASQTNHVKDVKKIKIEHAPSPSSGGTLKNDKAKTKPPLQVTKVENNLIVDKATKKAVIVGKESKSAATKEESVSLKEKTKPLTPSIGAKEKEQHVALVTSTLPPLPLPPMLPEDKEADSLRGNISVKAVKKEVEKKLRCLLADLPLPPELPGGDDLSKSPEEKKTATQLHSKRRPKYVLAFYLLLN

SEQ ID NO: 837178 - protein, 1452 aa, Homo sapiens; identical to SEQ ID NO: 837171

SEQ ID NO: 837179 - protein, 1512 aa, Homo sapiens
MPSSSDTALGGGGGLSWAEKRLEERRKRRRFLSPQQPPLLLPLLQPQLLQPPPPPPPLLFLAAPGTAAAAAAAAAASSSCFSPGPPLEVKRLARGKRRAGGRQKRRRGPRAGQEAEKRRVFSLPQPQQDGGGGASSGGGVTPLVEYEDVSSQSEQGLLLGGASAATAATAAGGTGGSGGSPASSSGTQRRGEGSERRPRRDRRSSSGRSKERHREHRRRDGQRGGSEASKSRSRHSHSGEERAEVAKSGSSSSSGGRRKSASATSSSSSSRKDRDSKAHRSRTKSSKEPPSAYKEPPKAYREDKTEPKAYRRRRSLSPLGGRDDSPVSHRASQSLRSRKSPSPAGGGSSPYSRRLPRSPSPYSRRRSPSYSRHSSYERGGDVSPSPYSSSSWRRSRSPYSPVLRRSGKSRSRSPYSSRHSRSRSRHRLSRSRSRHSSISPSTLTLKSSLAAELNKNKKARAAEAARAAEAAKAAEATKAAEAAAKAAKASNTSTPTKGNTETSASASQTNHVKDVKKIKIEHAPSPSSGGTLKNDKAKTKPPLQVTKVENNLIVDKATKKAVIVGKESKSAATKEESVSLKEKTKPLTPSIGAKEKEQHVALVTSTLPPLPLPPMLPEDKEADSLRGNISVKAVKKEVEKKLRCLLADLPLPPELPGGDDLSKSPEEKKTATQLHSKRRPKICGPRYGETKEKDIDWGKRCVDKFDIIGIIGEGTYGQVYKARDKDTGEMVALKKVRLDNEKEGFPITAIREIKILRQLTHQSIINMKEIVTDKEDALDFKKDKGAFYLVFEYMDHDLMGLLESGLVHFNENHIKSFMRQLMEGLDYCHKKNFLHRDIKCSNILLNNRGQIKLADFGLARLYSSEESRPYTNKVITLWYRPPELLLGEERYTPAIDVWSCGCILGELFTKKPIFQANQELAQLELISRICGSPCPAVWPDVIKLPYFNTMKPKKQYRRKLREEFVFIPAAALDLFDYMLALDPSKRCTAEQALQCEFLRDVEPSKMPPPDLPLWQDCHELWSKKRRRQKQMGMTDDVSTIKAPRKDLSLGLDDSRTNTPQGVLPSSQLKSQGSSNVAPVKTGPGQHLNHSELAILLNLLQSKTSVNMADFVQVLNIKVNSETQQQLNKINLPAGILATGEKQTDPSTPQQESSKPLGGIQPSSQTIQPKVETDAAQAAVQSAFAVLLTQLIKAQQSKQKDVLLEERENGSGHEASLQLRPPPEPSTPVSGQDDLIQHQDMRILELTPEPDRPRILPPDQRPPEPPEPPPVTEEDLDYRTENQHVPTTSSSLTDPHAGVKAALLQLLAQHQPQDDPKREGGIDYQAGDTYVSTSDYKDNFGSSSFSSAPYVSNDGLGSSSAPPLERRSFIGNSDIQSLDNYSTASSHSGGPPQPSAFSESFPSSVAGYGDIYLNAGPMLFSGDKDHRFEYSHGPIAVLANSSDPSTGPESTHPLPAKMHNYNYGGNLQENPSGPSLMHGQTWTSPAQGPGYSQGYRGHISTSTGRGRGRGLPY

SEQ ID NO: 837180 - protein, 1434 aa, Homo sapiens
MPSSSDTALGGGGGLSWAEKRLEERRKRRRFLSPQQPPLLLPLLQPQLLQPPPPPPPLLFLAAPGTAAAAAAAAAASSSCFSPGPPLEVKRLARGKRRAGGRQKRRRGPRAGQEAEKRRVFSLPQPQQDGGGGASSGGGVTPLVEYEDVSSQSEQGLLLGGASAATAATAAGGTGGSGGSPASSSGTQRRGEGSERRPRRDRRSSSGRSKERHREHRRRDGQRGGSEASKSRSRHSHSGEERAEVAKSGSSSSSGGRRKSASATSSSSSSRKDRDSKAHRSRTKSSKEPPSAYKEPPKAYREDKTEPKAYRRRRSLSPLGGRDDSPVSHRASQSLRSRKSPSPAGGGSSPYSRRLPRSPSPYSRRRSPSYSRHSSYERGGDVSPSPYSSSSWRRSRSPYSPVLRRSGKSRSRSPYSSRHSRSRSRHRLSRSRSRHSSISPSTLTLKSSLAAELNKNKKARAAEAARAAEAAKAAEATKAAEAAAKAAKASNTSTPTKGNTETSASASQTNHVKDVKKIKIEHAPSPSSGGTLKNDKAKTKPPLQVTKVENNLIVDKATKKAVIVGKESKSAATKEESVSLKEKTKPLTPSIGAKEKEQHVALVTSTLPPLPLPPMLPEDKEADSLRGNISVKAVKKEVEKKLRCLLADLPLPPELPGGDDLSKSPEEKKTATQLHSKRRPKICGPRYGETKEKDIDWGKRCVDKFDIIGIIGEGTYGQVYKARDKDTGEMVALKKVRLDNEKEGFPITAIREIKILRQLTHQSIINMKEIVTDKEDALDFKKDKGAFYLVFEYMDHDLMGLLESGLVHFNENHIKSFMRQLMEGLDYCHKKNFLHRDIKCSNILLNNRGQIKLADFGLARLYSSEESRPYTNKVITLWYRPPELLLGEERYTPAIDVWSCGCILGELFTKKPIFQANQELAQLELISRICGSPCPAVWPDVIKLPYFNTMKPKKQYRRKLREEFVFIPAAALDLFDYMLALDPSKRCTAEQALQCEFLRDVEPSKMPPPDLPLWQDCHELWSKKRRRQKQMGMTDDVSTIKAPRKDLSLGLDDSRTNTPQGVLPSSQLKSQGSSNVAPGEKQTDPSTPQQESSKPLGGIQPSSQTIQPKVETDAAQAAVQSAFAVLLTQLIKAQQSKQKDVLLEERENGSGHEASLQLRPPPEPSTPVSGQDDLIQHQDMRILELTPEPDRPRILPPDQRPPEPPEPPPVTEEDLDYRTENQHVPTTSSSLTDPHAGVKAALLQLLAQHQPQDDPKREGGIDYQAGDTYVSTSDYKDNFGSSSFSSAPYVSNDGLGSSSAPPLERRSFIGNSDIQSLDNYSTASSHSGGPPQPSAFSESFPSSVAGYGDIYLNAGPMLFSGDKDHRFEYSHGPIAVLANSSDPSTGPESTHPLPAKMHNYNYGGNLQERPGYSQGYRGHISTSTGRGRGRGLPY

SEQ ID NO: 837181 - protein, 1452 aa, Homo sapiens; identical to SEQ ID NO: 837171

SEQ ID NO: 837182 - protein, 1452 aa, Homo sapiens; identical to SEQ ID NO: 837171

SEQ ID NO: 837183 - protein, 475 aa, Homo sapiens [sequence omitted]

SEQ ID NO: 837184 - protein, 867 aa, Homo sapiens
MPSSSDTALGGGGGLSWAEKRLEERRKRRRFLSPQQPPLLLPLLQPQLLQPPPPPPPLLFLAAPGTAAAAAAAAAASSSCFSPGPPLEVKRLARGKRRAGGRQKRRRGPRAGQEAEKRRVFSLPQPQQDGGGGASSGGGVTPLVEYEDVSSQSEQGLLLGGASAATAATAAGGTGGSGGSPASSSGTQRRGEGSERRPRRDRRSSSGRSKERHREHRRRDGQRGGSEASKSRSRHSHSGEERAEVAKSGSSSSSGGRRKSASATSSSSSSRKDRDSKAHRSRTKSSKEPPSAYKEPPKAYREDKTEPKAYRRRRSLSPLGGRDDSPVSHRASQSLRSRKSPSPAGGGSSPYSRRLPRSPSPYSRRRSPSYSRHSSYERGGDVSPSPYSSSSWRRSRSPYSPVLRRSGKSRSRSPYSSRHSRSRSRHRLSRSRSRHSSISPSTLTLKSSLAAELNKNKKARAAEAARAAEAAKAAEATKAAEAAAKAAKASNTSTPTKGNTETSASASQTNHVKDVKKIKIEHAPSPSSGGTLKNDKAKTKPPLQVTKVENNLIVDKATKKAVIVGKESKSAATKEESVSLKEKTKPLTPSIGAKEKEQHVALVTSTLPPLPLPPMLPEDKEADSLRGNISVKAVKKEVEKKLRCLLADLPLPPELPGGDDLSKSPEEKKTATQLHSKRRPKICGPRYGETKEKDIDWGKRCVDKFDIIGIIGEGTYGQVYKARDKDTGEMVALKKVRLDNEKEGFPITAIREIKILRQLTHQSIINMKEIVTDKEDALDFKKDKGAFYLVFEYMDHDLMGLLESGLVHFNENHIKSFMRQLMEGLDYCHKKNFLHRDIKCSNILLNNRGQIKLADFGLARLYSSEER

SEQ ID NO: 837185 - protein, 70 aa, Homo sapiens
LPLWQDCHELWSKKRRRQKQMGMTDDVSTIKAPRKDLSLGLDDSRTNTPQGVLPSSQLKSQGSSNVAPGQ

SEQ ID NO: 837186 - protein, 113 aa, Homo sapiens
GENGYTAAESKAHPGGEAGGGHLCCSRRGACLSASLLLLLATVAALIALVTILGLPSCTPGAQACITLTNRTGFLCHDQRSCIPASGVCDGVRTCTHGEDEDESLCREYPLGA

SEQ ID NO: 837187 - protein, 80 aa, Homo sapiens
SLTSNTFKHPLSAKYQSPFELLAERSELTVSEQSVDMSEVHNIRKLFKINQMCLLIEESGRQMGNGWAWVSESVVVLTAT

SEQ ID NO: 837188 - protein, 379 aa, Homo sapiens
ARGRVLVLAAPAPRPAPPGRGAAASFGRAGPGMLHTTQLYQHVPETRWPIVYSPRYNITFMGLEKLHPFDAGKWGKVINFLKEEKLLSDSMLVEAREASEEDLLVVHTRRYLNELKWSFAVATITEIPPVIFLPNFLVQRKVLRPLRTQTGGTIMAGKLAVERGWAINVGGGFHHCSSDRGGGFCAYADITLAIKFLFERVEGISRATIIDLDAHQGNGHERDFMDDKRVYIMDVYNRHIYPGDRFAKQAIRRKVELEWGTEDDEYLDKVERNIKKSLQEHLPDVVVYNAGTDILEGDRLGGLSISPAGIVKRDELVFRMVRGRRVPILMVTSGGYQKRTARIIADSILNLFGLGLIGPESPSVSAQNSDTPLLPPAVP

SEQ ID NO: 837189 - protein, 379 aa, Homo sapiens; identical to SEQ ID NO: 837188

SEQ ID NO: 837190 - protein, 279 aa, Homo sapiens
ARGRVLVLAAPAPRPAPPGRGAAASFGRAGPGMLHTTQLYQHVPETRWPIVYSPRYNITFMGLEKLHPFDAGKWGKVINFLKEEKLLSDSMLVEAREASEEDLLVVHTRRYLNELKGNGHERDFMDDKRVYIMDVYNRHIYPGDRFAKQAIRRKVELEWGTEDDEYLDKVERNIKKSLQEHLPDVVVYNAGTDILEGDRLGGLSISPAGIVKRDELVFRMVRGRRVPILMVTSGGYQKRTARIIADSILNLFGLGLIGPESPSVSAQNSDTPLLPPAVP

SEQ ID NO: 837191 - protein, 728 aa, Homo sapiens
ARGRVLGWPHPRPAPPRPVAELRPALGGPAPGCECRGARAGVGSQGSRWAGALGRGRGRPGGRARLHTTQLYQHVPETRWPIVYSPRYNITFMGLEKLHPFDAGKWGKVINFLKEEKLLSDSMLVEAREASEEDLLVVHTRRYLNELKWSFAVATITEIPPVIFLPNFLVQRKVLRPLRTQTGGTIMAGKLAVERGWAINVGGGFHHCSSDRGGGFCAYADITLAIKFLFERVEGISRATIIDLDAHQVSALQGLDSSGDLPPPVPESSRGRRVSLLMSPRLSRLLSSVSRATNAGSVFVTLSRTAGPPHCSRGSSLPPPDCPHMRLFLKPTLMGLLSCAELCCGSPLLMNNLGHCPLPRAAEHWPPAPQADAHTHGLARAPGVTMLRTRRLGSKVSKQRVTSSSGPLMRPVPLVRQGGDPVGSGRHPPAPLLLWLCASWGPALGSCDPELLSQVTCGQSFTVCFFTSLIPTSPTTDLRGWQSGISSSDREPKSTGLAQAHARRCRGLVLRLNPSSALNSHETCCPREQAVLPWQMGSFLRGGWVAEPQPCLGHLPESGYCDLPKGNGHERDFMDDKRVYIMDVYNRHIYPGDRFAKQAIRRKVELEWGTEDDEYLDKVERNIKKSLQEHLPDVVVYNAGTDILEGDRLGGLSISPAGIVKRDELVFRMVRGRRVPILMVTSGGYQKRTARIIADSILNLFGLGLIGPESPSVSAQNSDTPLLPPAVP

SEQ ID NO: 837192 - protein, 213 aa, Homo sapiens
ARGRVLVLAAPAPRPAPPGRGAAASFGRAGPGMLHTTQLYQHVPETRWPIVYSPRYNITFMGLEKLHPFDAGKWGKVINFLKEAIRRKVELEWGTEDDEYLDKVERNIKKSLQEHLPDVVVYNAGTDILEGDRLGGLSISPAGIVKRDELVFRMVRGRRVPILMVTSGGYQKRTARIIADSILNLFGLGLIGPESPSVSAQNSDTPLLPPAVP

SEQ ID NO: 837193 - protein, 81 aa, Homo sapiens
RISILAWREKKKKRNRQRALGGTVASTGLTKVPGPQSFSMPRGPRWARPLACSSALLMGTFRDLQEVGGGASTPASRQLWP

SEQ ID NO: 837194 - protein, 386 aa, Homo sapiens
ARGRVLGWPHPRPAPPRPVAELRPALGGPAPGCECRGARAGVGSQGSRWAGALGRGRGRPGGRARLHTTQLYQHVPETRWPIVYSPRYNITFMGLEKLHPFDAGKWGKVINFLKEEKLLSDSMLVEAREASEEDLLVVHTRRYLNELKWSFAVATITEIPPVIFLPNFLVQRKVLRPLRTQTGGTIMAGKLAVERGWAINVGGGFHHCSSDRGGGFCAYADITLAIKFLFERVEGISRATIIDLDAHQVSALQGLDSSGDLPPPVPESSRGRRVSLLMSPRLSRLLSSVSRATNAGSVFVTLSRTAGPPHCSRGSSLPPPDCPHMRLFLKPTLMGLLSCAELCCGSPLLMNNLGHCPLPRAAEHWPPAPQADAHTHGLARAPGVTI

SEQ ID NO: 837195 - protein, 81 aa, Homo sapiens
PESPSSSPEQGIVKRDELVFRMVRGRRVPILMVTSGGYQKRTARIIADSILNLFGLGLIGPESPSVSAQNSDTPLLPPAVP

SEQ ID NO: 837196 - protein, 126 aa, Homo sapiens
MPSTLLRLHLKGQVLTTGGRGLEQRTRAWQSRNGTRSTGKFDFAPSLTTEETSARKVPAASDRRVVLIGIIQKFLILSFGRMATLKQILNAFKKKKSCGFLFFFFFFFGRELLISCYFFLSPFVVI

SEQ ID NO: 837197 - protein, 411 aa, Homo sapiens
ARGRVLGWPHPRPAPPRPVAELRPALGGPAPGCECRGARAGVGSQGSRWAGALGRGRGRPGGRARLHTTQLYQHVPETRWPIVYSPRYNITFMGLEKLHPFDAGKWGKVINFLKEEKLLSDSMLVEAREASEEDLLVVHTRRYLNELKWSFAVATITEIPPVIFLPNFLVQRKVLRPLRTQTGGTIMAGKLAVERGWAINVGGGFHHCSSDRGGGFCAYADITLAIKFLFERVEGISRATIIDLDAHQGNGHERDFMDDKRVYIMDVYNRHIYPGDRFAKQAIRRKVELEWGTEDDEYLDKVERNIKKSLQEHLPDVVVYNAGTDILEGDRLGGLSISPAGIVKRDELVFRMVRGRRVPILMVTSGGYQKRTARIIADSILNLFGLGLIGPESPSVSAQNSDTPLLPPAVP

SEQ ID NO: 837198 - protein, 379 aa, Homo sapiens; identical to SEQ ID NO: 837188

SEQ ID NO: 837199 - protein, 407 aa, Homo sapiens
ARGRVLVLAAPAPRPAPPGRGAAASFGRAGPGMLHTTQLYQHVPETRWPIVYSPRYNITFMGLEKLHPFDAGKWGKVINFLKEEKLLSDSMLVEAREASEEDLLVVHTRRYLNELKWSFAVATITEIPPVIFLPNFLVQRKVLRPLRTQTGGTIMAGKLAVERGWAINVGGGFHHCSSDRGGGFCAYADITLAIKFLFERVEGISRATIIDLDAHQGNGHERDFMDDKRVYIMDVYNRHIYPGDRFAKQAIRRKVELEWGTEDDEYLDKVERNIKKSLQEHLPDVVVYNAGTDILEGDRLGGLSISPAGIVKRDELVFRMVRGRRVPILMVTSGGYQKRTARIIADSILNLFGLGLIGPESPSVSAQNSDTPRRVEHPVGWSTPSGGAPRRVEHPVGWSTPSGGAGI

SEQ ID NO: 837200 - protein, 197 aa, Homo sapiens
MPPAGLRRAAPLTAIALLVLGAPLVLAGEDCLWYLDRNGSWHPGFNCEFFTFCCGTCYHRYCCRDLTLLITERQQKHCLAFSPKTIAGIASAVILFVAVVATTICCFLCSCCYLYRRRQQLQSPFEGQEIPMTGIPVQPVYPYPQDPKAGPAPPQPGFMYPPSGPAPQYPLYPAGPPVYNPAAPPPYMPPQPSYPGA

SEQ ID NO: 837201 - protein, 449 aa, Homo sapiens
PGRGRVQDTARLPWPQCPTARSAHGGSDGRNHRGAGDRGSRAVLCWVRGTQLQRLGGRRWWVDSWALRGAAPAGLARAGRLVPPPEEAEEEPEPGRGLGPAAAPAGRLGPAVPSLGGPTPAAPSPHHATRGAPPGRAAHRNRSVGAGGSPGYRGWGEMRQEWDGGGGRGGTDPRGLGSGLLRDPPAATGALGVAGSSRSGKRELQDAGPWEADPGVQGQLQAEASGALGLRPSGWRQGATLSVREPSGWGPPGEWGRARLGMNWPGGHWAPPIPARVLAGEDCLWYLDRNGSWHPGFNCEFFTFCCGTCYHRYCCRDLTLLITERQQKHCLAFSPKTIAGIASAVILFVAVVATTICCFLCSCCYLYRRRQQLQSPFEGQEIPMTGIPVQPVYPYPQDPKAGPAPPQPGFMYPPSGPAPQYPLYPAGPPVYNPAAPPPYMPPQPSYPGA

SEQ ID NO: 837202 - protein, 174 aa, Homo sapiens
MPPAGLRRAAPLTAIALLVLGAPLVLAGEDCLWYLDRNGSWHPGFNCEFFTFCCGTCYHRYCCRDLTLLITERQQKHCLAFSPKTIAGIASAVILFVAVVATTICCFLCSCCYLYRRRQQLQSPFEGQEIPMTGIPVQPVYPYPQDPKAGPAPPQPSPGPYWGQSPREVEQELN

SEQ ID NO: 837203 - protein, 228 aa, Homo sapiens
PGRGRVQDTARLPWPQCPTARSAHGGSDGRNHRGAGDRGSRAVLCWVRGTQLQRLVLAGEDCLWYLDRNGSWHPGFNCEFFTFCCGTCYHRYCCRDLTLLITERQQKHCLAFSPKTIAGIASAVILFVAVVATTICCFLCSCCYLYRRRQQLQSPFEGQEIPMTGIPVQPVYPYPQDPKAGPAPPQPGFMYPPSGPAPQYPLYPAGPPVYNPAAPPPYMPPQPSYPGA

SEQ ID NO: 837204 - protein, 197 aa, Homo sapiens; identical to SEQ ID NO: 837200

SEQ ID NO: 837205 - protein, 189 aa, Homo sapiens
METSAPRAGSQVVATTARHSAAYRADPLRVSSRDKLTEMAASSQGNFEGNFESLDLAEFAKKQPWWRKLFGQESGPSAEKYSVATQLFIGGVTGWCTGFIFQKVGKLAATAVGGGFFLLQLANHTGYIKVDWQRVEKDMKKAKEQLKIRKSNQIPTEVRSKAEEVVSFVKKNVLVTGGFFGGFLLGMAS

SEQ ID NO: 837206 - protein, 189 aa, Homo sapiens; identical to SEQ ID NO: 837205

SEQ ID NO: 837207 - protein, 161 aa, Homo sapiens
LTTTTTKFAAAQTSSQGNFEGNFESLDLAEFAKKQPWWRKLFGQESGPSAEKYSVATQLFIGGVTGWCTGFIFQKVGKLAATAVGGGFFLLQLANHTGYIKVDWQRVEKDMKKAKEQLKIRKSNQIPTEVRSKAEEVVSFVKKNVLVTGGFFGGFLLGMAS

SEQ ID NO: 837208 - protein, 189 aa, Homo sapiens; identical to SEQ ID NO: 837205

SEQ ID NO: 837209 - protein, 189 aa, Homo sapiens; identical to SEQ ID NO: 837205

SEQ ID NO: 837210 - protein, 189 aa, Homo sapiens; identical to SEQ ID NO: 837205

SEQ ID NO: 837211 - protein, 161 aa, Homo sapiens; identical to SEQ ID NO: 837207

SEQ ID NO: 837212 - protein, 120 aa, Homo sapiens
METSAPRAGSQVVATTARHSAAYRADPLRVSSRDKLTLRNLLRSSHGGVSCSGRNLDLQQKSIAWQPSCSLEVSLDGAQVSYSRRLESWLQQLWEVDFFSFSLQTILGTSKLTGNEWRRT

SEQ ID NO: 837213 - protein, 219 aa, Homo sapiens
ASRDRAPRGVQAARGRGGRSGIAPGSAAPRVRPRSRACLGPNHPGVSSPVELTQPSGAAPGAEARRHSVPVLGSGNFEGNFESLDLAEFAKKQPWWRKLFGQESGPSAEKYSVATQLFIGGVTGWCTGFIFQKVGKLAATAVGGGFFLLQLANHTGYIKVDWQRVEKDMKKAKEQLKIRKSNQIPTEVRSKAEEVVSFVKKNVLVTGGFFGGFLLGMAS

SEQ ID NO: 837214 - protein, 173 aa, Homo sapiens
METSAPRAGSQVVATTARHSAAYRADPLRVSSRDKLTEMAASSQGNFEGNFESLDLAEFAKKQPWWRKLFGQESGPSAECTGFIFQKVGKLAATAVGGGFFLLQLANHTGYIKVDWQRVEKDMKKAKEQLKIRKSNQIPTEVRSKAEEVVSFVKKNVLVTGGFFGGFLLGMAS

SEQ ID NO: 837215 - protein, 751 aa, Homo sapiens
MPALGWAVAAILMLQTAMAEPSPGTLPRKAGVFSDLSNQELKAVHSFLWSKKELRLQPSSTTTMAKNTVFLIEMLLPKKYHVLRFLDKGERHPVREARAVIFFGDQEHPNVTEFAVGPLPGPCYMRALSPRPGYQSSWASRPISTAEYALLYHTLQEATKPLHQFFLNTTGFSFQDCHDRCLAFTDVAPRGVASGQRRSWLIIQRYVEGYFLHPTGLELLVDHGSTDAGHWAVEQVWYNGKFYGSPEELARKYADGEVDVVVLEDPLPGGKGHDSTEEPPLFSSHKPRGDFPSPIHVSGPRLVQPHGPRFRLEGNAVLYGGWSFAFRLRSSSGLQVLNVHFGGERIAYEVSVQEAVALYGGHTPAGMQTKYLDVGWGLGSVTHELAPGIDCPETATFLDTFHYYDADDPVHYPRALCLFEMPTGVPLRRHFNSNFKGGFNFYAGLKGQVLVLRTTSTVYNYDYIWDFIFYPNGVMEAKMHATGYVHATFYTPEGLRHGTRLHTHLIGNIHTHLVHYRVDLDVAGTKNSFQTLQMKLENITNPWSPRHRVVQPTLEQTQYSWERQAAFRFKRKLPKYLLFTSPQENPWGHKRSYRLQIHSMADQVLPPGWQEEQAITWARYPLAVTKYRESELCSSSIYHQNDPWHPPVVFEQFLHNNENIENEDLVAWVTVGFLHIPHSEDIPNTATPGNSVGFLLRPFNFFPEDPSLASRDTVIVWPRDNGPNYVQRWIPEDRDCSMPPPFSYNGTYRPV

SEQ ID NO: 837216 - protein, 277 aa, Homo sapiens
MEAKMHATGYVHATFYTPEGLRHGTRLHTHLIGNIHTHLVHYRVDLDVAGTKNSFQTLQMKLENITNPWSPRHRVVQPTLEQTQYSWERQAAFRFKRKLPKYLLFTSPQENPWGHKRSYRLQIHSMADQVLPPGWQEEQAITWARYPLAVTKYRESELCSSSIYHQNDPWHPPVVFEQFLHNNENIENEDLVAWVTVGFLHIPHSEDIPNTATPGNSVGFLLRPFNFFPEDPSLASRDTVIVWPRDNGPNYVQRWIPEDRDCSMPPPFSYNGTYRPV

SEQ ID NO: 837217 - protein, 770 aa, Homo sapiens [sequence omitted]

SEQ ID NO: 837218 - protein, 751 aa, Homo sapiens; identical to SEQ ID NO: 837215

SEQ ID NO: 837219 - protein, 412 aa, Homo sapiens
MPGLHRCGPPGCGFWPAPLYGGHTPAGMQTKYLDVGWGLGSVTHELAPGIDCPETATFLDTFHYYDADDPVHYPRALCLFEMPTGVPLRRHFNSNFKGGFNFYAGLKGQVLVLRTTSTVYNYDYIWDFIFYPNGVMEAKMHATGYVHATFYTPEGLRHGTRLHTHLIGNIHTHLVHYRVDLDVAGTKNSFQTLQMKLENITNPWSPRHRVVQPTLEQTQYSWERQAAFRFKRKLPKYLLFTSPQENPWGHKRSYRLQIHSMADQVLPPGWQEEQAITWARYPLAVTKYRESELCSSSIYHQNDPWHPPVVFEQFLHNNENIENEDLVAWVTVGFLHIPHSEDIPNTATPGNSVGFLLRPFNFFPEDPSLASRDTVIVWPRDNGPNYVQRWIPEDRDCSMPPPFSYNGTYRPV

SEQ ID NO: 837220 - protein, 797 aa, Homo sapiens
MPALGWAVAAILMLQTAMAEPSPGTLPRKAGVFSDLSNQELKAVHSFLWSKKELRLQPSSTTTMAKNTVFLIEMLLPKKYHVLRFLDKGERHPVREARAVIFFGDQEHPNVTEFAVGPLPGPCYMRALSPRPGYQSSWASRPISTAEYALLYHTLQEATKPLHQFFLNTTGFSFQDCHDRCLAFTDVAPRGVASGQRRSWLIIQRYVEGYFLHPTGLELLVDHGSTDAGHWAVEQVWYNGKFYGSPEELARKYADGEVDVVVLEDPLPGGKGHDSTEEPPLFSSHKPRGDFPSPIHVSGPRLVQPHGPRFRLEGNAVLYGGWSFAFRLRSSSGLQVLNVHFGGERIAYEVSVQEAVALYGGHTPAGMQTKYLDVGWGLGSVTHELAPGIDCPETATFLDTFHYYDADDPVHYPRALCLFEMPTGVPLRRHFNSNFKGGFNFYAGLKGQVLVLRTTSTVYNYDYIWDFIFYPNGVMEAKMHATGYVHATFYTPEGLRHGTRLHTHLIGNIHTHLVHYRVDLDVAGTKNSFQTLQMKLENITNPWSPRHRVVQPTLEQTQYSWERQAAFRFKRKLPKYLLFTSPQENPWGHKRSYRLQIHSMADQVLPPGWQEEQAITWASGLRKRRRRGWSCCLTVAEAEETPNESGLVCWAQELTPVIPALWEAKYPLAVTKYRESELCSSSIYHQNDPWHPPVVFEQFLHNNENIENEDLVAWVTVGFLHIPHSEDIPNTATPGNSVGFLLRPFNFFPEDPSLASRDTVIVWPRDNGPNYVQRWIPEDRDCSMPPPFSYNGTYRPV

SEQ ID NO: 837221 - protein, 695 aa, Homo sapiens
MPALGWAVAAILMLQTAMAEPSPGTLPRKAGVFSDLSNQELKAVHSFLWSKKELRLQPSSTTTMAKNTVFLIEMLLPKKYHVLRFLDKGERHPVREARAVIFFGDQEHPNVTEFAVGPLPGPCYMRALSPRPGYQSSWASRPISTAEYALLYHTLQEATKPLHQFFLNTTGFSFQDCHDRCLAFTDVAPRGVASGQRRSWLIIQRYVEGYFLHPTGLELLVDHGSTDAGHWAVEQVWYNGKFYGSPEELARKYADGEVDVVVLEDPLPGGKGHDSTEEPPLFSSHKPRGDFPSPIHVSGPRLVQPHGPRFRLEGNAVLYGGWSFAFRLRSSSGLQVLNVHFGGERIAYEVSVQEAVALYGGHTPAGMQTKYLDVGWGLGSVTHELAPGIDCPETATFLDTFHYYDADDPVHYPRALCLFEMPTGVPLRRHFNSNFKGGFNFYAGLKGQVLVLRTTSTVYNYDYIWDFIFYPNGVMEAKMHATGYVHATFYTPEGLRHGTRLHTHLIGNIHTHLVHYRVDLDVAGTKNSFQTLQMKLENITNPWSPRHRVVQPTLEQTQYSWERQAAFRFKRKLPKYLLFTSPQENPWGHKRSYRLQIHSMADQVLPPGWQEEQAITWARYPLAVTKYRESELCSSSIYHQNDPWHPPVVFEQFLHNNENIENEDLVAWVTVGFLHIPHSEDIPNTATPQSLALCA

SEQ ID NO: 837222 - protein, 619 aa, Homo sapiens [sequence omitted]

SEQ ID NO: 837223 - protein, 151 aa, Homo sapiens
YLVTARGYLAQVMACSSCQPGGSTWSAMESELCSSSIYHQNDPWHPPVVFEQFLHNNENIENEDLVAWVTVGFLHIPHSEDIPNTATPGNSVGFLLRPFNFFPEDPSLASRDTVIVWPRDNGPNYVQRWIPEDRDCSMPPPFSYNGTYRPV

SEQ ID NO: 837224 - protein, 108 aa, Homo sapiens
MPALGWAVAAILMLQTAMAEPSPGTLPRKAGVFSDLSNQRHCDRVASGQRPQLRPALDPCPQGSSGKTPKTSRTKEAKSKKKGRAQEHSRTETKTTTRETKARKTTEE

SEQ ID NO: 837225 - protein, 751 aa, Homo sapiens; identical to SEQ ID NO: 837215

SEQ ID NO: 837226 - protein, 751 aa, Homo sapiens; identical to SEQ ID NO: 837215

SEQ ID NO: 837227 - protein, 751 aa, Homo sapiens; identical to SEQ ID NO: 837215

SEQ ID NO: 837228 - protein, 515 aa, Homo sapiens
MPALGWAVAAILMLQTAMAEPSPGTLPRKAGVFSDLSNQELKAVHSFLWSKKELRLQPSSTTTMAKNTVFLIEMLLPKKYHVLRFLDKGERHPVREARAVIFFGDQEHPNVTEFAVGPLPGPCYMRALSPRPGYQSSWASRPISTAEYALLYHTLQEATKPLHQFFLNTTGFSFQDCHDRCLAFTDVAPRGVASGQRRSWLIIQRYVEGYFLHPTGLELLVDHGSTDAGHWAVEQVWYNGKFYGSPEELARKYADGEVDVVVLEDPLPGGKGHDSTEEPPLFSSHKPRGDFPSPIHVSGPRLVQPHGPRFRLEGNAVLYGGWSFAFRLRSSSGLQVLNVHFGGERIAYEVSVQEAVALYGGHTPAGMQTKYLDVGWGLGSVTHELAPGIDCPETATFLDTFHYYDADDPVHYPRALCLFEMPTGVPLRRHFNSNFKGGFNFYAGLKGQVLVLRTTSTVYNYDYIWDFIFYPNGVMEAKMHATGYVHATFYTPEGLRHGTRLHTHLIGNIHTHLVH

SEQ ID NO: 837229 - protein, 727 aa, Homo sapiens [sequence omitted]

SEQ ID NO: 837230 - protein, 621 aa, Homo sapiens
MPALGWAVAAILMLQTAMAEPSPGTLPRKAGVFSDLSNQELKAVHSFLWSKKELRLQPSSTTTMAKNTVFLIEMLLPKKYHVLRFLDKGERHPVREARAVIFFGDQEHPNVTEFAVGPLPGPCYMRALSPRPGYQSSWASRPISTAEYALLYHTLQEATKPLHQFFLNTTGFSFQDCHDRCLAFTDVAPRGVASGQRRSWLIIQRYVEGYFLHPTGLELLVDHGSTDAGHWAVEQVWYNGKFYGSPEELARKYADGEVDVVVLEDPLPGGKGHDSTEEPPLFSSHKPRGDFPSPIHVSGPRLVQPHGPRFRLEGNAVLYGGWSFAFRLRSSSGLQVLNVHFGGERIAYEVSVQEAVALYGGHTPAGMQTKYLDVGWGLGSVTHELAPGIDCPETATFLDTFHYYDADDPVHYPRALCLFEMPTGVPLRRHFNSNFKGGFNFYAGLKGQVLVLRTTSTVYNYDYIWDFIFYPNGVMEAKMHATGYVHATFYTPEGLRHGTRLHTHLIGNIHTHLVHYRVDLDVAGTKNSFQTLQMKLENITNPWSPRHRVVQPTLEQTQYSWERQAAFRFKRKLPKYLLFTSPQENPWGHKRSYRLQIHSMPQRRVAQLKNVKEDTGHHKEQ

SEQ ID NO: 837231 - protein, 139 aa, Homo sapiens
MPALGWAVAAILMLQTAMAEPSPGTLPRKAGVFSDLSNQELKAVHSFLWSKKELRLQPSSTTTMAKNTVFLIEMLLPKKYHVLRFLDKGERHPVREARAVIFFFSAGLSFCFFGVGLWDCRLSEFGGLEIRLGGIDVMG

SEQ ID NO: 837232 - protein, 273 aa, Homo sapiens
MRAAGVGLVDCHCHLSAPDFDRDLDDVLEKAKKANVVALVAVAEHSGEFEKIMQLSERYNGFVLPCLGVHPVQGLPPEDQRSVTLKDLDVALPIIENYKDRLLAIGEVGLDFSPRFAGTGEQKEEQRQVLIRQIQLAKRLNLPVNVHSRSAGRPTINLLQEQGAEKVLLHAFDGRPSVAMEGVRAGYFFSIPPSIIRSGQQKLVKQLPLTSICLETDSPALGPEKQVRNEPWNISISAEYIAQVKGISVEEVIEVTTQNALKLFPKLRHLLQK

SEQ ID NO: 837233 - protein, 281 aa, Homo sapiens
MRAAGVGLVDCHCHLSAPDFDRDLDDVLEKAKKANVVALVAVAEHSGEFEKIMQLSERYNGFVLPCLGVHPVQGLPPEDQRSVTLKDLDVALPIIENYKDRLLAIGEVGLDFSPRFAGTGEQKEEQRQVLIRQIQLAKRLNLPVNVHSRSAGRPTINLLQEQGAEKVLLHAFDGRPSVAMEGVRAGYFFSIPPSIIRSGQLLSLFSKKQKLVKQLPLTSICLETDSPALGPEKQVRNEPWNISISAEYIAQVKGISVEEVIEVTTQNALKLFPKLRHLLQK

SEQ ID NO: 837234 - protein, 191 aa, Homo sapiens
MRAAGVGLVDCHCHLSAPDFDRDLDDVLEKAKKANVVALVAVAEHSGEFEKIMQLSERYNGFVLPCLGVHPVQGLPPEDQRSVTLKDLDVALPIIENYKDRLLAIGEVGLDFSPRFAGTGEQKEEQRQVLIRQIQLAKRLNLPVNVHSRSAGRPTINLLQEQAETCETIAFNFYMLRNRFTCTRTRKTGTE

SEQ ID NO: 837235 - protein, 270 aa, Homo sapiens
SSQELTLKAEKTRSHPSKGDLDDVLEKAKKANVVALVAVAEHSGEFEKIMQLSERYNGFVLPCLGVHPVQGLPPEDQRSVTLKDLDVALPIIENYKDRLLAIGEVGLDFSPRFAGTGEQKEEQRQVLIRQIQLAKRLNLPVNVHSRSAGRPTINLLQEQGAEKVLLHAFDGRPSVAMEGVRAGYFFSIPPSIIRSGQQKLVKQLPLTSICLETDSPALGPEKQVRNEPWNISISAEYIAQVKGISVEEVIEVTTQNALKLFPKLRHLLQK

SEQ ID NO: 837236 - protein, 822 aa, Homo sapiens
MGFGSDLKNSHEAVLKLQDWELRLLETVKKFMALRIKSDKEYASTLQNLCNQVDKESTVQMNYVSNVSKSWLLMIQQTEQLSRIMKTHAEDLNSGPLHRLTMMIKDKQQVKKSYIGVHQQIEAEMIKVTKTELEKLKCSYRQLIKEMNSAKEKYKEALAKGKETEKAKERYDKATMKLHMLHNQYVLALKGAQLHQNQYYDITLPLLLDSLQKMQEEMIKALKGIFDEYSQITSLVTEEIVNVHKEIQMSVEQIDPSTEYNNFIDVHRTTAAKEQEIEFDTSLLEENENLQANEIMWNNLTAESLQVMLKTLAEELMQTQQMLLNKEEAVLELEKRIEESSETCEKKSDIVLLLSQKQALEELKQSVQQLRCTEAKFSAQKELLEQKVQENDGKEPPPVVNYEEDARSVTSMERKERLSKFESIRHSIAGIIRSPKSAVGSSALSDMISISEKPLAEQDWYHGAIPRIEAQELLKKQGDFLVRESHGKPGEYVLSVYSDGQRRHFIIQYVDNMYRFEGTGFSNIPQLIDHHYTTKQVITKKSGVVLLNPIPKDKKWILSHEDVILGELLGKGNFGEVYKGTLKDKTSVAVKTCKEDLPQELKIKFLQEAKILKQYDHPNIVKLIGVCTQRQPVYIIMELVSGGDFLTFLRRKKDELKLKQLVKFSLDAAAGMLYLESKNCIHRDLAARNCLVGENNVLKISDFGMSRQEDGGVYSSSGLKQIPIKWTAPEALNYGRYSSESDVWSFGILLWETFSLGVCPYPGMTNQQAREQVERGYRMSAPQHCPEDISKIMMKCWDYKPENRPKFSELQKELTIIKRKLT

SEQ ID NO: 837237 - protein, 822 aa, Homo sapiens; identical to SEQ ID NO: 837236

SEQ ID NO: 837238 - protein, 132 aa, Homo sapiens [sequence omitted]

SEQ ID NO: 837239 - protein, 332 aa, Homo sapiens
MRAPARGTGCCGRSGGRWLAGAAQPRCLWAGGAGQRFMVPGGTMKSLKKDSRLRITPTRLLEASENVKEKKRAKGPEQPTPTIQEEPEPVSNVLQGDDILALAIKKEDLKEQHIPRLTEKEDKRVITQKFIIRKLKPMDPRRKVCHLVARPANPDEATKPLDYSGTPSLSPGFTVFQLMGPGDSFDGSDQILPHHILGSLQDFKRIALARGNTQLAERIPTSPCLMTLISAEGESKQKAPKEEKRPPWAPPPQHNFLKNWQRNTALRKKQQEALSEHLKKAGSGHCSMAKPGRTYRTRPRTDRGHPIALPHIKPGERKQRGETSGVRGARRR

SEQ ID NO: 837240 - protein, 1019 aa, Homo sapiens
MRAPARGTGCCGRSGGRWLAGAAQPRCLWAGGAGQRFMVPGGTMKSLKKDSRLRITPTRLLEASENVKEPRLVLNSWAQAICLPWPPKILQLLIHSLACHCPWEKKRAKGPEQPTPTIQEEPEPVSNVLQGDDILALAIKKEDLKEQHIPRLTEKEDKRVITQKFIIRKLKPMDPRRKVCHLVARPANPDEATKPLDYSGPGDSFDGSDQILPHHILGSLQDFKRIALARGNTQLAERIPTSPCLMTLISAEGESKQKAPKEEKRPPWAPPPQHNFLKNWQRNTALRKKQQEALSEHLKKPVSELLMHTGETYRRIQEERELIDCTLPTRRDRKSWENSGFWSRLEYLGDEMTGLVMTKTKTQRGLMEPITHIRKPHSIRVETGLPAQRDASYRYTWDRSLFLIYRRKELQRIMEELDFSQQDIDGLEVVGKGWPFSAVTVEDYTVFERSQGSSSEDTAYLGTLASSSDVSMPILGPSLLFCGKPACWIRGSNPQDKRQVGIAAHLTFETLEGEKTSSELTVVNNGTVAIWYDWRRQHQPDTFQDLKKNRMQRFYFDNREGVILPGEIKTFTFFFKSLTAGVFREFWEFRTHPTLLGGAILQVNLHAVSLTQDVFEDERKVLESKLTAHEAVTVVREVLQELLMGVLTPERTPSPVDAYLTEEDLFRHRNPPLHYEHQVVQSLHQLWRQYMTLPAKAEEARPGDKEHVSPIATEKASVNAELLPRFRSPISETQVPRPENEALRESGSQKARVGTKSPQRKSIMEEILVEESPDVDSTKSPWEPDGLPLLEWNLCLEDFRKAVMVLPDENHREDALMRLNKAALELCQKPRPLQSNLLHQMCLQLWRDVIDSLVGHSMWLRSVLGLPEKETIYLNVPEEQDQKSPPIMEVKVPVGKAGKEERKGAAQEKKQLGIKDKEDKKGAKLLGKEDRPNSKKHKAKDDKKVIKSASQDRFSLEDPTPDIILSSQEPIDPLVMGKYTQRLHSEVRGLLDTLVTDLMVLADELSPIKNVEEALRLCR

SEQ ID NO: 837241 - protein, 672 aa, Homo sapiens
MRAPARGTGCCGRSGGRWLAGAAQPRCLWAGGAGQRFMVPGGTMKSLKKDSRLRITPTRLLEASENVKEKKRAKGPEQPTPTIQEEPEPVSNVLQGDDILALAIKKEDLKEQHIPRLTEKEDKRVITQKFIIRKLKPMDPRRKVCHLVARPANPDEATKPLDYSGPGDSFDGSDQILPHHILGSLQDFKRIALARGNTQLAERIPTSPCLMTLISAEGESKQKAPKEEKRPPWAPPPQHNFLKNWQRNTALRKKQQEALSEHLKKPVSELLMHTGETYRRIQEERELIDCTLPTRRDRKSWENSGFWSRLEYLGDEMTGLVMTKTKTQRGLMEPITHIRKPHSIRVETGLPAQRDASYRYTWDRSLFLIYRRKELQRIMEELDFSQQDIDGLEVVGKGWPFSAVTVEDYTVFERSQGSSSEDTAYLGTLASSSDVSMPILGPSLLFCGKPACWIRGSNPQDKRQVGIAAHLTFETLEGEKTSSELTVVNNGTVAIWYDWRRQHQPDTFQDLKKNRMQRFYFDNREGVILPGEIKTFTFFFKSLTAGVFREFWEFRTHPTLLGGAILQVNLHAVSLTQDVFEDERKVLESKLTAHEAVTVVREVLQELLMGVLTPERTPSPVDAYLTEEDLFRHRNPPVRPSASPCPLMCALRQGSPTRRPHSGRSVGCWTPW

SEQ ID NO: 837242 - protein, 872 aa, Homo sapiens
MRAPARGTGCCGRSGGRWLAGAAQPRCLWAGGAGQRFMVPGGTMKSLKKDSRLRITPTRLLEASENVKEKKRAKGPEQPTPTIQEEPEPVSNVLQGDDILALAIKKEDLKEQHIPRLTEKEDKRVITQKFIIRKLKPMDPRRKVCHLVARPANPDEATKPLDYSGPGDSFDGSDQILPHHILGSLQDFKRIALARGNTQLAERIPTSPCLMTLISAEGESKQKAPKEEKRPPWAPPPQHNFLKNWQRNTALRKKQQEALSEHLKKPVSELLMHTGETYRRIQEERELIDCTLPTRRDRKSWENSGFWSRLEYLGDEMTGLVMTKTKTQRGLMEPITHIRKPHSIRVETGLPAQRDASYRYTWDRSLFLIYRRKELQRIMEELDFSQQDIDGLEVVGKGWPFSAVTVEDYTVFERSQGSSSEDTAYLGTLASSSDVSMPILGPSLLFCGKPACWIRGSNPQDKRQVGIAAHLTFETLEGEKTSSELTVVNNGTVAIWYDWRRQHQPDTFQDLKKNRMQRFYFDNREGVILPGEIKTFTFFFKSLTAGVFREFWEFRTHPTLLGGAILQVNLHAVSLTQDVFEDERKVLESKLTAHEAVTVVREVLQELLMGVLTPERTPSPVDAYLTEEDLFRHRNPPLHYEHQVVQSLHQLWRQYMTLPAKAEEARPGDKEHVSPIATEKASVNAELLPRFRSPISETQVPRPENEALRESGSQKARVGTKSPQRKSIMEEILVEESPDVDSTKSPWEPDGLPLLEWNLCLEDFRKAVMVLPDENHREDALMRLNKAALELCQKPRPLQSNLLHQMCLQLWRDVIDSLVGHSMWLRSVLGLPEKETIYLNVPEEQDQKSPPIMEVKVPARAAKGVVRRAVPS

SEQ ID NO: 837243 - protein, 984 aa, Homo sapiens
MRAPARGTGCCGRSGGRWLAGAAQPRCLWAGGAGQRFMVPGGTMKSLKKDSRLRITPTRLLEASENVKEKKRAKGPEQPTPTIQEEPEPVSNVLQGDDILALAIKKEDLKEQHIPRLTEKEDKRVITQKFIIRKLKPMDPRRKVCHLVARPANPDEATKPLDYSGPGDSFDGSDQILPHHILGSLQDFKRIALARGNTQLAERIPTSPCLMTLISAEGESKQKAPKEEKRPPWAPPPQHNFLKNWQRNTALRKKQQEALSEHLKKPVSELLMHTGETYRRIQEERELIDCTLPTRRDRKSWENSGFWSRLEYLGDEMTGLVMTKTKTQRGLMEPITHIRKPHSIRVETGLPAQRDASYRYTWDRSLFLIYRRKELQRIMEELDFSQQDIDGLEVVGKGWPFSAVTVEDYTVFERSQGSSSEDTAYLGTLASSSDVSMPILGPSLLFCGKPACWIRGSNPQDKRQVGIAAHLTFETLEGEKTSSELTVVNNGTVAIWYDWRRQHQPDTFQDLKKNRMQRFYFDNREGVILPGEIKTFTFFFKSLTAGVFREFWEFRTHPTLLGGAILQVNLHAVSLTQDVFEDERKVLESKLTAHEAVTVVREVLQELLMGVLTPERTPSPVDAYLTEEDLFRHRNPPLHYEHQVVQSLHQLWRQYMTLPAKAEEARPGDKEHVSPIATEKASVNAELLPRFRSPISETQVPRPENEALRESGSQKARVGTKSPQRKSIMEEILVEESPDVDSTKSPWEPDGLPLLEWNLCLEDFRKAVMVLPDENHREDALMRLNKAALELCQKPRPLQSNLLHQMCLQLWRDVIDSLVGHSMWLRSVLGLPEKETIYLNVPEEQDQKSPPIMEVKVPVGKAGKEERKGAAQEKKQLGIKDKEDKKGAKLLGKEDRPNSKKHKAKDDKKVIKSASQDRFSLEDPTPDIILSSQEPIDPLVMGKYTQRLHSEVRGLLDTLVTDLMVLADELSPIKNVEEALRLCR

SEQ ID NO: 837244 - protein, 74 aa, Homo sapiens
LQLWRDVIDSLVGHSMWLRSVLGLPEKETIYLNVPEEQGQILCNQPHLCIALLISLNGQAAVPGPVILLWWKLC

SEQ ID NO: 837245 - protein, 521 aa, Homo sapiens
MSEPKAIDPKLSTTDRVVKAVPFPPSHRLTAKEVFDNDGKPRVDILKAHLMKEGRLEESVALRIITEGASILRQEKNLLDIDAPVTVCGDIHGQFFDLMKLFEVGGSPANTRYLFLGDYVDRGYFSIECVLYLWALKILYPKTLFLLRGNHECRHLTEYFTFKQECKIKYSERVYDACMDAFDCLPLAALMNQQFLCVHGGLSPEINTLDDIRKLDRFKEPPAYGPMCDILWSDPLEDFGNEKTQEHFTHNTVRGCSYFYSYPAVCEFLQHNNLLSILRAHEAQDAGYRMYRKSQTTGFPSLITIFSAPNYLDVYNNKAAVLKYENNVMNIRQFNCSPHPYWLPNFMDVFTWSLPFVGEKVTEMLVNVLNICSDDELGSEEDGFDGATAAARKEVIRNKIRAIGKMARVFSVLREESESVLTLKGLTPTGMLPSGVLSGGKQTLQSATVEAIEADEAIKGFSPQHKITSFEEAKGLDRINERMPPRRDAMPSDANLNSINKALTSETNGTDSNGSNSSNIQ

SEQ ID NO: 837246 - protein, 511 aa, Homo sapiens
MSEPKAIDPKLSTTDRVVKAVPFPPSHRLTAKEVFDNDGKPRVDILKAHLMKEGRLEESVALRIITEGASILRQEKNLLDIDAPVTVCGDIHGQFFDLMKLFEVGGSPANTRYLFLGDYVDRGYFSIECVLYLWALKILYPKTLFLLRGNHECRHLTEYFTFKQECKIKYSERVYDACMDAFDCLPLAALMNQQFLCVHGGLSPEINTLDDIRKLDRFKEPPAYGPMCDILWSDPLEDFGNEKTQEHFTHNTVRGCSYFYSYPAVCEFLQHNNLLSILRAHEAQDAGYRMYRKSQTTGFPSLITIFSAPNYLDVYNNKAAVLKYENNVMNIRQFNCSPHPYWLPNFMDVFTWSLPFVGEKVTEMLVNVLNICSDDELGSEEDGFDGATAAARKEVIRNKIRAIGKMARVFSVLREESESVLTLKGLTPTGMLPSGVLSGGKQTLQSAIKGFSPQHKITSFEEAKGLDRINERMPPRRDAMPSDANLNSINKALTSETNGTDSNGSNSSNIQ

SEQ ID NO: 837247 - protein, 521 aa, Homo sapiens; identical to SEQ ID NO: 837245

SEQ ID NO: 837248 - protein, 480 aa, Homo sapiens
MSEPKAIDPKLSTTDRVVKAVPFPPSHRLTAKEVFDNDGKPRVDILKAHLMKEGRLEESVALRIITEGASILRQEKNLLDIDAPVTVCGDIHGQFFDLMKLFEVGGSPANTRYLFLGDYVDRGYFSIECVLYLWALKILYPKTLFLLRGNHECRHLTEYFTFKQECKIKYSERVYDACMDAFDCLPLAALMNQQFLCVHGGLSPEINTLDDIRKLDRFKEPPAYGPMCDILWSDPLEDFGNEKTQEHFTHNTVRGCSYFYSYPAVCEFLQHNNLLSILRAHEAQDAGYRMYRKSQTTGFPSLITIFSAPNYLDVYNNKAAVLKYENNVMNIRQFNCSPHPYWLPNFMDVFTWSLPFVGEKVTEMLVNVLNICSDDELGSEEDGFDGATAAARKEVIRNKIRAIGKMARVFSVLREESESVLTLKGLTPTGMMGIAAYQQLDVLASDSSLFALGARNWIQFTLSLKKRERDNKLYFGGDGD

SEQ ID NO: 837249 - protein, 521 aa, Homo sapiens; identical to SEQ ID NO: 837245

SEQ ID NO: 837250 - protein, 521 aa, Homo sapiens; identical to SEQ ID NO: 837245

SEQ ID NO: 837251 - protein, 521 aa, Homo sapiens; identical to SEQ ID NO: 837245

SEQ ID NO: 837252 - protein, 511 aa, Homo sapiens; identical to SEQ ID NO: 837246

SEQ ID NO: 837253 - protein, 722 aa, Homo sapiens
MKTLDIVNVTSDPNRCKANNFEGEEGNTCLENPALSPSLLRSYTLILYNYFCCTSQSFLDNGTTYKKKVIHLPQTRISKPNTTLCSSFTEFGTKRLKHALCLRKNNVMCEWNQSPIDGKGVRMMKGDDAFNWIKRTVLSITNLITDGSTILNFKIFLLISFVVLKINNFFFFEDGVLLVAQAGMQWRDLSSLQPPPPGFKRFSCLSLPSSWDYRRVPPRPANFVFLVEMGFHHVGQVGLELLTSSDPPASASQSAGITGVSHCGRPKKNSFYSYQTTLTSAMFKHTWTIDSVFFNSLKYIILKLQTHLFKPKFHHRHINWVSISYFGGQFQSVYYDNHLFRCNIVEDIGNFRFYTFLLGLWNEKLIGYHFQNEIGNYGYPSYRAAVNDDLNVCYITDFLFSSEAVVNVHFAMIEKLRFVNITIGTINFLKHEISMNKYKFEMIIHENPKSKYFQTIEGYTTVFLKSLFPPLKKHATNCFFSKLKLCTVVKLKICRKNCLVFLHNKNFYYSGVGDQSGQYSETLSLLKYKKKKKKKKISQAWWCAPVIPATWEAEAGELLVTWEAEVAVSRDRAIALQSGGQSKTHSQKKKKKEFLLLFPEEWFLLTCYCIIKKDLLMVQYNNLELIYVAFYSYLNAFLCHIDHMASSPTFLLIFNKPCCSTIRETFRFWMILPVEVETSSDNRKGKYKGPNIFIVEFTSKITYPYRLSSLCSTSINSDFINH

SEQ ID NO: 837254 - protein, 323 aa, Homo sapiens
MEPRVRVEGWKVPTSRCRFLLARVLGYLVVMEAVLTEELDEEEQLLRRHRKEKKELQAKIQGMKNAVPKNDKKRRKQLTEDVAKLEKEMEQKHREELEQLKLTTKENKIDSVAVNISNLVLENQPPRISKAQKRREKKAALEKEREERIAEAEIENLTGARHMESEKLAQILAARQLEIKQIPSDGHCMYKAIEDQLKEKDCALTVVALRSQTAEYMQSHVEDFLPFLTNPNTGDMYTPEEFQKYCEDIVNTAAWGGQLELRALSHILQTPIEIIQADSPPIIVGEEYSKKPLILVYMRHAYGLGEHYNSVTRLVNIVTENCS

SEQ ID NO: 837255 - protein, 323 aa, Homo sapiens; identical to SEQ ID NO: 837254

SEQ ID NO: 837256 - protein, 148 aa, Homo sapiens
GFQGLLIRVEEKVKFCCNDSLNSPPLQKESRAVSLLTSPAAGIKTVDPLPLREDSEDNIHKFAEATLPVSKIPKYPTNPPGQLPSPPHVPSYWHPSRRIQGSLRDPEFQHNDEDRLSEISARSAASSLRAFQTLARAKKRKENFWGKT

SEQ ID NO: 837257 - protein, 434 aa, Homo sapiens [sequence omitted]

SEQ ID NO: 837258 - protein, 434 aa, Homo sapiens [sequence omitted]

SEQ ID NO: 837259 - protein, 168 aa, Homo sapiens
GFQGLLIRVEEKVKFCCNDSLNSPPLQKESRAVSLLTSPAAGIKTVDPLPLREDSEDNIHKFAEATLPVSKIPKYPTNPPGQLPSPPHVPSYWHPSRRIQGSLRDPEFQHNVGKARMNNLQLPQHEAFNDEDEDRLSEISARSAASSLRAFQTLARAKKRKENFWGKT

SEQ ID NO: 837260 - protein, 714 aa, Homo sapiens
MPVRFKGLSEYQRNFLWKKSYLSESCNSSVGRKYPWAGLRSDQLGITKEPSFISKRRVPYHDPQISKSLEWNGAISESNVVASPEPEAPETPKSQEAEQKDVIQERVHSLEASRVPKRTRSHSADSRAEGASDVENNEGVTNHTPVNENVELEHSTKVLSENVDNGLDRLLRKKAGLTVVPSYNALRNSEYQRQFVWKTSKETAPAFAANQVFHNKSQFVPPFKGNSVIHETEYKRNFKGLSPVKEPKLRNDLRENRNLETVSPERKSNKIDDRLKLEAEMELKDLHQPKRKLTPWKHQRLGKVNSEYRAKFLSPAQYLYKAGAWTHVKGNMPNQVKELREKAEFYRKRVQGTHFSRDHLNQILSDSNCCWDVSSTTSSEGTVSSNIRALDLAGDPTSHKTLQKCPSTEPEEKGNIVEEQPQKNTTEKLGVSAPTIPVRRRLAWDTENTSEDVQKQPGEKEEEDDNEEEGDRKTGKQAFMGEQEKLDVHEKSKADKMKEGSDSSVSSEKGGRLPTPKLRELGGIQRTHHDLTTPAVGGAVLVSPSKMKPPAPEQRKRMTSQDCLETSKNDFTKKESRAVSLLTSPAAGIKTVDPLPLREDSEDNIHKFAEATLPVSKIPKYPTNPPGQLPSPPHVPSYWHPSRRIQGSLRDPEFQHNVGKARMNNLQLPQHEAFNDEDEDRLSEISARSAASSLRAFQTLARAKKRKENFWGKT

SEQ ID NO: 837261 - protein, 694 aa, Homo sapiens
MPVRFKGLSEYQRNFLWKKSYLSESCNSSVGRKYPWAGLRSDQLGITKEPSFISKRRVPYHDPQISKSLEWNGAISESNVVASPEPEAPETPKSQEAEQKDVIQERVHSLEASRVPKRTRSHSADSRAEGASDVENNEGVTNHTPVNENVELEHSTKVLSENVDNGLDRLLRKKAGLTVVPSYNALRNSEYQRQFVWKTSKETAPAFAANQVFHNKSQFVPPFKGNSVIHETEYKRNFKGLSPVKEPKLRNDLRENRNLETVSPERKSNKIDDRLKLEAEMELKDLHQPKRKLTPWKHQRLGKVNSEYRAKFLSPAQYLYKAGAWTHVKGNMPNQVKELREKAEFYRKRVQGTHFSRDHLNQILSDSNCCWDVSSTTSSEGTVSSNIRALDLAGDPTSHKTLQKCPSTEPEEKGNIVEEQPQKNTTEKLGVSAPTIPVRRRLAWDTENTSEDVQKQPGEKEEEDDNEEEGDRKTGKQAFMGEQEKLDVHEKSKADKMKEGSDSSVSSEKGGRLPTPKLRELGGIQRTHHDLTTPAVGGAVLVSPSKMKPPAPEQRKRMTSQDCLETSKNDFTKKESRAVSLLTSPAAGIKTVDPLPLREDSEDNIHKFAEATLPVSKIPKYPTNPPGQLPSPPHVPSYWHPSRRIQGSLRDPEFQHNDEDRLSEISARSAASSLRAFQTLARAKKRKENFWGKT

SEQ ID NO: 837262 - protein, 714 aa, Homo sapiens; identical to SEQ ID NO: 837260

SEQ ID NO: 837263 - protein, 714 aa, Homo sapiens; identical to SEQ ID NO: 837260

SEQ ID NO: 837264 - protein, 193 aa, Homo sapiens
FPRVPSRFLYLHRRLSNSPKCSLIAMGNYTGPPRHFFREQAFSRLYLYTRMIVFHHHFGTSTAGPSFYSPPPQRKPGVMPLGFSPAGQKKVDPLPLREDSEDNIHKFAEATLPVSKIPKYPTNPPGQLPSPPHVPSYWHPSRRIQGSLRDPEFQHNDEDRLSEISARSAASSLRAFQTLARAKKRKENFWGKT

SEQ ID NO: 837265 - protein, 714 aa, Homo sapiens; identical to SEQ ID NO: 837260

SEQ ID NO: 837266 - protein, 714 aa, Homo sapiens; identical to SEQ ID NO: 837260

SEQ ID NO: 837267 - protein, 228 aa, Homo sapiens
SGGDMPVRFKGLSEYQRNFLWKKSYLSESCNSSVGRKYPWAGLRSDQLGITKEPSFISKRRVPYHDPQISKSLEWNGAISESNVVASPEPEAPETPKSQEAEQKDVIQERVHSLEASRVPKRTRSHSADSRAEGASDVENNEGVTNHTPVNENVELEHSTKVLSENVDNGLDRLLRKKAGLTVVPSYNALRNSEYQRQFVWKTSKETAPAFAANQASDDHCCQMQHIY

SEQ ID NO: 837268 - protein, 714 aa, Homo sapiens; identical to SEQ ID NO: 837260

SEQ ID NO: 837269 - protein, 434 aa, Homo sapiens [sequence omitted]

SEQ ID NO: 837270 - protein, 235 aa, Homo sapiens
MGEQEKLDVHEKSKADKMKEGSDSSVSSEKGGRLPTPKLRELGGIQRTHHDLTTPAVGGAVLVSPSKMKPPAPEQRKRMTSQDCLETSKNDFTKKESRAVSLLTSPAAGIKTVDPLPLREDSEDNIHKFAEATLPVSKIPKYPTNPPGQLPSPPHVPSYWHPSRRIQGSLRDPEFQHNVGKARMNNLQLPQHEAFNDEDEDRLSEISARSAASSLRAFQTLARAKKRKENFWGKT

SEQ ID NO: 837271 - protein, 222 aa, Homo sapiens [sequence omitted]

SEQ ID NO: 837272 - protein, 714 aa, Homo sapiens; identical to SEQ ID NO: 837260

SEQ ID NO: 837273 - protein, 714 aa, Homo sapiens; identical to SEQ ID NO: 837260

SEQ ID NO: 837274 - protein, 714 aa, Homo sapiens; identical to SEQ ID NO: 837260

SEQ ID NO: 837275 - protein, 714 aa, Homo sapiens; identical to SEQ ID NO: 837260

SEQ ID NO: 837276 - protein, 718 aa, Homo sapiens
MPVRFKGLSEYQRNFLWKKSYLSESCNSSVGRKYPWAGLRSDQLGITKEPSFISKRRVPYHDPQISKSLEWNGAISESNVVASPEPEAPETPKSQEAEQKDVIQERVHSLEASRVPKRTRSHSADSRAEGASDVENNEGVTNHTPVNENVELEHSTKVLSENVDNGLDRLLRKKAGLTVVPSYNALRNSEYQRQFVWKTSKETAPAFAANQVFHNKSQFVPPFKGNSVIHETEYKRNFKGLSPVKEPKLRNDLRENRNLETVSPERKSNKIDDRLKLEAEMELKDLHQPKRKLTPWKHQRLGKVNSEYRAKFLSPAQYLYKAGAWTHVKGNMPNQVKELREKAEFYRKRVQGTHFSRDHLNQILSDSNCCWDVSSTTSSEGTVSSNIRALDLAGDPTSHKTLQKCPSTEPEEKGNIVEEQPQKNTTEKLGVSAPTIPVRRRLAWDTENTSEDVQKQPGEKEEEDDNEEEGDRKTGKQAFMGEQEKLDVHEKSKADKMKEGSDSSVSSEKGGRLPTPKLRELGGIQRTHHDLTTPAVGGAVLVSPSKMKPPAPEQRKRMTSQDCLETSKNDFTKKESRAVSLLTSPAAGIKTVDPLPLREDSEDNIHKFAEATLPVSKIPKYPTNPPGQLPSPPHVPSYWHPSRRIQGSLRDPEFQHNVGKARMNNLQLPQHEAFNDEDEDRLSEISARSAASSLRAFQTLARAKKRKEMRKLRFTETE

SEQ ID NO: 837277 - protein, 306 aa, Homo sapiens
EGDASGIQTSGACRARSGGGRDRGCTGRGCGADARAGAAMVKISFQPAVAGIKGDKADKASASAPAPASATEILLTPAREEQPPQHRSKRGSSVGGVCYLSMGMVVLLMGLVFASVYIYRYFFLAQLARDNFFRCGVLYEDSLSSQVRTQMELEEDVKIYLDENYERINVPVPQFGGGDPADIIHDFQRGLTAYHDISLDKCYVIELNTTIVLPPRNFWELLMNVKRGTYLPQTYIIQEEMVVTEHVSDKEALGSFIYHLCNGKDTYRLRRRATRRRINKRGAKNCNAIRHFENTFVVETLICGVV

SEQ ID NO: 837278 - protein, 306 aa, Homo sapiens; identical to SEQ ID NO: 837277

SEQ ID NO: 837279 - protein, 306 aa, Homo sapiens; identical to SEQ ID NO: 837277

SEQ ID NO: 837280 - protein, 306 aa, Homo sapiens; identical to SEQ ID NO: 837277

SEQ ID NO: 837281 - protein, 250 aa, Homo sapiens
GWYRSGDVKDPGLGTEILLTPAREEQPPQHRSKRGSSVGGVCYLSMGMVVLLMGLVFASVYIYRYFFLAQLARDNFFRCGVLYEDSLSSQVRTQMELEEDVKIYLDENYERINVPVPQFGGGDPADIIHDFQRGLTAYHDISLDKCYVIELNTTIVLPPRNFWELLMNVKRGTYLPQTYIIQEEMVVTEHVSDKEALGSFIYHLCNGKDTYRLRRRATRRRINKRGAKNCNAIRHFENTFVVETLICGVV

SEQ ID NO: 837282 - protein, 259 aa, Homo sapiens
EGDASGIQTSGACRARSGGGRDRGCTGRGCGADARAGAAMVKISFQPAVAGIKGDKADKASASAPAPASATEILLTPARLARDNFFRCGVLYEDSLSSQVRTQMELEEDVKIYLDENYERINVPVPQFGGGDPADIIHDFQRGLTAYHDISLDKCYVIELNTTIVLPPRNFWELLMNVKRGTYLPQTYIIQEEMVVTEHVSDKEALGSFIYHLCNGKDTYRLRRRATRRRINKRGAKNCNAIRHFENTFVVETLICGVV

SEQ ID NO: 837283 - protein, 279 aa, Homo sapiens
PHTLPPAPPPPASLNITFHPPLPINPHNHNPSPSPPPPPSATHILLTPPTHHHPPQHPSNTPTSLPPLSLSIPIVLLLIPLLFPSLYIYTYFFFHTSPHLARDNFFRCGVLYEDSLSSQVRTQMELEEDVKIYLDENYERINVPVPQFGGGDPADIIHDFQRGLTAYHDISLDKCYVIELNTTIVLPPRNFWELLMNVKRGTYLPQTYIIQEEMVVTEHVSDKEALGSFIYHLCNGKDTYRLRRRATRRRINKRGAKNCNAIRHFENTFVVETLICGVV

SEQ ID NO: 837284 - protein, 75 aa, Homo sapiens
EEVDKKEVVEAVTIVETPPMVVVGIVGYVETPRGLLCAVPEEGSPQSRQWDGRLRNGAGKVTAQSRPRGTSRGFC

SEQ ID NO: 837285 - protein, 176 aa, Homo sapiens
EGDASGIQTSGACRARSGGGRDRGCTGRGCGADARAGAAMVKISFQPAVAGIKGDKADKASASAPAPASATEILLTPAREEQPPQHRSKRGSSVGGVCYLSMGMVVLLMGLVFASVYIYRYFFLAQLARDNFFRCGVLYEDSLSSQVRTQMELEEDVKIYSLLSHVHGGRAVGSAE

SEQ ID NO: 837286 - protein, 92 aa, Homo sapiens
RKPEGPTHCGGHLVLQRGTYLPQTYIIQEEMVVTEHVSDKEALGSFIYHLCNGKDTYRLRRRATRRREWLASPTVAPVPCPRPQLSSRLAQL

SEQ ID NO: 837287 - protein, 306 aa, Homo sapiens; identical to SEQ ID NO: 837277

SEQ ID NO: 837288 - protein, 306 aa, Homo sapiens; identical to SEQ ID NO: 837277

SEQ ID NO: 837289 - protein, 203 aa, Homo sapiens
MVVLLMGLVFASVYIYRYFFLAQLARDNFFRCGVLYEDSLSSQVRTQMELEEDVKIYLDENYERINVPVPQFGGGDPADIIHDFQRGLTAYHDISLDKCYVIELNTTIVLPPRNFWELLMNVKRGTYLPQTYIIQEEMVVTEHVSDKEALGSFIYHLCNGKDTYRLRRRATRRRINKRGAKNCNAIRHFENTFVVETLICGVV

SEQ ID NO: 837290 - protein, 269 aa, Homo sapiens
EGDASGIQTSGACRARSGGGRDRGCTGRGCGADARAGAAMVKISFQPAVAGIKGDKADKASASAPAPASATEILLTPAREEQPPQHRSKRGSSVGGVCYLSMGMVVLLMGLVFASVYIYRYFFLAQLARDNFFRCGVLYEDSLSSQVRTQMELEEDVKIYLDENYERINVPVPQFGGGDPADIIHDFQRRGTYLPQTYIIQEEMVVTEHVSDKEALGSFIYHLCNGKDTYRLRRRATRRRINKRGAKNCNAIRHFENTFVVETLICGVV

SEQ ID NO: 837291 - protein, 306 aa, Homo sapiens; identical to SEQ ID NO: 837277

SEQ ID NO: 837292 - protein, 166 aa, Homo sapiens
MSLHSSPTLPTSLYQSCDLSVGGPSLLTWVWRRERRCCKVFSVSHCLEAGPAKAWAHSCTGSPRGRTGWGSRACEALGKGMGLWGRGGMGFRSICTIRKVLRSFFLEGTLSSLSLFLDLGLELRMGRCAQGGTHQSTREGGYLGVSQGLCQCLQPTSRSLEFGEWG

SEQ ID NO: 837293 - protein, 211 aa, Homo sapiens
EGDASGIQTSGACRARSGGGRDRGCTGRGCGADARAGAAMVKISFQPAVAGIKGDKADKASASAPAPASATEILLTPAREEQPPQHRSKRGSSVGGVCYLSMGMVVLLMGLVFASVYIYRYFFLAQLARDNFFRCGVLYEDSLSSQVRTQMELEEDVKIYLDENYERINVPVPQFGGGDPADIIHDFQRRGLTAYHDMALSFPSLPKLPHV

SEQ ID NO: 837294 - protein, 1531 aa, Homo sapiens
MSTDSNSLAREFLTDVNRLCNAVVQRVEAREEEEEETHMATLGQYLVHGRGFLLLTKLNSIIDQALTCREELLTLLLSLLPLVWKIPVQEEKATDFNLPLSADIILTKEKNSSSQRSTQEKLHLEGSALSSQVSAKVNVFRKSRRQRKITHRYSVRDARKTQLSTSDSEANSDEKGIAMNKHRRPHLLHHFLTSFPKQDHPKAKLDRLATKEQTPPDAMALENSREIIPRQGSNTDILSEPAALSVISNMNNSPFDLCHVLLSLLEKVCKFDVTLNHNSPLAASVVPTLTEFLAGFGDCCSLSDNLESRVVSAGWTEEPVALIQRMLFRTVLHLLSVDVSTAEMMPENLRKNLTELLRAALKIRICLEKQPDPFAPRQKKTLQEVQEDFVFSKYRHRALLLPELLEGVLQILICCLQSAASNPFYFSQAMDLVQEFIQHHGFNLFETAVLQMEWLVLRDGVPPEASEHLKALINSVMKIMSTVKKVKSEQLHHSMCTRKRHRRCEYSHFMHHHRDLSGLLVSAFKNQVSKNPFEETADGDVYYPERCCCIAVCAHQCLRLLQQASLSSTCVQILSGVHNIGICCCMDPKSVIIPLLHAFKLPALKNFQQHILNILNKLILDQLGGAEISPKIKKAACNICTVDSDQLAQLEETLQGNLCDAELSSSLSSPSYRFQGILPSSGSEDLLWKWDALKAYQNFVFEEDRLHSIQIANHICNLIQKGNIVVQWKLYNYIFNPVLQRGVELAHHCQHLSVTSAQSHVCSHHNQCLPQDVLQIYVKTLPILLKSRVIRDLFLSCNGVSQIIELNCLNGIRSHSLKAFETLIISLGEQQKDASVPDIDGIDIEQKELSSVHVGTSFHHQQAYSDSPQSLSKFYAGLKEAYPKRRKTVNQDVHINTINLFLCVAFLCVSKEAESDRESANDSEDTSGYDSTASEPLSHMLPCISLESLVLPSPEHMHQAADIWSMCRWIYMLSSVFQKQFYRLGGFRVCHKLIFMIIQKLFRSHKEEQGKKEGDTSVNENQDLNRISQPKRTMKEDLLSLAIKSDPIPSELGSLKKSADSLGKLELQHISSINVEEVSATEAAPEEAKLFTSQESETSLQSIRLLEALLAICLHGARTSQQKMELELPNQNLSVESILFEMRDHLSQSKVIETQLAKPLFDALLRVALGNYSADFEHNDAMTEKSHQSAEELSSQPGDFSEEAEDSQCCSFKLLVEEEGYEADSESNPEDGETQDDGVDLKSETEGFSASSSPNDLLENLTQGEIIYPEICMLELNLLSASKAKLDVLAHVFESFLKIIRQKEKNVFLLMQQGTVKNLLGGFLSILTQDDSDFQACQRVLVDLLVSLMSSRTCSEELTLLLRIFLEKSPCTKILLLGILKIIESDTTMSPSQYLTFPLLHAPNLSNGVSSQKYPGILNSKAMGLLRRARVSRSKKEADRESFPHRLLSSWHIAPVHLPLLGQNCWPHLSEGFSVSLWFNVECIHEAESTTEKGKKIKKRNKSLILPDSSFDGTGMMTGLSDLYTKIVFRL

SEQ ID NO: 837295 - protein, 3729 aa, Homo sapiens
MSTDSNSLAREFLTDVNRLCNAVVQRVEAREEEEEETHMATLGQYLVHGRGFLLLTKLNSIIDQALTCREELLTLLLSLLPLVWKIPVQEEKATDFNLPLSADIILTKEKNSSSQRSTQEKLHLEGSALSSQVSAKVNVFRKSRRQRKITHRYSVRDARKTQLSTSDSEANSDEKGIAMNKHRRPHLLHHFLTSFPKQDHPKAKLDRLATKEQTPPDAMALENSREIIPRQGSNTDILSEPAALSVISNMNNSPFDLCHVLLSLLEKVCKFDVTLNHNSPLAASVVPTLTEFLAGFGDCCSLSDNLESRVVSAGWTEEPVALIQRMLFRTVLHLLSVDVSTAEMMPENLRKNLTELLRAALKIRICLEKQPDPFAPRQKKTLQEVQEDFVFSKYRHRALLLPELLEGVLQILICCLQSAASNPFYFSQAMDLVQEFIQHHGFNLFETAVLQMEWLVLRDGVPPEASEHLKALINSVMKIMSTVKKVKSEQLHHSMCTRKRHRRCEYSHFMHHHRDLSGLLVSAFKNQVSKNPFEETADGDVYYPERCCCIAVCAHQCLRLLQQASLSSTCVQILSGVHNIGICCCMDPKSVIIPLLHAFKLPALKNFQQHILNILNKLILDQLGGAEISPKIKKAACNICTVDSDQLAQLEETLQGNLCDAELSSSLSSPSYRFQGILPSSGSEDLLWKWDALKAYQNFVFEEDRLHSIQIANHICNLIQKGNIVVQWKLYNYIFNPVLQRGVELAHHCQHLSVTSAQSHVCSHHNQCLPQDVLQIYVKTLPILLKSRVIRDLFLSCNGVSQIIELNCLNGIRSHSLKAFETLIISLGEQQKDASVPDIDGIDIEQKELSSVHVGTSFHHQQAYSDSPQSLSKFYAGLKEAYPKRRKTVNQDVHINTINLFLCVAFLCVSKEAESDRESANDSEDTSGYDSTASEPLSHMLPCISLESLVLPSPEHMHQAADIWSMCRWIYMLSSVFQKQFYRLGGFRVCHKLIFMIIQKLFRSHKEEQGKKEGDTSVNENQDLNRISQPKRTMKEDLLSLAIKSDPIPSELGSLKKSADSLGKLELQHISSINVEEVSATEAAPEEAKLFTSQESETSLQSIRLLEALLAICLHGARTSQQKMELELPNQNLSVESILFEMRDHLSQSKVIETQLAKPLFDALLRVALGNYSADFEHNDAMTEKSHQSAEELSSQPGDFSEEAEDSQCCSFKLLVEEEGYEADSESNPEDGETQDDGVDLKSETEGFSASSSPNDLLENLTQGEIIYPEICMLELNLLSASKAKLDVLAHVFESFLKIIRQKEKNVFLLMQQGTVKNLLGGFLSILTQDDSDFQACQRVLVDLLVSLMSSRTCSEELTLLLRIFLEKSPCTKILLLGILKIIESDTTMSPSQYLTFPLLHAPNLSNGVSSQKYPGILNSKAMGLLRRARVSRSKKEADRESFPHRLLSSWHIAPVHLPLLGQNCWPHLSEGFSVSLWFNVECIHEAESTTEKGKKIKKRNKSLILPDSSFDGTESDRPEGAEYINPGERLIEEGCIHIISLGSKALMIQVWADPHNATLIFRVCMDSNDDMKAVLLAQVESQENIFLPSKWQHLVLTYLQQPQGKRRIHGKISIWVSGQRKPDVTLDFMLPRKTSLSSDSNKTFCMIGHCLSSQEEFLQLAGKWDLGNLLLFNGAKVGSQEAFYLYACGPNHTSVMPCKYGKPVNDYSKYINKEILRCEQIRELFMTKKDVDIGLLIESLSVVYTTYCPAQYTIYEPVIRLKGQMKTQLSQRPFSSKEVQSILLEPHHLKNLQPTEYKTIQGILHEIGGTGIFVFLFARVVELSSCEETQALALRVILSLIKYNQQRVHELENCNGLSMIHQVLIKQKCIVGFYILKTLLEGCCGEDIIYMNENGEFKLDVDSNAIIQDVKLLEELLLDWKIWSKAEQGVWETLLAALEVLIRADHHQQMFNIKQLLKAQVVHHFLLTCQVLQEYKEGQLTPMPREMAKIFQEKVRSIMYLRHSSSGGRSLMSPGFMVISPSGFTASPYEGENSSNIIPQQMAAHMLRSRSLPAFPTSSLLTQSQKLTGSLGCSIDRLQNIADTYVATQSKKQNSLGSSDTLKKGKEDAFISSCESAKTVCEMEAVLSAQVSVSDVPKGVLGFPVVKADHKQLGAEPRSEDDSPGDESCPRRPDYLKGLASFQRSHSTIASLGLAFPSQNGSAAVGRWPSLVDRNTDDWENVTEDCLVPICCGLYELLSGVLLILPDVLLEDVMDKLIQADTLLVLVNHPSPAIQQGVIKLLDAYFARASKEQKDKFLKNRGFSLLANQLYLHRGTQELLECFIEMFFGRHIGLDEEFDLEDVRNMGLFQKWSVIPILGLIETSLYDNILLHNALLLLLQILNSCSKVADMLLDNGLLYVLCNTVAALNGLEKNIPMSEYKLLACDIQQLFIAVTIHACSSSGSQYFRVIEDLIVMLGYLQNSKNKRTQNMAVALQLRVLQAAMEFIRTTANHDSENLTDSLQSPSAPHHAVVQKRKSIAGPRKFPLAQTESLLMKMRSVANDELHVMMQRRMSQENPSQATETELAQRLQRLTVLAVNRIIYQEFNSDIIDILRTPENVTQSKTSVFQTEISEENIHHEQSSVFNPFQKEIFTYLVEGFKVSIGSSKASGSKQQWTKILWSCKETFRMQLGRLLVHILSPAHAAQERKQIFEIVHEPNHQEILRDCLSPSLQHGAKLVLYLSELIHNHQGELTEEELGTAELLMNALKLCGHKCIPPSASTKADLIKMIKEEQKKYETEEGVNKAAWQKTVNNNQQSLFQRLDSKSKDISKIAADITQAVSLSQGNERKKVIQHIRGMYKVDLSASRHWQELIQQLTHDRAVWYDPIYYPTSWQLDPTEGPNRERRRLQRCYLTIPNKYLLRDRQKSEDVVKPPLSYLFEDKTHSSFSSTVKDKAASESIRVNRRCISVAPSRETAGELLLGKCGMYFVEDNASDTVESSSLQGELEPASFSWTYEEIKEVHKRWWQLRDNAVEIFLTNGRTLLLAFDNTKVRDDVYHNILTNNLPNLLEYGNITALTNLWYTGQITNFEYLTHLNKHAGRSFNDLMQYPVFPFILADYVSETLDLNDLLIYRNLSKPIAVQYKEKEDRYVDTYKYLEEEYRKGAREDDPMPPVQPYHYGSHYSNSGTVLHFLVRMPPFTKMFLAYQDQSFDIPDRTFHSTNTTWRLSSFESMTDVKELIPEFFYLPEFLVNREGFDFGVRQNGERVNHVNLPPWARNDPRLFILIHRQALESDYVSQNICQWIDLVFGYKQKGKASVQAINVFHPATYFGMDVSAVEDPVQRRALETMIKTYGQTPRQLFHMAHVSRPGAKLNIEGELPAAVGLLVQFAFRETREQVKEITYPSPLSWIKGLKWGEYVGSPSAPVPVVCFSQPHGERFGSLQALPTRAICGLSRNFCLLMTYSKEQGVRSMNSTDIQWSAILSWGYADNILRLKSKQSEPPVNFIQSSQQYQVTSCAWVPDSCQLFTGSKCGVITAYTNRFTSSTPSEIEMETQIHLYGHTEEITSLFVCKPYSILISVSRDGTCIIWDLNRLCYVQSLAGHKSPVTAVSASETSGDIATVCDSAGGGSDLRLWTVNGDLVGHVHCREIICSVAFSNQPEGVSINVIAGGLENGIVRLWSTWDLKPVREITFPKSNKPIISLTFSCDGHHLYTANSDGTVIAWCRKDQQRLKQPMFYSFLSSYAAG

SEQ ID NO: 837296 - protein, 3729 aa, Homo sapiens; identical to SEQ ID NO: 837295

SEQ ID NO: 837297 - protein, 3192 aa, Homo sapiens
MSTDSNSLAREFLTDVNRLCNAVVQRVEAREEEEEETHMATLGQYLVHGRGFLLLTKLNSIIDQALTCREELLTLLLSLLPLVWKIPVQEEKATDFNLPLSADIILTKEKNSSSQRSTQEKLHLEGSALSSQVSAKVNVFRKSRRQRKITHRYSVRDARKTQLSTSDSEANSDEKGIAMNKHRRPHLLHHFLTSFPKQDHPKAKLDRLATKEQTPPDAMALENSREIIPRQGSNTDILSEPAALSVISNMNNSPFDLCHVLLSLLEKVCKFDVTLNHNSPLAASVVPTLTEFLAGFGDCCSLSDNLESRVVSAGWTEEPVALIQRMLFRTVLHLLSVDVSTAEMMPENLRKNLTELLRAALKIRICLEKQPDPFAPRQKKTLQEVQEDFVFSKYRHRALLLPELLEGVLQILICCLQSAASNPFYFSQAMDLVQEFIQHHGFNLFETAVLQMEWLVLRDGVPPEASEHLKALINSVMKIMSTVKKVKSEQLHHSMCTRKRHRRCEYSHFMHHHRDLSGLLVSAFKNQVSKNPFEETADGDVYYPERCCCIAVCAHQCLRLLQQASLSSTCVQILSGVHNIGICCCMDPKSVIIPLLHAFKLPALKNFQQHILNILNKLILDQLGGAEISPKIKKAACNICTVDSDQLAQLEETLQGNLCDAELSSSLSSPSYRFQGILPSSGSEDLLWKWDALKAYQNFVFEEDRLHSIQIANHICNLIQKGNIVVQWKLYNYIFNPVLQRGVELAHHCQHLSVTSAQSHVCSHHNQCLPQDVLQIYVKTLPILLKSRVIRDLFLSCNGVSQIIELNCLNGIRSHSLKAFETLIISLGEQQKDASVPDIDGIDIEQKELSSVHVGTSFHHQQAYSDSPQSLSKFYAGLKEAYPKRRKTVNQDVHINTINLFLCVAFLCVSKEAESDRESANDSEDTSGYDSTASEPLSHMLPCISLESLVLPSPEHMHQAADIWSMCRWIYMLSSVFQKQFYRLGGFRVCHKLIFMIIQKLFRSHKEEQGKKEGDTSVNENQDLNRISQPKRTMKEDLLSLAIKSDPIPSELGSLKKSADSLGKLELQHISSINVEEVSATEAAPEEAKLFTSQESETSLQSIRLLEALLAICLHGARTSQQKMELELPNQNLSVESILFEMRDHLSQSKVIETQLAKPLFDALLRVALGNYSADFEHNDAMTEKSHQSAEELSSQPGDFSEEAEDSQCCSFKLLVEEEGYEADSESNPEDGETQDDGVDLKSETEGFSASSSPNDLLENLTQGEIIYPEICMLELNLLSASKAKLDVLAHVFESFLKIIRQKEKNVFLLMQQGTVKNLLGGFLSILTQDDSDFQACQRVLVDLLVSLMSSRTCSEELTLLLRIFLEKSPCTKILLLGILKIIESDTTMSPSQYLTFPLLHAPNLSNGVSSQKYPGILNSKAMGLLRRARVSRSKKEADRESFPHRLLSSWHIAPVHLPLLGQNCWPHLSEGFSVSLWFNVECIHEAESTTEKGKKIKKRNKSLILPDSSFDGTESDRPEGAEYINPGERLIEEGCIHIISLGSKALMIQVWADPHNATLIFRVCMDSNDDMKAVLLAQVESQENIFLPSKWQHLVLTYLQQPQGKRRIHGKISIWVSGQRKPDVTLDFMLPRKTSLSSDSNKTFCMIGHCLSSQEEFLQLAGKWDLGNLLLFNGAKVGSQEAFYLYACGPNHTSVMPCKYGKPVNDYSKYINKEILRCEQIRELFMTKKDVDIGLLIESLSVVYTTYCPAQYTIYEPVIRLKGQMKTQLSQRPFSSKEVQSILLEPHHLKNLQPTEYKTIQGILHEIGGTGIFVFLFARVVELSSCEETQALALRVILSLIKYNQQRVHELENCNGLSMIHQVLIKQKCIVGFYILKTLLEGCCGEDIIYMNENGEFKLDVDSNAIIQDVKLLEELLLDWKIWSKAEQGVWETLLAALEVLIRADHHQQMFNIKQLLKAQVVHHFLLTCQVLQEYKEGQLTPMPREMAKIFQEKVRSIMYLRHSSSGGRSLMSPGFMVISPSGFTASPYEGENSSNIIPQQMAAHMLRSRSLPAFPTSSLLTQSQKLTGSLGCSIDRLQNIADTYVATQSKKQNSLGSSDTLKKGKEDAFISSCESAKTVCEMEAVLSAQVSVSDVPKGVLGFPVVKADHKQLGAEPRSEDDSPGDESCPRRPDYLKGLASFQRSHSTIASLGLAFPSQNGSAAVGRWPSLVDRNTDDWENVTEDCLVPICCGLYELLSGVLLILPDVLLEDVMDKLIQADTLLVLVNHPSPAIQQGVIKLLDAYFARASKEQKDKFLKNRGFSLLANQLYLHRGTQELLECFIEMFFGRHIGLDEEFDLEDVRNMGLFQKWSVIPILGLIETSLYDNILLHNALLLLLQILNSCSKVADMLLDNGLLYVLCNTVAALNGLEKNIPMSEYKLLACDIQQLFIAVTIHACSSSGSQYFRVIEDLIVMLGYLQNSKNKRTQNMAVALQLRVLQAAMEFIRTTANHDSENLTDSLQSPSAPHHAVVQKRKSIAGPRKFPLAQTESLLMKMRSVANDELHVMMQRRMSQENPSQATETELAQRLQRLTVLAVNRIIYQEFNSDIIDILRTPENVTQSKTSVFQTEISEENIHHEQSSVFNPFQKEIFTYLVEGFKVSIGSSKASGSKQQWTKILWSCKETFRMQLGRLLVHILSPAHAAQERKQIFEIVHEPNHQEILRDCLSPSLQHGAKLVLYLSELIHNHQGELTEEELGTAELLMNALKLCGHKCIPPSASTKADLIKMIKEEQKKYETEEGVNKAAWQKTVNNNQQSLFQRLDSKSKDISKIAADITQAVSLSQGNERKKVIQHIRGMYKVDLSASRHWQELIQQLTHDRAVWYDPIYYPTSWQLDPTEGPNRERRRLQRCYLTIPNKYLLRDRQKSEDVVKPPLSYLFEDKTHSSFSSTVKDKAASESIRVNRRCISVAPSRETAGELLLGKCGMYFVEDNASDTVESSSLQGELEPASFSWTYEEIKEVHKRWWQLRDNAVEIFLTNGRTLLLAFDNTKVRDDVYHNILTNNLPNLLEYGNITALTNLWYTGQITNFEYLTHLNKHAGRSFNDLMQYPVFPFILADYVSETLDLNDLLIYRNLSKPIAVQYKEKEDRYVDTYKYLEEEYRKGAREDDPMPPVQPYHYGSHYSNSGTVLHFLVRMPPFTKMFLAYQDFF

SEQ ID NO: 837298 - protein, 2716 aa, Homo sapiens
MSTDSNSLAREFLTDVNRLCNAVVQRVEAREEEEEETHMATLGQYLVHGRGFLLLTKLNSIIDQALTCREELLTLLLSLLPLVWKIPVQEEKATDFNLPLSADIILTKEKNSSSQRSTQEKLHLEGSALSSQVSAKVNVFRKSRRQRKITHRYSVRDARKTQLSTSDSEANSDEKGIAMNKHRRPHLLHHFLTSFPKQDHPKAKLDRLATKEQTPPDAMALENSREIIPRQGSNTDILSEPAALSVISNMNNSPFDLCHVLLSLLEKVCKFDVTLNHNSPLAASVVPTLTEFLAGFGDCCSLSDNLESRVVSAGWTEEPVALIQRMLFRTVLHLLSVDVSTAEMMPENLRKNLTELLRAALKIRICLEKQPDPFAPRQKKTLQEVQEDFVFSKYRHRALLLPELLEGVLQILICCLQSAASNPFYFSQAMDLVQEFIQHHGFNLFETAVLQMEWLVLRDGVPPEASEHLKALINSVMKIMSTVKKVKSEQLHHSMCTRKRHRRCEYSHFMHHHRDLSGLLVSAFKNQVSKNPFEETADGDVYYPERCCCIAVCAHQCLRLLQQASLSSTCVQILSGVHNIGICCCMDPKSVIIPLLHAFKLPALKNFQQHILNILNKLILDQLGGAEISPKIKKAACNICTVDSDQLAQLEETLQGNLCDAELSSSLSSPSYRFQGILPSSGSEDLLWKWDALKAYQNFVFEEDRLHSIQIANHICNLIQKGNIVVQWKLYNYIFNPVLQRGVELAHHCQHLSVTSAQSHVCSHHNQCLPQDVLQIYVKTLPILLKSRVIRDLFLSCNGVSQIIELNCLNGIRSHSLKAFETLIISLGEQQKDASVPDIDGIDIEQKELSSVHVGTSFHHQQAYSDSPQSLSKFYAGLKEAYPKRRKTVNQDVHINTINLFLCVAFLCVSKEAESDRESANDSEDTSGYDSTASEPLSHMLPCISLESLVLPSPEHMHQAADIWSMCRWIYMLSSVFQKQFYRLGGFRVCHKLIFMIIQKLFRSHKEEQGKKEGDTSVNENQDLNRISQPKRTMKEDLLSLAIKSDPIPSELGSLKKSADSLGKLELQHISSINVEEVSATEAAPEEAKLFTSQESETSLQSIRLLEALLAICLHGARTSQQKMELELPNQNLSVESILFEMRDHLSQSKVIETQLAKPLFDALLRVALGNYSADFEHNDAMTEKSHQSAEELSSQPGDFSEEAEDSQCCSFKLLVEEEGYEADSESNPEDGETQDDGVDLKSETEGFSASSSPNDLLENLTQGEIIYPEICMLELNLLSASKAKLDVLAHVFESFLKIIRQKEKNVFLLMQQGTVKNLLGGFLSILTQDDSDFQACQRVLVDLLVSLMSSRTCSEELTLLLRIFLEKSPCTKILLLGILKIIESDTTMSPSQYLTFPLLHAPNLSNGVSSQKYPGILNSKAMGLLRRARVSRSKKEADRESFPHRLLSSWHIAPVHLPLLGQNCWPHLSEGFSVSLWFNVECIHEAESTTEKGKKIKKRNKSLILPDSSFDGTESDRPEGAEYINPGERLIEEGCIHIISLGSKALMIQVWADPHNATLIFRVCMDSNDDMKAVLLAQVESQENIFLPSKWQHLVLTYLQQPQGKRRIHGKISIWVSGQRKPDVTLDFMLPRKTSLSSDSNKTFCMIGHCLSSQEEFLQLAGKWDLGNLLLFNGAKVGSQEAFYLYACGPNHTSVMPCKYGKPVNDYSKYINKEILRCEQIRELFMTKKDVDIGLLIESLSVVYTTYCPAQYTIYEPVIRLKGQMKTQLSQRPFSSKEVQSILLEPHHLKNLQPTEYKTIQGILHEIGGTGIFVFLFARVVELSSCEETQALALRVILSLIKYNQQRVHELENCNGLSMIHQVLIKQKCIVGFYILKTLLEGCCGEDIIYMNENGEFKLDVDSNAIIQDVKLLEELLLDWKIWSKAEQGVWETLLAALEVLIRADHHQQMFNIKQLLKAQVVHHFLLTCQVLQEYKEGQLTPMPREMAKIFQEKVRSIMYLRHSSSGGRSLMSPGFMVISPSGFTASPYEGENSSNIIPQQMAAHMLRSRSLPAFPTSSLLTQSQKLTGSLGCSIDRLQNIADTYVATQSKKQNSLGSSDTLKKGKEDAFISSCESAKTVCEMEAVLSAQVSVSDVPKGVLGFPVVKADHKQLGAEPRSEDDSPGDESCPRRPDYLKGLASFQRSHSTIASLGLAFPSQNGSAAVGRWPSLVDRNTDDWENVTEDCLVPICCGLYELLSGVLLILPDVLLEDVMDKLIQADTLLVLVNHPSPAIQQGVIKLLDAYFARASKEQKDKFLKNRGFSLLANQLYLHRGTQELLECFIEMFFGRHIGLDEEFDLEDVRNMGLFQKWSVIPILGLIETSLYDNILLHNALLLLLQILNSCSKVADMLLDNGLLYVLCNTVAALNGLEKNIPMSEYKLLACDIQQLFIAVTIHACSSSGSQYFRVIEDLIVMLGYLQNSKNKRTQNMAVALQLRVLQAAMEFIRTTANHDSENLTDSLQSPSAPHHAVVQKRKSIAGPRKFPLAQTESLLMKMRSVANDELHVMMQRRMSQENPSQATETELAQRLQRLTVLAVNRIIYQEFNSDIIDILRTPENVTQSKTSVFQTEISEENIHHEQSSVFNPFQKEIFTYLVEGFKVSIGSSKASGSKQQWTKILWSCKETFRMQLGRLLVHILSPAHAAQERKQIFEIVHEPNHQEILRDCLSPSLQAH

SEQ ID NO: 837299 - protein, 2662 aa, Homo sapiens
MSTDSNSLAREFLTDVNRLCNAVVQRVEAREEEEEETHMATLGQYLVHGRGFLLLTKLNSIIDQALTCREELLTLLLSLLPLVWKIPVQEEKATDFNLPLSADIILTKEKNSSSQRSTQEKLHLEGSALSSQVSAKVNVFRKSRRQRKITHRYSVRDARKTQLSTSDSEANSDEKGIAMNKHRRPHLLHHFLTSFPKQDHPKAKLDRLATKEQTPPDAMALENSREIIPRQGSNTDILSEPAALSVISNMNNSPFDLCHVLLSLLEKVCKFDVTLNHNSPLAASVVPTLTEFLAGFGDCCSLSDNLESRVVSAGWTEEPVALIQRMLFRTVLHLLSVDVSTAEMMPENLRKNLTELLRAALKIRICLEKQPDPFAPRQKKTLQEVQEDFVFSKYRHRALLLPELLEGVLQILICCLQSAASNPFYFSQAMDLVQEFIQHHGFNLFETAVLQMEWLVLRDGVPPEASEHLKALINSVMKIMSTVKKVKSEQLHHSMCTRKRHRRCEYSHFMHHHRDLSGLLVSAFKNQVSKNPFEETADGDVYYPERCCCIAVCAHQCLRLLQQASLSSTCVQILSGVHNIGICCCMDPKSVIIPLLHAFKLPALKNFQQHILNILNKLILDQLGGAEISPKIKKAACNICTVDSDQLAQLEETLQGNLCDAELSSSLSSPSYRFQGILPSSGSEDLLWKWDALKAYQNFVFEEDRLHSIQIANHICNLIQKGNIVVQWKLYNYIFNPVLQRGVELAHHCQHLSVTSAQSHVCSHHNQCLPQDVLQIYVKTLPILLKSRVIRDLFLSCNGVSQIIELNCLNGIRSHSLKAFETLIISLGEQQKDASVPDIDGIDIEQKELSSVHVGTSFHHQQAYSDSPQSLSKFYAGLKEAYPKRRKTVNQDVHINTINLFLCVAFLCVSKEAESDRESANDSEDTSGYDSTASEPLSHMLPCISLESLVLPSPEHMHQAADIWSMCRWIYMLSSVFQKQFYRLGGFRVCHKLIFMIIQKLFRSHKEEQGKKEGDTSVNENQDLNRISQPKRTMKEDLLSLAIKSDPIPSELGSLKKSADSLGKLELQHISSINVEEVSATEAAPEEAKLFTSQESETSLQSIRLLEALLAICLHGARTSQQKMELELPNQNLSVESILFEMRDHLSQSKVIETQLAKPLFDALLRVALGNYSADFEHNDAMTEKSHQSAEELSSQPGDFSEEAEDSQCCSFKLLVEEEGYEADSESNPEDGETQDDGVDLKSETEGFSASSSPNDLLENLTQGEIIYPEICMLELNLLSASKAKLDVLAHVFESFLKIIRQKEKNVFLLMQQGTVKNLLGGFLSILTQDDSDFQACQRVLVDLLVSLMSSRTCSEELTLLLRIFLEKSPCTKILLLGILKIIESDTTMSPSQYLTFPLLHAPNLSNGVSSQKYPGILNSKAMGLLRRARVSRSKKEADRESFPHRLLSSWHIAPVHLPLLGQNCWPHLSEGFSVSLWFNVECIHEAESTTEKGKKIKKRNKSLILPDSSFDGTESDRPEGAEYINPGERLIEEGCIHIISLGSKALMIQVWADPHNATLIFRVCMDSNDDMKAVLLAQVESQENIFLPSKWQHLVLTYLQQPQGKRRIHGKISIWVSGQRKPDVTLDFMLPRKTSLSSDSNKTFCMIGHCLSSQEEFLQLAGKWDLGNLLLFNGAKVGSQEAFYLYACGPNHTSVMPCKYGKPVNDYSKYINKEILRCEQIRELFMTKKDVDIGLLIESLSVVYTTYCPAQYTIYEPVIRLKGQMKTQLSQRPFSSKEVQSILLEPHHLKNLQPTEYKTIQGILHEIGGTGIFVFLFARVVELSSCEETQALALRVILSLIKYNQQRVHELENCNGLSMIHQVLIKQKCIVGFYILKTLLEGCCGEDIIYMNENGEFKLDVDSNAIIQDVKLLEELLLDWKIWSKAEQGVWETLLAALEVLIRADHHQQMFNIKQLLKAQVVHHFLLTCQVLQEYKEGQLTPMPREMAKIFQEKVRSIMYLRHSSSGGRSLMSPGFMVISPSGFTASPYEGENSSNIIPQQMAAHMLRSRSLPAFPTSSLLTQSQKLTGSLGCSIDRLQNIADTYVATQSKKQNSLGSSDTLKKGKEDAFISSCESAKTVCEMEAVLSAQVSVSDVPKGVLGFPVVKADHKQLGAEPRSEDDSPGDESCPRRPDYLKGLASFQRSHSTIASLGLAFPSQNGSAAVGRWPSLVDRNTDDWENVTEDCLVPICCGLYELLSGVLLILPDVLLEDVMDKLIQADTLLVLVNHPSPAIQQGVIKLLDAYFARASKEQKDKFLKNRGFSLLANQLYLHRGTQELLECFIEMFFGRHIGLDEEFDLEDVRNMGLFQKWSVIPILGLIETSLYDNILLHNALLLLLQILNSCSKVADMLLDNGLLYVLCNTVAALNGLEKNIPMSEYKLLACDIQQLFIAVTIHACSSSGSQYFRVIEDLIVMLGYLQNSKNKRTQNMAVALQLRVLQAAMEFIRTTANHDSENLTDSLQSPSAPHHAVVQKRKSIAGPRKFPLAQTESLLMKMRSVANDELHVMMQRRMSQENPSQATETELAQRLQRLTVLAVNRIIYQEFNSDIIDILRTPENVTQSKTSVFQTEISEENIHHEQSSVFNPFQKEIFTYLVEGFKVSIGSSASGSKQLDCAYFVA

SEQ ID NO: 837300 - protein, 2306 aa, Homo sapiens
MSTDSNSLAREFLTDVNRLCNAVVQRVEAREEEEEETHMATLGQYLVHGRGFLLLTKLNSIIDQALTCREELLTLLLSLLPLVWKIPVQEEKATDFNLPLSADIILTKEKNSSSQRSTQEKLHLEGSALSSQVSAKVNVFRKSRRQRKITHRYSVRDARKTQLSTSDSEANSDEKGIAMNKHRRPHLLHHFLTSFPKQDHPKAKLDRLATKEQTPPDAMALENSREIIPRQGSNTDILSEPAALSVISNMNNSPFDLCHVLLSLLEKVCKFDVTLNHNSPLAASVVPTLTEFLAGFGDCCSLSDNLESRVVSAGWTEEPVALIQRMLFRTVLHLLSVDVSTAEMMPENLRKNLTELLRAALKIRICLEKQPDPFAPRQKKTLQEVQEDFVFSKYRHRALLLPELLEGVLQILICCLQSAASNPFYFSQAMDLVQEFIQHHGFNLFETAVLQMEWLVLRDGVPPEASEHLKALINSVMKIMSTVKKVKSEQLHHSMCTRKRHRRCEYSHFMHHHRDLSGLLVSAFKNQVSKNPFEETADGDVYYPERCCCIAVCAHQCLRLLQQASLSSTCVQILSGVHNIGICCCMDPKSVIIPLLHAFKLPALKNFQQHILNILNKLILDQLGGAEISPKIKKAACNICTVDSDQLAQLEETLQGNLCDAELSSSLSSPSYRFQGILPSSGSEDLLWKWDALKAYQNFVFEEDRLHSIQIANHICNLIQKGNIVVQWKLYNYIFNPVLQRGVELAHHCQHLSVTSAQSHVCSHHNQCLPQDVLQIYVKTLPILLKSRVIRDLFLSCNGVSQIIELNCLNGIRSHSLKAFETLIISLGEQQKDASVPDIDGIDIEQKELSSVHVGTSFHHQQAYSDSPQSLSKFYAGLKEAYPKRRKTVNQDVHINTINLFLCVAFLCVSKEAESDRESANDSEDTSGYDSTASEPLSHMLPCISLESLVLPSPEHMHQAADIWSMCRWIYMLSSVFQKQFYRLGGFRVCHKLIFMIIQKLFRSHKEEQGKKEGDTSVNENQDLNRISQPKRTMKEDLLSLAIKSDPIPSELGSLKKSADSLGKLELQHISSINVEEVSATEAAPEEAKLFTSQESETSLQSIRLLEALLAICLHGARTSQQKMELELPNQNLSVESILFEMRDHLSQSKVIETQLAKPLFDALLRVALGNYSADFEHNDAMTEKSHQSAEELSSQPGDFSEEAEDSQCCSFKLLVEEEGYEADSESNPEDGETQDDGVDLKSETEGFSASSSPNDLLENLTQGEIIYPEICMLELNLLSASKAKLDVLAHVFESFLKIIRQKEKNVFLLMQQGTVKNLLGGFLSILTQDDSDFQACQRVLVDLLVSLMSSRTCSEELTLLLRIFLEKSPCTKILLLGILKIIESDTTMSPSQYLTFPLLHAPNLSNGVSSQKYPGILNSKAMGLLRRARVSRSKKEADRESFPHRLLSSWHIAPVHLPLLGQNCWPHLSEGFSVSLWFNVECIHEAESTTEKGKKIKKRNKSLILPDSSFDGTESDRPEGAEYINPGERLIEEGCIHIISLGSKALMIQVWADPHNATLIFRVCMDSNDDMKAVLLAQVESQENIFLPSKWQHLVLTYLQQPQGKRRIHGKISIWVSGQRKPDVTLDFMLPRKTSLSSDSNKTFCMIGHCLSSQEEFLQLAGKWDLGNLLLFNGAKVGSQEAFYLYACGPNHTSVMPCKYGKPVNDYSKYINKEILRCEQIRELFMTKKDVDIGLLIESLSVVYTTYCPAQYTIYEPVIRLKGQMKTQLSQRPFSSKEVQSILLEPHHLKNLQPTEYKTIQGILHEIGGTGIFVFLFARVVELSSCEETQALALRVILSLIKYNQQRVHELENCNGLSMIHQVLIKQKCIVGFYILKTLLEGCCGEDIIYMNENGEFKLDVDSNAIIQDVKLLEELLLDWKIWSKAEQGVWETLLAALEVLIRADHHQQMFNIKQLLKAQVVHHFLLTCQVLQEYKEGQLTPMPREMAKIFQEKVRSIMYLRHSSSGGRSLMSPGFMVISPSGFTASPYEGENSSNIIPQQMAAHMLRSRSLPAFPTSSLLTQSQKLTGSLGCSIDRLQNIADTYVATQSKKQNSLGSSDTLKKGKEDAFISSCESAKTVCEMEAVLSAQVSVSDVPKGVLGFPVVKADHKQLGAEPRSEDDSPGDESCPRRPDYLKGLASFQRSHSTIASLGLAFPSQNGSAAVGRWPSLVDRNTDDWENFAYSLGYEPNYNRTASAHSVTEDCLVPICCGLYELLSGVLLILPDVLLEDVMDKLIQADTLLVLVNHPSPAIQQGVIKVRANTR

SEQ ID NO: 837301 - protein, 1621 aa, Homo sapiens
MSTDSNSLAREFLTDVNRLCNAVVQRVEAREEEEEETHMATLGQYLVHGRGFLLLTKLNSIIDQALTCREELLTLLLSLLPLVWKIPVQEEKATDFNLPLSADIILTKEKNSSSQRSTQEKLHLEGSALSSQVSAKVNVFRKSRRQRKITHRYSVRDARKTQLSTSDSEANSDEKGIAMNKHRRPHLLHHFLTSFPKQDHPKAKLDRLATKEQTPPDAMALENSREIIPRQGSNTDILSEPAALSVISNMNNSPFDLCHVLLSLLEKVCKFDVTLNHNSPLAASVVPTLTEFLAGFGDCCSLSDNLESRVVSAGWTEEPVALIQRMLFRTVLHLLSVDVSTAEMMPENLRKNLTELLRAALKIRICLEKQPDPFAPRQKKTLQEVQEDFVFSKYRHRALLLPELLEGVLQILICCLQSAASNPFYFSQAMDLVQEFIQHHGFNLFETAVLQMEWLVLRDGVPPEASEHLKALINSVMKIMSTVKKVKSEQLHHSMCTRKRHRRCEYSHFMHHHRDLSGLLVSAFKNQVSKNPFEETADGDVYYPERCCCIAVCAHQCLRLLQQASLSSTCVQILSGVHNIGICCCMDPKSVIIPLLHAFKLPALKNFQQHILNILNKLILDQLGGAEISPKIKKAACNICTVDSDQLAQLEETLQGNLCDAELSSSLSSPSYRFQGILPSSGSEDLLWKWDALKAYQNFVFEEDRLHSIQIANHICNLIQKGNIVVQWKLYNYIFNPVLQRGVELAHHCQHLSVTSAQSHVCSHHNQCLPQDVLQIYVKTLPILLKSRVIRDLFLSCNGVSQIIELNCLNGIRSHSLKAFETLIISLGEQQKDASVPDIDGIDIEQKELSSVHVGTSFHHQQAYSDSPQSLSKFYAGLKEAYPKRRKTVNQDVHINTINLFLCVAFLCVSKEAESDRESANDSEDTSGYDSTASEPLSHMLPCISLESLVLPSPEHMHQAADIWSMCRWIYMLSSVFQKQFYRLGGFRVCHKLIFMIIQKLFRSHKEEQGKKEGDTSVNENQDLNRISQPKRTMKEDLLSLAIKSDPIPSELGSLKKSADSLGKLELQHISSINVEEVSATEAAPEEAKLFTSQESETSLQSIRLLEALLAICLHGARTSQQKMELELPNQNLSVESILFEMRDHLSQSKVIETQLAKPLFDALLRVALGNYSADFEHNDAMTEKSHQSAEELSSQPGDFSEEAEDSQCCSFKLLVEEEGYEADSESNPEDGETQDDGVDLKSETEGFSASSSPNDLLENLTQGEIIYPEICMLELNLLSASKAKLDVLAHVFESFLKIIRQKEKNVFLLMQQGTVKNLLGGFLSILTQDDSDFQACQRVLVDLLVSLMSSRTCSEELTLLLRIFLEKSPCTKILLLGILKIIESDTTMSPSQYLTFPLLHAPNLSNGVSSQKYPGILNSKAMGLLRRARVSRSKKEADRESFPHRLLSSWHIAPVHLPLLGQNCWPHLSEGFSVSLWFNVECIHEAESTTEKGKKIKKRNKSLILPDSSFDGTESDRPEGAEYINPGERLIEEGCIHIISLGSKALMIQVWADPHNATLIFRVCMDSNDDMKAVLLAQVESQENIFLPSKWQHLVLTYLQQPQGKRRIHGKISIWVSGQR

SEQ ID NO: 837302 - protein, 1902 aa, Homo sapiens
MSTDSNSLAREFLTDVNRLCNAVVQRVEAREEEEEETHMATLGQYLVHGRGFLLLTKLNSIIDQALTCREELLTLLLSLLPLVWKIPVQEEKATDFNLPLSADIILTKEKNSSSQRSTQEKLHLEGSALSSQVSAKVNVFRKSRRQRKITHRYSVRDARKTQLSTSDSEANSDEKGIAMNKHRRPHLLHHFLTSFPKQDHPKAKLDRLATKEQTPPDAMALENSREIIPRQGSNTDILSEPAALSVISNMNNSPFDLCHVLLSLLEKVCKFDVTLNHNSPLAASVVPTLTEFLAGFGDCCSLSDNLESRVVSAGWTEEPVALIQRMLFRTVLHLLSVDVSTAEMMPENLRKNLTELLRAALKIRICLEKQPDPFAPRQKKTLQEVQEDFVFSKYRHRALLLPELLEGVLQILICCLQSAASNPFYFSQAMDLVQEFIQHHGFNLFETAVLQMEWLVLRDGVPPEASEHLKALINSVMKIMSTVKKVKSEQLHHSMCTRKRHRRCEYSHFMHHHRDLSGLLVSAFKNQVSKNPFEETADGDVYYPERCCCIAVCAHQCLRLLQQASLSSTCVQILSGVHNIGICCCMDPKSVIIPLLHAFKLPALKNFQQHILNILNKLILDQLGGAEISPKIKKAACNICTVDSDQLAQLEETLQGNLCDAELSSSLSSPSYRFQGILPSSGSEDLLWKWDALKAYQNFVFEEDRLHSIQIANHICNLIQKGNIVVQWKLYNYIFNPVLQRGVELAHHCQHLSVTSAQSHVCSHHNQCLPQDVLQIYVKTLPILLKSRVIRDLFLSCNGVSQIIELNCLNGIRSHSLKAFETLIISLGEQQKDASVPDIDGIDIEQKELSSVHVGTSFHHQQAYSDSPQSLSKFYAGLKEAYPKRRKTVNQDVHINTINLFLCVAFLCVSKEAESDRESANDSEDTSGYDSTASEPLSHMLPCISLESLVLPSPEHMHQAADIWSMCRWIYMLSSVFQKQFYRLGGFRVCHKLIFMIIQKLFRSHKEEQGKKEGDTSVNENQDLNRISQPKRTMKEDLLSLAIKSDPIPSELGSLKKSADSLGKLELQHISSINVEEVSATEAAPEEAKLFTSQESETSLQSIRLLEALLAICLHGARTSQQKMELELPNQNLSVESILFEMRDHLSQSKVIETQLAKPLFDALLRVALGNYSADFEHNDAMTEKSHQSAEELSSQPGDFSEEAEDSQCCSFKLLVEEEGYEADSESNPEDGETQDDGVDLKSETEGFSASSSPNDLLENLTQGEIIYPEICMLELNLLSASKAKLDVLAHVFESFLKIIRQKEKNVFLLMQQGTVKNLLGGFLSILTQDDSDFQACQRVLVDLLVSLMSSRTCSEELTLLLRIFLEKSPCTKILLLGILKIIESDTTMSPSQYLTFPLLHAPNLSNGVSSQKYPGILNSKAMGLLRRARVSRSKKEADRESFPHRLLSSWHIAPVHLPLLGQNCWPHLSEGFSVSLWFNVECIHEAESTTEKGKKIKKRNKSLILPDSSFDGTESDRPEGAEYINPGERLIEEGCIHIISLGSKALMIQVWADPHNATLIFRVCMDSNDDMKAVLLAQVESQENIFLPSKWQHLVLTYLQQPQGKRRIHGKISIWVSGQRKPDVTLDFMLPRKTSLSSDSNKTFCMIGHCLSSQEEFLQLAGKWDLGNLLLFNGAKVGSQEAFYLYACGPNHTSVMPCKYGKPVNDYSKYINKEILRCEQIRELFMTKKDVDIGLLIESLSVVYTTYCPAQYTIYEPVIRLKGQMKTQLSQRPFSSKEVQSILLEPHHLKNLQPTEYKTIQGILHEIGGTGIFVFLFARVVELSSCEETQALALRVILSLIKYNQQRVHELENCNGLSMIHQVLIKQKCIVGFYILKVCLHKIYSYSFICSDTHLVIKVFQ

SEQ ID NO: 837303 - protein, 3801 aa, Homo sapiens
MSTDSNSLAREFLTDVNRLCNAVVQRVEAREEEEEETHMATLGQYLVHGRGFLLLTKLNSIIDQALTCREELLTLLLSLLPLVWKIPVQEEKATDFNLPLSADIILTKEKNSSSQRSTQEKLHLEGSALSSQVSAKVNVFRKSRRQRKITHRYSVRDARKTQLSTSDSEANSDEKGIAMNKHRRPHLLHHFLTSFPKQDHPKAKLDRLATKEQTPPDAMALENSREIIPRQGSNTDILSEPAALSVISNMNNSPFDLCHVLLSLLEKVCKFDVTLNHNSPLAASVVPTLTEFLAGFGDCCSLSDNLESRVVSAGWTEEPVALIQRMLFRTVLHLLSVDVSTAEMMPENLRKNLTELLRAALKIRICLEKQPDPFAPRQKKTLQEVQEDFVFSKYRHRALLLPELLEGVLQILICCLQSAASNPFYFSQAMDLVQEFIQHHGFNLFETAVLQMEWLVLRDGVPPEASEHLKALINSVMKIMSTVKKVKSEQLHHSMCTRKRHRRCEYSHFMHHHRDLSGLLVSAFKNQVSKNPFEETADGDVYYPERCCCIAVCAHQCLRLLQQASLSSTCVQILSGVHNIGICCCMDPKSVIIPLLHAFKLPALKNFQQHILNILNKLILDQLGGAEISPKIKKAACNICTVDSDQLAQLEETLQGNLCDAELSSSLSSPSYRFQGILPSSGSEDLLWKWDALKAYQNFVFEEDRLHSIQIANHICNLIQKGNIVVQWKLYNYIFNPVLQRGVELAHHCQHLSVTSAQSHVCSHHNQCLPQDVLQIYVKTLPILLKSRVIRDLFLSCNGVSQIIELNCLNGIRSHSLKAFETLIISLGEQQKDASVPDIDGIDIEQKELSSVHVGTSFHHQQAYSDSPQSLSKFYAGLKEAYPKRRKTVNQDVHINTINLFLCVAFLCVSKEAESDRESANDSEDTSGYDSTASEPLSHMLPCISLESLVLPSPEHMHQAADIWSMCRWIYMLSSVFQKQFYRLGGFRVCHKLIFMIIQKLFRSHKEEQGKKEGDTSVNENQDLNRISQPKRTMKEDLLSLAIKSDPIPSELGSLKKSADSLGKLELQHISSINVEEVSATEAAPEEAKLFTSQESETSLQSIRLLEALLAICLHGARTSQQKMELELPNQNLSVESILFEMRDHLSQSKVIETQLAKPLFDALLRVALGNYSADFEHNDAMTEKSHQSAEELSSQPGDFSEEAEDSQCCSFKLLVEEEGYEADSESNPEDGETQDDGVDLKSETEGFSASSSPNDLLENLTQGEIIYPEICMLELNLLSASKAKLDVLAHVFESFLKIIRQKEKNVFLLMQQGTVKNLLGGFLSILTQDDSDFQACQRVLVDLLVSLMSSRTCSEELTLLLRIFLEKSPCTKILLLGILKIIESDTTMSPSQYLTFPLLHAPNLSNGVSSQKYPGILNSKAMGLLRRARVSRSKKEADRESFPHRLLSSWHIAPVHLPLLGQNCWPHLSEGFSVSLWFNVECIHEAESTTEKGKKIKKRNKSLILPDSSFDGTESDRPEGAEYINPGERLIEEGCIHIISLGSKALMIQVWADPHNATLIFRVCMDSNDDMKAVLLAQVESQENIFLPSKWQHLVLTYLQQPQGKRRIHGKISIWVSGQRKPDVTLDFMLPRKTSLSSDSNKTFCMIGHCLSSQEEFLQLAGKWDLGNLLLFNGAKVGSQEAFYLYACGPNHTSVMPCKYGKPVNDYSKYINKEILRCEQIRELFMTKKDVDIGLLIESLSVVYTTYCPAQYTIYEPVIRLKGQMKTQLSQRPFSSKEVQSILLEPHHLKNLQPTEYKTIQGILHEIGGTGIFVFLFARVVELSSCEETQALALRVILSLIKYNQQRVHELENCNGLSMIHQVLIKQKCIVGFYILKTLLEGCCGEDIIYMNENGEFKLDVDSNAIIQDVKLLEELLLDWKIWSKAEQGVWETLLAALEVLIRADHHQQMFNIKQLLKAQVVHHFLLTCQVLQEYKEGQLTPMPREVCRSFVKIIAEVLGSPPDLELLTIIFNFLLAVHPPTNTYVCHNPTNFYFSLHIDGKIFQEKVRSIMYLRHSSSGGRSLMSPGFMVISPSGFTASPYEGENSSNIIPQQMAAHMLRSRSLPAFPTSSLLTQSQKLTGSLGCSIDRLQNIADTYVATQSKKQNSLGSSDTLKKGKEDAFISSCESAKTVCEMEAVLSAQVSVSDVPKGVLGFPVVKADHKQLGAEPRSEDDSPGDESCPRRPDYLKGLASFQRSHSTIASLGLAFPSQNGSAAVGRWPSLVDRNTDDWENFAYSLGYEPNYNRTASAHSVTEDCLVPICCGLYELLSGVLLILPDVLLEDVMDKLIQADTLLVLVNHPSPAIQQGVIKLLDAYFARASKEQKDKFLKNRGFSLLANQLYLHRGTQELLECFIEMFFGRHIGLDEEFDLEDVRNMGLFQKWSVIPILGLIETSLYDNILLHNALLLLLQILNSCSKVADMLLDNGLLYVLCNTVAALNGLEKNIPMSEYKLLACDIQQLFIAVTIHACSSSGSQYFRVIEDLIVMLGYLQNSKNKRTQNMAVALQLRVLQAAMEFIRTTANHDSENLTDSLQSPSAPHHAVVQKRKSIAGPRKFPLAQTESLLMKMRSVANDELHVMMQRRMSQENPSQATETELAQRLQRLTVLAVNRIIYQEFNSDIIDILRTPENVTQSKTSVFQTEISEENIHHEQSSVFNPFQKEIFTYLVEGFKVSIGSSKASGSKQQWTKILWSCKETFRMQLGRLLVHILSPAHAAQERKQIFEIVHEPNHQEILRDCLSPSLQHGAKLVLYLSELIHNHQGELTEEELGTAELLMNALKLCGHKCIPPSASTKADLIKMIKEEQKKYETEEGVNKAAWQKTVNNNQQSLFQRLDSKSKDISKIAADITQAVSLSQGNERKKVIQHIRGMYKVDLSASRHWQELIQQLTHDRAVWYDPIYYPTSWQLDPTEGPNRERRRLQRCYLTIPNKYLLRDRQKSEDVVKPPLSYLFEDKTHSSFSSTVKDKAASESIRVNRRCISVAPSRETAGELLLGKCGMYFVEDNASDTVESSSLQGELEPASFSWTYEEIKEVHKRWWQLRDNAVEIFLTNGRTLLLAFDNTKVRDDVYHNILTNNLPNLLEYGNITALTNLWYTGQITNFEYLTHLNKHAGRSFNDLMQYPVFPFILADYVSETLDLNDLLIYRNLSKPIAVQYKEKEDRYVDTYKYLEEEYRKGAREDDPMPPVQPYHYGSHYSNSGTVLHFLVRMPPFTKMFLAYQDQSFDIPDRTFHSTNTTWRLSSFESMTDVKELIPEFFYLPEFLVNREGFDFGVRQNGERVNHVNLPPWARNDPRLFILIHRQALESDYVSQNICQWIDLVFGYKQKGKASVQAINVFHPATYFGMDVSAVEDPVQRRALETMIKTYGQTPRQLFHMAHVSRPGAKLNIEGELPAAVGLLVQFAFRETREQVKEITYPSPLSWIKGLKWGEYVGSPSAPVPVVCFSQPHGERFGSLQALPTRAICGLSRNFCLLMTYSKEQGVRSMNSTDIQWSAILSWGYADNILRLKSKQSEPPVNFIQSSQQYQVTSCAWVPDSCQLFTGSKCGVITAYTNRFTSSTPSEIEMETQIHLYGHTEEITSLFVCKPYSILISVSRDGTCIIWDLNRLCYVQSLAGHKSPVTAVSASETSGDIATVCDSAGGGSDLRLWTVNGDLVGHVHCREIICSVAFSNQPEGVSINVIAGGLENGIVRLWSTWDLKPVREITFPKSNKPIISLTFSCDGHHLYTANSDGTVIAWCRKDQQRLKQPMFYSFLSSYAAG

SEQ ID NO: 837304 - protein, 3729 aa, Homo sapiens; identical to SEQ ID NO: 837295

SEQ ID NO: 837305 - protein, 2047 aa, Homo sapiens
MSTDSNSLAREFLTDVNRLCNAVVQRVEAREEEEEETHMATLGQYLVHGRGFLLLTKLNSIIDQALTCREELLTLLLSLLPLVWKIPVQEEKATDFNLPLSADIILTKEKNSSSQRSTQEKLHLEGSALSSQVSAKVNVFRKSRRQRKITHRYSVRDARKTQLSTSDSEANSDEKGIAMNKHRRPHLLHHFLTSFPKQDHPKAKLDRLATKEQTPPDAMALENSREIIPRQGSNTDILSEPAALSVISNMNNSPFDLCHVLLSLLEKVCKFDVTLNHNSPLAASVVPTLTEFLAGFGDCCSLSDNLESRVVSAGWTEEPVALIQRMLFRTVLHLLSVDVSTAEMMPENLRKNLTELLRAALKIRICLEKQPDPFAPRQKKTLQEVQEDFVFSKYRHRALLLPELLEGVLQILICCLQSAASNPFYFSQAMDLVQEFIQHHGFNLFETAVLQMEWLVLRDGVPPEASEHLKALINSVMKIMSTVKKVKSEQLHHSMCTRKRHRRCEYSHFMHHHRDLSGLLVSAFKNQVSKNPFEETADGDVYYPERCCCIAVCAHQCLRLLQQASLSSTCVQILSGVHNIGICCCMDPKSVIIPLLHAFKLPALKNFQQHILNILNKLILDQLGGAEISPKIKKAACNICTVDSDQLAQLEETLQGNLCDAELSSSLSSPSYRFQGILPSSGSEDLLWKWDALKAYQNFVFEEDRLHSIQIANHICNLIQKGNIVVQWKLYNYIFNPVLQRGVELAHHCQHLSVTSAQSHVCSHHNQCLPQDVLQIYVKTLPILLKSRVIRDLFLSCNGVSQIIELNCLNGIRSHSLKAFETLIISLGEQQKDASVPDIDGIDIEQKELSSVHVGTSFHHQQAYSDSPQSLSKFYAGLKEAYPKRRKTVNQDVHINTINLFLCVAFLCVSKEAESDRESANDSEDTSGYDSTASEPLSHMLPCISLESLVLPSPEHMHQAADIWSMCRWIYMLSSVFQKQFYRLGGFRVCHKLIFMIIQKLFRSHKEEQGKKEGDTSVNENQDLNRISQPKRTMKEDLLSLAIKSDPIPSELGSLKKSADSLGKLELQHISSINVEEVSATEAAPEEAKLFTSQESETSLQSIRLLEALLAICLHGARTSQQKMELELPNQNLSVESILFEMRDHLSQSKVIETQLAKPLFDALLRVALGNYSADFEHNDAMTEKSHQSAEELSSQPGDFSEEAEDSQCCSFKLLVEEEGYEADSESNPEDGETQDDGVDLKSETEGFSASSSPNDLLENLTQGEIIYPEICMLELNLLSASKAKLDVLAHVFESFLKIIRQKEKNVFLLMQQGTVKNLLGGFLSILTQDDSDFQACQRVLVDLLVSLMSSRTCSEELTLLLRIFLEKSPCTKILLLGILKIIESDTTMSPSQYLTFPLLHAPNLSNGVSSQKYPGILNSKAMGLLRRARVSRSKKEADRESFPHRLLSSWHIAPVHLPLLGQNCWPHLSEGFSVSLWFNVECIHEAESTTEKGKKIKKRNKSLILPDSSFDGTESDRPEGAEYINPGERLIEEGCIHIISLGSKALMIQVWADPHNATLIFRVCMDSNDDMKAVLLAQVESQENIFLPSKWQHLVLTYLQQPQGKRRIHGKISIWVSGQRKPDVTLDFMLPRKTSLSSDSNKTFCMIGHCLSSQEEFLQLAGKWDLGNLLLFNGAKVGSQEAFYLYACGPNHTSVMPCKYGKPVNDYSKYINKEILRCEQIRELFMTKKDVDIGLLIESLSVVYTTYCPAQYTIYEPVIRLKGQMKTQLSQRPFSSKEVQSILLEPHHLKNLQPTEYKTIQGILHEIGGTGIFVFLFARVVELSSCEETQALALRVILSLIKYNQQRVHELENCNGLSMIHQVLIKQKCIVGFYILKTLLEGCCGEDIIYMNENGEFKLDVDSNAIIQDVKLLEELLLDWKIWSKAEQGVWETLLAALEVLIRADHHQQMFNIKQLLKAQVVHHFLLTCQVLQEYKEGQLTPMPREVCRSFVKIIAEVLGSPPDLELLTIIFNFLLAVHPPTNTYVCHNPTNFYFSLHIGRYNHFC

SEQ ID NO: 837306 - protein, 1513 aa, Homo sapiens
MSTDSNSLAREFLTDVNRLCNAVVQRVEAREEEEEETHMATLGQYLVHGRGFLLLTKLNSIIDQALTCREELLTLLLSLLPLVWKIPVQEEKATDFNLPLSADIILTKEKNSSSQRSTQEKLHLEGSALSSQVSAKVNVFRKSRRQRKITHRYSVRDARKTQLSTSDSEANSDEKGIAMNKHRRPHLLHHFLTSFPKQDHPKAKLDRLATKEQTPPDAMALENSREIIPRQGSNTDILSEPAALSVISNMNNSPFDLCHVLLSLLEKVCKFDVTLNHNSPLAASVVPTLTEFLAGFGDCCSLSDNLESRVVSAGWTEEPVALIQRMLFRTVLHLLSVDVSTAEMMPENLRKNLTELLRAALKIRICLEKQPDPFAPRQKKTLQEVQEDFVFSKYRHRALLLPELLEGVLQILICCLQSAASNPFYFSQAMDLVQEFIQHHGFNLFETAVLQMEWLVLRDGVPPEASEHLKALINSVMKIMSTVKKVKSEQLHHSMCTRKRHRRCEYSHFMHHHRDLSGLLVSAFKNQVSKNPFEETADGDVYYPERCCCIAVCAHQCLRLLQQASLSSTCVQILSGVHNIGICCCMDPKSVIIPLLHAFKLPALKNFQQHILNILNKLILDQLGGAEISPKIKKAACNICTVDSDQLAQLEETLQGNLCDAELSSSLSSPSYRFQGILPSSGSEDLLWKWDALKAYQNFVFEEDRLHSIQIANHICNLIQKGNIVVQWKLYNYIFNPVLQRGVELAHHCQHLSVTSAQSHVCSHHNQCLPQDVLQIYVKTLPILLKSRVIRDLFLSCNGVSQIIELNCLNGIRSHSLKAFETLIISLGEQQKDASVPDIDGIDIEQKELSSVHVGTSFHHQQAYSDSPQSLSKFYAGLKEAYPKRRKTVNQDVHINTINLFLCVAFLCVSKEAESDRESANDSEDTSGYDSTASEPLSHMLPCISLESLVLPSPEHMHQAADIWSMCRWIYMLSSVFQKQFYRLGGFRVCHKLIFMIIQKLFRSHKEEQGKKEGDTSVNENQDLNRISQPKRTMKEDLLSLAIKSDPIPSELGSLKKSADSLGKLELQHISSINVEEVSATEAAPEEAKLFTSQESETSLQSIRLLEALLAICLHGARTSQQKMELELPNQNLSVESILFEMRDHLSQSKVIETQLAKPLFDALLRVALGNYSADFEHNDAMTEKSHQSAEELSSQPGDFSEEAEDSQCCSFKLLVEEEGYEADSESNPEDGETQDDGVDLKSETEGFSASSSPNDLLENLTQGEIIYPEICMLELNLLSASKAKLDVLAHVFESFLKIIRQKEKNVFLLMQQGTVKNLLGGFLSILTQDDSDFQACQRVLVDLLVSLMSSRTCSEELTLLLRIFLEKSPCTKILLLGILKIIESDTTMSPSQYLTFPLLHAPNLSNGVSSQKYPGILNSKAMGLLRRARVSRSKKEADRESFPHRLLSSWHIAPVHLPLLGQNCWPHLSEGFSVSLWFNVECIHEAESTTYSSPKGKGGLQGNMPEVSWGAR

SEQ ID NO: 837307 - protein, 1815 aa, Homo sapiens
DFFLFFQEYKEGQLTPMPREVCRSFVKIIAEVLGSPPDLELLTIIFNFLLAVHPPTNTYVCHNPTNFYFSLHIDGKIFQEKVRSIMYLRHSSSGGRSLMSPGFMVISPSGFTASPYEGENSSNIIPQQMAAHMLRSRSLPAFPTSSLLTQSQKLTGSLGCSIDRLQNIADTYVATQSKKQNSLGSSDTLKKGKEDAFISSCESAKTVCEMEAVLSAQVSVSDVPKGVLGFPVVKADHKQLGAEPRSEDDSPGDESCPRRPDYLKGLASFQRSHSTIASLGLAFPSQNGSAAVGRWPSLVDRNTDDWENVTEDCLVPICCGLYELLSGVLLILPDVLLEDVMDKLIQADTLLVLVNHPSPAIQQGVIKLLDAYFARASKEQKDKFLKNRGFSLLANQLYLHRGTQELLECFIEMFFGRHIGLDEEFDLEDVRNMGLFQKWSVIPILGLIETSLYDNILLHNALLLLLQILNSCSKVADMLLDNGLLYVLCNTVAALNGLEKNIPMSEYKLLACDIQQLFIAVTIHACSSSGSQYFRVIEDLIVMLGYLQNSKNKRTQNMAVALQLRVLQAAMEFIRTTANHDSENLTDSLQSPSAPHHAVVQKRKSIAGPRKFPLAQTESLLMKMRSVANDELHVMMQRRMSQENPSQATETELAQRLQRLTVLAVNRIIYQEFNSDIIDILRTPENVTQSKTSVFQTEISEENIHHEQSSVFNPFQKEIFTYLVEGFKVSIGSSKASGSKQQWTKILWSCKETFRMQLGRLLVHILSPAHAAQERKQIFEIVHEPNHQEILRDCLSPSLQHGAKLVLYLSELIHNHQGELTEEELGTAELLMNALKLCGHKCIPPSASTKADLIKMIKEEQKKYETEEGVNKAAWQKTVNNNQQSLFQRLDSKSKDISKIAADITQAVSLSQGNERKKVIQHIRGMYKVDLSASRHWQELIQQLTHDRAVWYDPIYYPTSWQLDPTEGPNRERRRLQRCYLTIPNKYLLRDRQKSEDVVKPPLSYLFEDKTHSSFSSTVKDKAASESIRVNRRCISVAPSRETAGELLLGKCGMYFVEDNASDTVESSSLQGELEPASFSWTYEEIKEVHKRWWQLRDNAVEIFLTNGRTLLLAFDNTKVRDDVYHNILTNNLPNLLEYGNITALTNLWYTGQITNFEYLTHLNKHAGRSFNDLMQYPVFPFILADYVSETLDLNDLLIYRNLSKPIAVQYKEKEDRYVDTYKYLEEEYRKGAREDDPMPPVQPYHYGSHYSNSGTVLHFLVRMPPFTKMFLAYQDQSFDIPDRTFHSTNTTWRLSSFESMTDVKELIPEFFYLPEFLVNREGFDFGVRQNGERVNHVNLPPWARNDPRLFILIHRQALESDYVSQNICQWIDLVFGYKQKGKASVQAINVFHPATYFGMDVSAVEDPVQRRALETMIKTYGQTPRQLFHMAHVSRPGAKLNIEGELPAAVGLLVQFAFRETREQVKEITYPSPLSWIKGLKWGEYVGSPSAPVPVVCFSQPHGERFGSLQALPTRAICGLSRNFCLLMTYSKEQGVRSMNSTDIQWSAILSWGYADNILRLKSKQSEPPVNFIQSSQQYQVTSCAWVPDSCQLFTGSKCGVITAYTNRFTSSTPSEIEMETQIHLYGHTEEITSLFVCKPYSILISVSRDGTCIIWDLNRLCYVQSLAGHKSPVTAVSASETSGDIATVCDSAGGGSDLRLWTVNGDLVGHVHCREIICSVAFSNQPEGVSINVIAGGLENGIVRLWSTWDLKPVREITFPKSNKPIISLTFSCDGHHLYTANSDGTVIAWCRKDQQRLKQPMFYSFLSSYAAG

SEQ ID NO: 837308 - protein, 144 aa, Homo sapiens [sequence omitted]

SEQ ID NO: 837309 - protein, 144 aa, Homo sapiens [sequence omitted]

SEQ ID NO: 837310 - protein, 307 aa, Homo sapiens
MTSIKEQAAISRLLSFLQEWDNAGKVARSHILDKFIETNQGKTAPELEQEFSQGASLFLVRLTTSLRITYMTDSCLEKLLRSIGIFLSAVSSNRYLIEFLEVGGVLTLLEILGLEKIKEEAKKESVKLLQVIANSGRTYKELICESYGVRSIAEFLAKSKSEETQEEVQVLLDSLVHGNPKYQNQVYKGLIALLPCESPKAQQLSLQTLRTAQPIIGTTHPSIVDCVLKVLGTMHLEVQYEAIELIKDLVGYDVRQALLKGLVALLIPSVKEISKLQAKILSDPSVLQLTPSLPMFLQQAAAAKAIG

SEQ ID NO: 837311 - protein, 226 aa, Homo sapiens
MSIAEELLYLRVVRGLMAAMGNTDHSNSQRLASLTLECFVQMFPLVAEHVRKCMGEELYQLFLVSAPFLPRRNETDGGSDSVMPLQTVPILERATCRVDLATSCRRDCSGVGSSTRHLPVPFPALSVRLPTRPPPATSLCQAQLQVQTALAPQPGPPCSCPQSNAEDLYMKIDSIQADILAANTVNVTKALCLHGSSYSMNTLYGSRDSAQMAYLTHFEEDVESKE

SEQ ID NO: 837312 - protein, 144 aa, Homo sapiens [sequence omitted]

SEQ ID NO: 837313 - protein, 144 aa, Homo sapiens [sequence omitted]

SEQ ID NO: 837314 - protein, 144 aa, Homo sapiens [sequence omitted]

SEQ ID NO: 837315 - protein, 144 aa, Homo sapiens [sequence omitted]

SEQ ID NO: 837316 - protein, 144 aa, Homo sapiens [sequence omitted]

SEQ ID NO: 837317 - protein, 144 aa, Homo sapiens [sequence omitted]

SEQ ID NO: 837318 - protein, 144 aa, Homo sapiens [sequence omitted]

SEQ ID NO: 837319 - protein, 144 aa, Homo sapiens [sequence omitted]

SEQ ID NO: 837320 - protein, 144 aa, Homo sapiens [sequence omitted]

SEQ ID NO: 837321 - protein, 144 aa, Homo sapiens [sequence omitted]

SEQ ID NO: 837322 - protein, 144 aa, Homo sapiens [sequence omitted]

SEQ ID NO: 837323 - protein, 127 aa, Homo sapiens
MSIAEELLYLRVVRGLMAAMGNTDHSNSQRLASLTLECFVQMFPLVAEHVRKCMGEELYQLFLSNAEDLYMKIDSIQADILAANTVNVTKALCLHGSSYSMNTLYGSRDSAQMAYLTHFEEDVESKE

SEQ ID NO: 837324 - protein, 124 aa, Homo sapiens
PPPPEPASASPEPTSPSPGTCVCLPGTRFRLPGTHFRLPKTRFCLPGTHFRLPKTRFRLPKTRFRLPGTYFRLPKTLFCLPGTGFRLPRTRFRLPGTHFRLPRVCADARPGWVCFPWWHRAALA

SEQ ID NO: 837325 - protein, 108 aa, Homo sapiens
MENFPGWSQTSKLKQSSYPTQPNNHSTYTQHQSTHSQTHTPPTPPQHHTIYPLSQHNPTHTNHPTPLPPPTTTYKPLHSHIIALLNLCLLLITVQLRAKENPYDENHK

SEQ ID NO: 837326 - protein, 113 aa, Homo sapiens
MSTTVTLSLHLWMGSPAWVTRATPSPKKELSAKPRYLPPRGGGISEVFLGPGPKRPRKARERRGRGFGQRCRHRINTVAHGNAPESGDPGSEHRRTKEARTWRAPTNKGGKPA

SEQ ID NO: 837327 - protein, 389 aa, Homo sapiens
MPLENLEEEGLPKNPDLRIAQLRFLLSLPEHRGDAAVRDELMAAVRDNNMAPYYEALCKSLDWQIDVDLLNKMKKANEDELKRLDEELEDAEKNLGESEIRDAMMAKAEYLCRIGDKEGALTAFRKTYDKTVALGHRLDIVFYLLRIGLFYMDNDLITRNTEKAKSLIEEGGDWDRRNRLKVYQGLYCVAIRDFKQAAELFLDTVSTFTSYELMDYKTFVTYTVYVSMIALERPDLREKVIKGAEILEVLHSLPAVRQYLFSLYECRYSVFFQSLAVVEQEMKKDWLFAPHYRYYVREMRIHAYSQLLESYRSLTLGYMAEAFGVGVEFIDQELSRFIAAGRLHCKIDKVNEIVETNRPDSKNWQYQETIKKGDLLLNRVQKLSRVINM

SEQ ID NO: 837328 - protein, 389 aa, Homo sapiens; identical to SEQ ID NO: 837327

SEQ ID NO: 837329 - protein, 332 aa, Homo sapiens [sequence omitted]

SEQ ID NO: 837330 - protein, 442 aa, Homo sapiens
MPLENLEEEGLPKNPDLRIAQLRFLLSLPEHRGDAAVRDELMAAVRDNNFWNRIRQEQTEDCPPSSPSRGWHCQDWPSRKPPTSIRLCFAKPIIKRHRMPSYMAPYYEALCKSLDWQIDVDLLNKMKKANEDELKRLDEELEDAEKNLGESEIRDAMMAKAEYLCRIGDKEGALTAFRKTYDKTVALGHRLDIVFYLLRIGLFYMDNDLITRNTEKAKSLIEEGGDWDRRNRLKVYQGLYCVAIRDFKQAAELFLDTVSTFTSYELMDYKTFVTYTVYVSMIALERPDLREKVIKGAEILEVLHSLPAVRQYLFSLYECRYSVFFQSLAVVEQEMKKDWLFAPHYRYYVREMRIHAYSQLLESYRSLTLGYMAEAFGVGVEFIDQELSRFIAAGRLHCKIDKVNEIVETNRPDSKNWQYQETIKKGDLLLNRVQKLSRVINM

SEQ ID NO: 837331 - protein, 340 aa, Homo sapiens
MAPYYEALCKSLDWQIDVDLLNKMKKANEDELKRLDEELEDAEKNLGESEIRDAMMAKAEYLCRIGDKEGALTAFRKTYDKTVALGHRLDIVFYLLRIGLFYMDNDLITRNTEKAKSLIEEGGDWDRRNRLKVYQGLYCVAIRDFKQAAELFLDTVSTFTSYELMDYKTFVTYTVYVSMIALERPDLREKVIKGAEILEVLHSLPAVRQYLFSLYECRYSVFFQSLAVVEQEMKKDWLFAPHYRYYVREMRIHAYSQLLESYRSLTLGYMAEAFGVGVEFIDQELSRFIAAGRLHCKIDKVNEIVETNRPDSKNWQYQETIKKGDLLLNRVQKLSRVINM

SEQ ID NO: 837332 - protein, 350 aa, Homo sapiens
MPLENLEEEDMAPYYEALCKSLDWQIDVDLLNKMKKANEDELKRLDEELEDAEKNLGESEIRDAMMAKAEYLCRIGDKEGALTAFRKTYDKTVALGHRLDIVFYLLRIGLFYMDNDLITRNTEKAKSLIEEGGDWDRRNRLKVYQGLYCVAIRDFKQAAELFLDTVSTFTSYELMDYKTFVTYTVYVSMIALERPDLREKVIKGAEILEVLHSLPAVRQYLFSLYECRYSVFFQSLAVVEQEMKKDWLFAPHYRYYVREMRIHAYSQLLESYRSLTLGYMAEAFGVGVEFIDQELSRFIAAGRLHCKIDKVNEIVETNRPDSKNWQYQETIKKGDLLLNRVQKLSRVINM

SEQ ID NO: 837333 - protein, 290 aa, Homo sapiens
MPLENLEEEGLPKNPDLRIAQLRFLLSLPEHRGDAAVRDELMAAVRDNNMAPYYEALCKSLDWQIDVDLLNKMKKANEDELKRLDEELEDAEKNLGESEIRDAMMAKAEYLCRIGDKEGALTAFRKTYDKTVALGHRLDIVFYLLRIGLFYMDNDLITRNTEKAKSLIEEGGDWDRRNRLKVYQGLYCVAIRDFKQAAELFLDTVSTFTSYELMDYKTFVTYTVYVSMIALERPDLREKVIKGAEILEVLHSLPAVRQYLFSLYECRYSVFFQSLGNCPGLLLPGDYTAK

SEQ ID NO: 837334 - protein, 134 aa, Homo sapiens
MPLENLEEEGLPKNPDLRIAQLRFLLSLPEHRGDAAVRDELMAAVRDNSEARTSAESAAKAWAVPAFRSLRGLFLMELQTPLTGSQRPGLASPALRVLLWFGDTLGDLDLPQRGLHLSVPPSPVRAAWGRIVRH

SEQ ID NO: 837335 - protein, 389 aa, Homo sapiens; identical to SEQ ID NO: 837327

SEQ ID NO: 837336 - protein, 389 aa, Homo sapiens; identical to SEQ ID NO: 837327

SEQ ID NO: 837337 - protein, 326 aa, Homo sapiens
MPLENLEEEGLPKNPDLRIAQLRFLLSLPEHRGDAAVRDELMAAVRDNNMAPYYEALCKSLDWQIDVDLLNKMKKANEDELKRLDEELEDAEKNLGESEIRDAMMAKAEYLCRIGDKEGALTAFRKTYDKTVALGHRLDIVFYLLRIGLFYMDNDLITRNTEKAKSLIEEGGDWDRRNRLKVYQGLYCVAIRDFKQAAELFLDTVSTFTSYELMDYKTFVTYTVYVSMIALERPDLREKVIKGAEILEVLHSLPAVRQYLFSLYECRYSVFFQSLAVVEQEMKKDWLFAPHYRYYVREMRIHAYSQLLESYRSLTLGYMAEAFGVY

SEQ ID NO: 837338 - protein, 351 aa, Homo sapiens
MNESNDSTNYDMAPYYEALCKSLDWQIDVDLLNKMKKANEDELKRLDEELEDAEKNLGESEIRDAMMAKAEYLCRIGDKEGALTAFRKTYDKTVALGHRLDIVFYLLRIGLFYMDNDLITRNTEKAKSLIEEGGDWDRRNRLKVYQGLYCVAIRDFKQAAELFLDTVSTFTSYELMDYKTFVTYTVYVSMIALERPDLREKVIKGAEILEVLHSLPAVRQYLFSLYECRYSVFFQSLAVVEQEMKKDWLFAPHYRYYVREMRIHAYSQLLESYRSLTLGYMAEAFGVGVEFIDQELSRFIAAGRLHCKIDKVNEIVETNRPDSKNWQYQETIKKGDLLLNRVQKLSRVINM

SEQ ID NO: 837339 - protein, 403 aa, Homo sapiens
MPLENLEEEDFWNRIRQEQTEDCPPSSPSRGWHCQDWPSRKPPTSIRLCFAKPIIKRHRMPSYMAPYYEALCKSLDWQIDVDLLNKMKKANEDELKRLDEELEDAEKNLGESEIRDAMMAKAEYLCRIGDKEGALTAFRKTYDKTVALGHRLDIVFYLLRIGLFYMDNDLITRNTEKAKSLIEEGGDWDRRNRLKVYQGLYCVAIRDFKQAAELFLDTVSTFTSYELMDYKTFVTYTVYVSMIALERPDLREKVIKGAEILEVLHSLPAVRQYLFSLYECRYSVFFQSLAVVEQEMKKDWLFAPHYRYYVREMRIHAYSQLLESYRSLTLGYMAEAFGVGVEFIDQELSRFIAAGRLHCKIDKVNEIVETNRPDSKNWQYQETIKKGDLLLNRVQKLSRVINM

SEQ ID NO: 837340 - protein, 176 aa, Homo sapiens
MPLENLEEEGLPKNPDLRIAQLRFLLSLPEHRGDAAVRDELMAAVRDNNMAPYYEALCKSLDWQIDVDLLNKMKKANEDELKRLDEELEDAEKNLGESEIRDAMMAKAEYLCRIGDKEGALTAFRKTYDKTVALGHRLDIVFYLLRIGLFYMDNDLITRNTEKAKRYFLRVGLYFL

SEQ ID NO: 837341 - protein, 792 aa, Homo sapiens
RREPARPAQPGSDRGGGERVERGEPGEGPRRRDSISRSGHRQRFASRGTGRGHRRPASLQPLACCRASPGPGALGARGLRERDPAGTRGGAAGRGTGSQPALCLGAGRQEGAMALDGIRMPDGCYADGTWELSVHVTDLNRDVTLRVTGEVHIGGVMLKLVEKLDVKKDWSDHALWWEKKRTWLLKTHWTLDKYGIQADAKLQFTPQHKLLRLQLPNMKYVKVKVNFSDRVFKAVSDICKTFNIRHPEELSLLKKPRDPTKKKKKKLDDQSEDEALELEGPLITPGSGSIYSSPGLYSKTMTPTYDAHDGSPLSPTSAWFGDSALSEGNPGILAVSQPITSPEILAKMFKPQALLDKAKINQGWLDSSRSLMEQDVKENEALLLRFKYYSFFDLNPKYDAIRINQLYEQAKWAILLEEIECTEEEMMMFAALQYHINKLSIMTSENHLNNSDKEVDEVDAALSDLEITLEGGKTSTILGDITSIPELADYIKVFKPKKLTLKGYKQYWCTFKDTSISCYKSKEESSGTPAHQMNLRGCEVTPDVNISGQKFNIKLLIPVAEGMNEIWLRCDNEKQYAHWMAACRLASKGKTMADSSYNLEVQNILSFLKMQHLNPDPQLIPEQITTDITPECLVSPRYLKKYKNKQITARILEAHQNVAQMSLIEAKMRFIQAWQSLPEFGITHFIARFQGGKKEELIGIAYNRLIRMDASTGDAIKTWRFSNMKQWNVNWEIKMVTVEFADEVRLSFICTEVDCKVVHEFIGGYIFLSTRAKDQNESLDEEMFYKLTSGWV

SEQ ID NO: 837342 - protein, 575 aa, Homo sapiens [sequence omitted]

SEQ ID NO: 837343 - protein, 799 aa, Homo sapiens
RREPARPAQPGSDRGGGERVERGEPGEGPRRRDSISRSGHRQRFASRGTGRGHRRPASLQPLACCRASPGPGALGARGLRERDPAGTRGGAAGRGTGSQPALCLGAGRQEGAMALDGIRMPDGCYADGTWELSVHVTDLNRDVTLRVTGEVHIGGVMLKLVEKLGEYASQPHVKKDWSDHALWWEKKRTWLLKTHWTLDKYGIQADAKLQFTPQHKLLRLQLPNMKYVKVKVNFSDRVFKAVSDICKTFNIRHPEELSLLKKPRDPTKKKKKKLDDQSEDEALELEGPLITPGSGSIYSSPGLYSKTMTPTYDAHDGSPLSPTSAWFGDSALSEGNPGILAVSQPITSPEILAKMFKPQALLDKAKINQGWLDSSRSLMEQDVKENEALLLRFKYYSFFDLNPKYDAIRINQLYEQAKWAILLEEIECTEEEMMMFAALQYHINKLSIMTSENHLNNSDKEVDEVDAALSDLEITLEGGKTSTILGDITSIPELADYIKVFKPKKLTLKGYKQYWCTFKDTSISCYKSKEESSGTPAHQMNLRGCEVTPDVNISGQKFNIKLLIPVAEGMNEIWLRCDNEKQYAHWMAACRLASKGKTMADSSYNLEVQNILSFLKMQHLNPDPQLIPEQITTDITPECLVSPRYLKKYKNKQITARILEAHQNVAQMSLIEAKMRFIQAWQSLPEFGITHFIARFQGGKKEELIGIAYNRLIRMDASTGDAIKTWRFSNMKQWNVNWEIKMVTVEFADEVRLSFICTEVDCKVVHEFIGGYIFLSTRAKDQNESLDEEMFYKLTSGWV

SEQ ID NO: 837344 - protein, 680 aa, Homo sapiens
MALDGIRMPDGCYADGTWELSVHVTDLNRDVTLRVTGEVHIGGVMLKLVEKLDVKKDWSDHALWWEKKRTWLLKTHWTLDKYGIQADAKLQFTPQHKLLRLQLPNMKYVKVKVNFSDRVFKAVSDICKTFNIRHPEELSLLKKPRDPTKKKKKKLDDQSEDEALELEGPLITPGSGSIYSSPGLYSKTMTPTYDAHDGSPLSPTSAWFGDSALSEGNPGILAVSQPITSPEILAKMFKPQALLDKAKINQGWLDSSRSLMEQDVKENEALLLRFKYYSFFDLNPKYDAIRINQLYEQAKWAILLEEIECTEEEMMMFAALQYHINKLSIMTSENHLNNSDKEVDEVDAALSDLEITLEGGKTSTILGDITSIPELADYIKVFKPKKLTLKGYKQYWCTFKDTSISCYKSKEESSGTPAHQMNLRGCEVTPDVNISGQKFNIKLLIPVAEGMNEIWLRCDNEKQYAHWMAACRLASKGKTMADSSYNLEVQNILSFLKMQHLNPDPQLIPEQITTDITPECLVSPRYLKKYKNKQITARILEAHQNVAQMSLIEAKMRFIQAWQSLPEFGITHFIARFQGGKKEELIGIAYNRLIRMDASTGDAIKTWRFSNMKQWNVNWEIKMVTVEFADEVRLSFICTEVDCKVVHEFIGGYIFLSTRAKDQNESLDEEMFYKLTSGWV

SEQ ID NO: 837345 - protein, 322 aa, Homo sapiens
TESRELGIKAERRKRKRRPKKLTLKGYKQYWCTFKDTSISCYKSKEESSGTPAHQMNLRGCEVTPDVNISGQKFNIKLLIPVAEGMNEIWLRCDNEKQYAHWMAACRLASKGKTMADSSYNLEVQNILSFLKMQHLNPDPQLIPEQITTDITPECLVSPRYLKKYKNKQPGYIRDLITARILEAHQNVAQMSLIEAKMRFIQAWQSLPEFGITHFIARFQGGKKEELIGIAYNRLIRMDASTGDAIKTWRFSNMKQWNVNWEIKMVTVEFADEVRLSFICTEVDCKVVHEFIGGYIFLSTRAKDQNESLDEEMFYKLTSGWV

SEQ ID NO: 837346 - protein, 554 aa, Homo sapiens
MALDGIRMPDGCYADGTWELSVHVTDLNRDVTLRVTGEVHIGGVMLKLVEKLDVKKDWSDHALWWEKKRTWLLKTHWTLDKYGIQADAKLQFTPQHKLLRLQLPNMKYVKVKVNFSDRVFKAVSDICKTFNIRHPEELSLLKKPRDPTKKKKKKLDDQSEDEALELEGPLITPGSGSIYSSPGLYSKTMTPTYDAHDGSPLSPTSAWFGDSALSEGNPGILAVSQPITSPEILAKMFKPQALLDKAKINQGWLDSSRSLMEQDVKENEALLLRFKYYSFFDLNPKYDAIRINQLYEQAKWAILLEEIECTEEEMMMFAALQYHINKLSIMTSENHLNNSDKEVDEVDAALSDLEITLEGGKTSTILGDITSIPELADYIKVFKPKKLTLKGYKQYWCTFKDTSISCYKSKEESSGTPAHQMNLRGCEVTPDVNISGQKFNIKLLIPVAEGMNEIWLRCDNEKQYAHWMAACRLASKGKTMADSSYNLEVQNILSFLKMQHLNPDPQLIPEQITTDITPECLVSPRYLKKYKNKQPGYIRDLVSSPYLPQKKKNK

SEQ ID NO: 837347 - protein, 552 aa, Homo sapiens
MALDGIRMPDGCYADGTWELSVHVTDLNRDVTLRVTGEVHIGGVMLKLVEKLDVKKDWSDHALWWEKKRTWLLKTHWTLDKYGIQADAKLQFTPQHKLLRLQLPNMKYVKVKVNFSDRVFKAVSDICKTFNIRHPEELSLLKKPRDPTKKKKKKLDDQSEDEALELEGPLITPGSGSIYSSPGLYSKTMTPTYDAHDGSPLSPTSAWFGDSALSEGNPGILAVSQPITSPEILAKMFKPQALLDKAKINQGWLDSSRSLMEQDVKENEALLLRFKYYSFFDLNPKYDAIRINQLYEQAKWAILLEEIECTEEEMMMFAALQYHINKLSIMTSENHLNNSDKEVDEVDAALSDLEITLEGGKTSTILGDITSIPELADYIKVFKPKKLTLKGYKQYWCTFKDTSISCYKSKEESSGTPAHQMNLRGCEVTPDVNISGQKFNIKLLIPVAEGMNEIWLRCDNEKQYAHWMAACRLASKGKTMADSSYNLEVQNILSFLKMQHLNPDPQLIPEQITTDITPECLVSPPFAWFKYLWIVIIGHSSSGGQTWKWLGD

SEQ ID NO: 837348 - protein, 680 aa, Homo sapiens; identical to SEQ ID NO: 837344

SEQ ID NO: 837349 - protein, 575 aa, Homo sapiens [sequence omitted]

SEQ ID NO: 837350 - protein, 687 aa, Homo sapiens
MALDGIRMPDGCYADGTWELSVHVTDLNRDVTLRVTGEVHIGGVMLKLVEKLDVKKDWSDHALWWEKKRTWLLKTHWTLDKYGIQADAKLQFTPQHKLLRLQLPNMKYVKVKVNFSDRVFKAVSDICKTFNIRHPEELSLLKKPRDPTKKKKKKLDDQSEDEALELEGPLITPGSGSIYSSPGLYSKTMTPTYDAHDGSPLSPTSAWFGDSALSEGNPGILAVSQPITSPEILAKMFKPQALLDKAKINQGWLDSSRSLMEQDVKENEALLLRFKYYSFFDLNPKYDAIRINQLYEQAKWAILLEEIECTEEEMMMFAALQYHINKLSIMTSENHLNNSDKEVDEVDAALSDLEITLEGGKTSTILGDITSIPELADYIKVFKPKKLTLKGYKQYWCTFKDTSISCYKSKEESSGTPAHQMNLRGCEVTPDVNISGQKFNIKLLIPVAEGMNEIWLRCDNEKQYAHWMAACRLASKGKTMADSSYNLEVQNILSFLKMQHLNPDPQLIPEQITTDITPECLVSPRYLKKYKNKQPGYIRDLITARILEAHQNVAQMSLIEAKMRFIQAWQSLPEFGITHFIARFQGGKKEELIGIAYNRLIRMDASTGDAIKTWRFSNMKQWNVNWEIKMVTVEFADEVRLSFICTEVDCKVVHEFIGGYIFLSTRAKDQNESLDEEMFYKLTSGWV

SEQ ID NO: 837351 - protein, 165 aa, Homo sapiens
EADLRIPKHRNLKKYKNKQITARILEAHQNVAQMSLIEAKMRFIQAWQSLPEFGITHFIARFQGGKKEELIGIAYNRLIRMDASTGDAIKTWRFSNMKQWNVNWEIKMVTVEFADEVRLSFICTEVDCKVVHEFIGGYIFLSTRAKDQNESLDEEMFYKLTSGWV

SEQ ID NO: 837352 - protein, 554 aa, Homo sapiens; identical to SEQ ID NO: 837346

SEQ ID NO: 837353 - protein, 199 aa, Homo sapiens
MALDGIRMPDGCYADGTWELSVHVTDLNRDVTLRVTGEVHIGGVMLKLVEKLDVKKDWSDHALWWEKKRTWLLKTHWTLDKYGIQADAKLQFTPQHKLLRLQLPNMKYVKVKVNFSDRVFKAVSDICKTFNIRHPEELSLLKKPRDPTKKKKKKLDDQSEDEALELEGPLITPGSGSIYSAPELYVTMTPTERARILRS

SEQ ID NO: 837354 - protein, 218 aa, Homo sapiens
MSQTAMSETYDFLFKFLVIGNAGTGKSCLLHQFIEKKFKDDSNHTIGVEFGSKIINVGGKYVKLQIWDTAGQERFRSVTRSYYRGAAGALLVYDITSRETYNALTNWLTDARMLASQNIVIILCGNKKDLDADREVTFLEASRFAQENELMFLETSALTGENVEEAFVQCARKILNKIESGELDPERMGSGIQYGDAALRQLRSPRRAQAPNAQECGC

SEQ ID NO: 837355 - protein, 218 aa, Homo sapiens; identical to SEQ ID NO: 837354

SEQ ID NO: 837356 - protein, 243 aa, Homo sapiens
MSQTAMSETYENSYRFFCLTFFALTLRNCTEPGPTLFWPLPFPPRFLPFRTTQHLFPHGLTFQSSLPTSDAAHFGFKSIINVGGKYVKLQIWDTAGQERFRSVTRSYYRGAAGALLVYDITSRETYNALTNWLTDARMLASQNIVIILCGNKKDLDADREVTFLEASRFAQENELMFLETSALTGENVEEAFVQCARKILNKIESGELDPERMGSGIQYGDAALRQLRSPRRAQAPNAQECGC

SEQ ID NO: 837357 - protein, 113 aa, Homo sapiens
MISPDARMLASQNIVIILCGNKKDLDADREVTFLEASRFAQENELMFLETSALTGENVEEAFVQCARKILNKIESGELDPERMGSGIQYGDAALRQLRSPRRAQAPNAQECGC

SEQ ID NO: 837358 - protein, 218 aa, Homo sapiens; identical to SEQ ID NO: 837354

SEQ ID NO: 837359 - protein, 125 aa, Homo sapiens
MSQTAMSETYDFLFKFLVIGNAGTGKSCLLHQFIEKKFKDDSNHTIGVEFGSKIINVGGKYVKLQIWDTAGQERFSRASVITSRDGPAFDCGYVDGKVSIAQDWRTGGLYILAELHTLSGAEEKT

SEQ ID NO: 837360 - protein, 218 aa, Homo sapiens; identical to SEQ ID NO: 837354

SEQ ID NO: 837361 - protein, 218 aa, Homo sapiens; identical to SEQ ID NO: 837354

SEQ ID NO: 837362 - protein, 121 aa, Homo sapiens
MSQTAMSETYDFLFKFLVIGNAGTGKSCLLHQFIEKKFKDDSNHTIGVEFGSKIINVGGKYVKLQIWDTAGQERFRSVTRSYYRGAAGALLVYDITRCPNASEPEHCDHPLWKQEGPGCRS

SEQ ID NO: 837363 - protein, 211 aa, Homo sapiens
MSQTAMSETYDFLFKFLVIGNAGTGKSCLLHQFIEKKFKDDSNHTIGVEFGSKIINVGGKYVKLQIWDTAGQERFRSVTRSYYRGAAGALLVYDITSRETYNALTNWLTDARMLASQNIVIILCGNKKDLDADREVTFLEASRFAQENELMFLETSALTGENVEEAFVQCARKILNKIESGVHTVAFGTQSLEPEESEVFFTTIFFYSVWK

SEQ ID NO: 837364 - protein, 139 aa, Homo sapiens
PVRTRERGVGRASRSPSPLPPRGRGRTEGGGPCACAELESGWAAAAGRPAVAVGTGRAPPSSGPPPQVLPHRDAPADRGRVQPVTRREAAPLPRCRRRPCPKPTIFCLSSWLLEMQELANLAYFISLLKKNSKMTQIIQ

SEQ ID NO: 837365 - protein, 380 aa, Homo sapiens [sequence omitted]

SEQ ID NO: 837366 - protein, 362 aa, Homo sapiens
MGTKGKVIKCKAAIAWEAGKPLCIEEVEVAPPKAHEVRIQIIATSLCHTDATVIDSKFEGLAFPVIVGHEAAGIVESIGPGVTNVKPGDKVIPLYAPLCRKCKFCLSPLTNLCGKISNLKSPASDQQLMEDKTSRFTCKGKPVYHFFGTSTFSQYTVVSDINLASTGYGAAINNAKVTPGSTCAVFGLGGVGLSAVMGCKAAGASRIIGIDINSEKFVKAKALGATDCLNPRDLHKPIQEVIIELTKGGVDFALDCAGGSETMKAALDCTTAGWGSCTFIGVAAGSKGLTVFPEELIIGRTINGTFFGGWKSVDSIPKLVTDYKNKKFNLDALVTHTLPFDKISEAFDLMNQGKSIRTILIF

SEQ ID NO: 837367 - protein, 356 aa, Homo sapiens
MGTKGKVIKCKAAIAWEAGKPLCIEEVEVAPPKAHEVRIQIIATSLCHTDATVIDSKFEGLAFPVIVGHEAAGIVESIGPGVTNVKPGDKVIPLYAPLCRKCKFCLSPLTNLCGKISNLKSPASDQQLMEDKTSRFTCKGKPVYHFFGTSTFSQYTVVSDINLASTGYGAAINNAKVTPGSTCAVFGLGGVGLSAVMGCKAAGASRIIGIDINSEKFVKAKALGATDCLNPRDLHKPIQEVIIELTKGGVDFALDCAGGSETMKAALDCTTAGWGSCTFIGVAAGSKGLTVFPEELIIGRTINGTFFGGWKSVDSIPKLVTDYKNKKFNLDALVTHTLPFDKISEAFDLMNQGKSI

SEQ ID NO: 837368 - protein, 362 aa, Homo sapiens; identical to SEQ ID NO: 837366

SEQ ID NO: 837369 - protein, 374 aa, Homo sapiens
MGTKGKVIKCKAAIAWEAGKPLCIEEVEVAPPKAHEVRIQIIATSLCHTDATVIDSKFEGLAFPVIVGHEAAGIVESIGPGVTNVKPGDKVIPLYAPLCRKCKFCLSPLTNLCGKISNLKSPASDQQLMEDKTSRFTCKGKPVYHFFGTSTFSQYTVVSDINLAKIDDDANLERVCLLGCGFSTGYGAAINNAKVTPGSTCAVFGLGGVGLSAVMGCKAAGASRIIGIDINSEKFVKAKALGATDCLNPRDLHKPIQEVIIELTKGGVDFALDCAGGSETMKAALDCTTAGWGSCTFIGVAAGSKGLTVFPEELIIGRTINGTFFGGWKSVDSIPKLVTDYKNKKFNLDALVTHTLPFDKISEAFDLMNQGKSI

SEQ ID NO: 837370 - protein, 285 aa, Homo sapiens
MGTKGKVIKCKAAIAWEAGKPLCIEEVEVAPPKAHEVRIQIIATSLCHTDATVIDSKFEGLAFPVIVGHEAAGIVESIGPGVTNVKPGDKVIPLYAPLCRKCKFCLSPLTNLCGKISNLKSPASDQQLMEDKTSRFTCKGKPVYHFFGTSTFSQYTVVSDINLAKIDDDANLERVCLLGCGFSTGYGAAINNAKVTPGSTCAVFGLGGVGLSAVMGCKAAGASRIIGIDINSEKFVKAKALGATDCLNPRDLHKPIQEVIIELTKGGVDFALDCAGGSETMVGKV

SEQ ID NO: 837371 - protein, 365 aa, Homo sapiens
SLFLFFLSFVIKCKAAIAWEAGKPLCIEEVEVAPPKAHEVRIQIIATSLCHTDATVIDSKFEGLAFPVIVGHEAAGIVESIGPGVTNVKPGDKVIPLYAPLCRKCKFCLSPLTNLCGKISNLKSPASDQQLMEDKTSRFTCKGKPVYHFFGTSTFSQYTVVSDINLASTGYGAAINNAKVTPGSTCAVFGLGGVGLSAVMGCKAAGASRIIGIDINSEKFVKAKALGATDCLNPRDLHKPIQEVIIELTKGGVDFALDCAGGSETMKAALDCTTAGWGSCTFIGVAAGSKGLTVFPEELIIGRTINGTFFGGWKSVDSIPKLVTDYKNKKFNLDALVTHTLPFDKISEAFDLMNQGKSIRTILIF

SEQ ID NO: 837372 - protein, 381 aa, Homo sapiens
MLVRGPHFELQRCKTHLFSSNYLTQVIKCKAAIAWEAGKPLCIEEVEVAPPKAHEVRIQIIATSLCHTDATVIDSKFEGLAFPVIVGHEAAGIVESIGPGVTNVKPGDKVIPLYAPLCRKCKFCLSPLTNLCGKISNLKSPASDQQLMEDKTSRFTCKGKPVYHFFGTSTFSQYTVVSDINLASTGYGAAINNAKVTPGSTCAVFGLGGVGLSAVMGCKAAGASRIIGIDINSEKFVKAKALGATDCLNPRDLHKPIQEVIIELTKGGVDFALDCAGGSETMKAALDCTTAGWGSCTFIGVAAGSKGLTVFPEELIIGRTINGTFFGGWKSVDSIPKLVTDYKNKKFNLDALVTHTLPFDKISEAFDLMNQGKSIRTILIF

SEQ ID NO: 837373 - protein, 362 aa, Homo sapiens; identical to SEQ ID NO: 837366

SEQ ID NO: 837374 - protein, 267 aa, Homo sapiens
MGTKGKVIKCKAAIAWEAGKPLCIEEVEVAPPKAHEVRIQIIATSLCHTDATVIDSKFEGLAFPVIVGHEAAGIVESIGPGVTNVKPGDKVIPLYAPLCRKCKFCLSPLTNLCGKISNLKSPASDQQLMEDKTSRFTCKGKPVYHFFGTSTFSQYTVVSDINLASTGYGAAINNAKVTPGSTCAVFGLGGVGLSAVMGCKAAGASRIIGIDINSEKFVKAKALGATDCLNPRDLHKPIQEVIIELTKGGVDFALDCAGGSETMVGKV

SEQ ID NO: 837375 - protein, 146 aa, Homo sapiens
MGTKGKVIKCKAAIAWEAGKPLCIEEVEVAPPKAHEVRIQIIATSLCHTDATVIDSKFEGLAFPVIVGHEAAGIVESIGPGVTNVKPGDKVIPLYAPLCRKCKFCLSPLTNLCGKISNLKSPASDQQLMEDKTIHCGVRYQSCQNR

SEQ ID NO: 837376 - protein, 155 aa, Homo sapiens
MGTKGKVIKCKAAIAWEAGKPLCIEEVEVAPPKAHEVRIQIIATSLCHTDATVIDSKFEGLAFPVIVGHEAAGIVESIGPGVTNVKPGDKVIPLYAPLCRKCKFCLSPLTNLCGKISNLKSPASDQQLMEDKTKSSPGLYNRRLGIMYFHWSSCW

SEQ ID NO: 837377 - protein, 150 aa, Homo sapiens
MGTKGKVIKCKAAIAWEAGKPLCIEEVEVAPPKAHEVRIQIIATSLCHTDATVIDSKFEGLAFPVIVGHEAAGIVESIGPGVTNVKPGDKVIPLYAPLCRKCKFCLSPLTNLCGKIRQVYLQRKTSLPFLWNQYILSVHCGVRYQSCQNR

SEQ ID NO: 837378 - protein, 155 aa, Homo sapiens; identical to SEQ ID NO: 837376

SEQ ID NO: 837379 - protein, 470 aa, Homo sapiens
RASKCPHPVCPLSCQHRGLIHPQSSAVGGDAMTPILTVLICLGLSLDPRTHVQAGPLPKPTLWAEPGSVITQGSPVTLRCQGSLETQEYHLYREKKTALWITRIPQELVKKGQFPILSITWEHAGRYCCIYGSHTAGLSESSDPLELVVTGAYSKPTLSALPSPVVTSGGNVTIQCDSQVAFDGFILCKEGEDEHPQCLNSHSHARGSSRAIFSVGPVSPSRRWSYRCYGYDSRAPYVWSLPSDLLGLLVPGVSKKPSLSVQPGPVVAPGEKLTFQCGSDAGYDRFVLYKEWGRDFLQRPGRQPQAGLSQANFTLGPVSRSYGGQYTCSGAYNLSSEWSAPSDPLDILITGQIRARPFLSVRPGPTVASGENVTLLCQSQGGMHTFLLTKEGAADSPLRLKSKRQSHKYQAEFPMSPVTSAHAGTYRCYGSLSSNPYLLTHPSDPLELVVSGAAETLSPPQNKSDSKAGE

SEQ ID NO: 837380 - protein, 406 aa, Homo sapiens
RASKCPHPVCPLSCQHRGLIHPQSSAVGGDAMTPILTVLICLGLSLDPRTHVQAGPLPKPTLWAEPGSVITQGSPVTLRCQGSLETQEYHLYREKKTALWITRIPQELVKKGQFPILSITWEHAGRYCCIYGSHTAGLSESSDPLELVVTGAYSKPTLSALPSPVVTSGGNVTIQCDSQVAFDGFILCVSKKPSLSVQPGPVVAPGEKLTFQCGSDAGYDRFVLYKEWGRDFLQRPGRQPQAGLSQANFTLGPVSRSYGGQYTCSGAYNLSSEWSAPSDPLDILITGQIRARPFLSVRPGPTVASGENVTLLCQSQGGMHTFLLTKEGAADSPLRLKSKRQSHKYQAEFPMSPVTSAHAGTYRCYGSLSSNPYLLTHPSDPLELVVSGAAETLSPPQNKSDSKAGE

SEQ ID NO: 837381 - protein, 163 aa, Homo sapiens
MIKCSHLRGFQAGVQKLKAELLDIAMENQTLNETLGSLSDAVVGLTYSQLESLSPEAVHGAISTLNQVSGWAKSQVIILSAKYLAHEKVLSFYNVSQMGALLAGVSTQAFCSMKRKDISQVLRSAVSQYVFRLVTCPAARYPQQDGPSGRHCPRHRGDTRGFL

SEQ ID NO: 837382 - protein, 166 aa, Homo sapiens
MLLILLSVALLAFSSAQDLDEDVSQEDVPLVISDGGDSEQFIDEERQGPPLGGQQSQPSAGDGNQNDGPQQGPPQQGGQQQQGPPPPQGKPQGPPQQGGHPPPPQGRPQGPPQQGGHPRPPRGRPQGPPQQGGHQQGPPPPPPGKPQGPPPQGGRPQGPPQGQSPQ

SEQ ID NO: 837383 - protein, 166 aa, Homo sapiens; identical to SEQ ID NO: 837382

SEQ ID NO: 837384 - protein, 117 aa, Homo sapiens
LCLVPQHRPSAGDGNQNDGPQQGPPQQGGQQQQGPPPPQGKPQGPPQQGGHPPPPQGRPQGPPQQGGHPRPPRGRPQGPPQQGGHQQGPPPPPPGKPQGPPPQGGRPQGPPQGQSPQ

SEQ ID NO: 837385 - protein, 127 aa, Homo sapiens
VGDSEDPKHDPLLVMGTRMMALSRDHPNKEASSNKVHHLLRESHKDHPNREAIPLLLKEGHKDHPNREAIPVLLEEGHKDHPNREAISKVLPHLLLESPRDHLPKGAAHKDLHRGSLLSNLGFNDRK

SEQ ID NO: 837386 - protein, 247 aa, Homo sapiens
MLLILLSVALLALSSAESSSEDVSQEESLFLISGKPEGRRPQGGNQPQRPPPPPGKPQGPPPQGGNQSQGPPPPPGKPEGRPPQGGNQSQGPPPHPGKPERPPPQGGNQSQGTPPPPGKPERPPPQGGNQSHRPPPPPGKPERPPPQGGNQSQGPPPHPGKPEGPPPQEGNKSRSARSPPGKPQGPPQQEGNKPQGPPPPGKPQGPPPAGGNPQQPQDPPAGKPQGPPPPPQGGRPPRPAQGQQPPQ

SEQ ID NO: 837387 - protein, 111 aa, Homo sapiens
MLLILLSVALLAFSSAQDLDEDVSQEDVPLVISDGGDSEQFIDEERQGPPLGGQQSQPSAGDGNQNDGPQQGPPQQGGQQQQGPPPPQGKPQGRSGGSGCSTVSRQSCQRV

SEQ ID NO: 837388 - protein, 109 aa, Homo sapiens
MRSVRDHLWEDSNLNPLLVMGTRMMALSRDHPNKEASSNKVHHLLRESHKPQGPPQQGGHPRPPRGRPQGPPQQGGHQQGPPPPPPGKPQGPPPQGGRPQGPPQGQSPQ

SEQ ID NO: 837389 - protein, 76 aa, Homo sapiens
MLLILLSVALLAFSSAQDLDEDVSQEDVPLVISDGGDSEQFIDEERQGPPLGGQQSQTLLLLASLLGWSLLRAIIL

SEQ ID NO: 837390 - protein, 127 aa, Homo sapiens; identical to SEQ ID NO: 837385

SEQ ID NO: 837391 - protein, 166 aa, Homo sapiens; identical to SEQ ID NO: 837382

SEQ ID NO: 837392 - protein, 166 aa, Homo sapiens; identical to SEQ ID NO: 837382

SEQ ID NO: 837393 - protein, 129 aa, Homo sapiens
GRIPGGDGEFLDPLLVMGTRMMALSRDHPNKEASSNKVHHLLRESHKDHPNREAIPLLLKEGHKDHPNREAIPVLLEEGHKDHPNREAISKVLPHLLLESPRDHLPKGAAHKDLHRGSLLSNLGFNDRK

SEQ ID NO: 837394 - protein, 153 aa, Homo sapiens
MLLILLSVALLAFSSAQDLDEDVSQEDVPLVISDGGDSEQFIDEERQGPPLGGQQSQPSAGDGNQNDGPQQGPPQQGGQQQQGPPPPQGKPQATRTTPTGRPSPSSSRKATRTTPTGRPSARSSPTSSWKAPGTTSPRGPPTRTSTGAVSSVI

SEQ ID NO: 837395 - protein, 126 aa, Homo sapiens
MLLILLSVALLAFSSAQDLDEDVSQEDVPLVISDGGDSEQFIDEERQGPPLGGQQSQPSAGDGNQNDGPQQGPPQQGGQQQQGGLISSSHHPLSVPRACQPQGHNPTSCSPNTHTGFVNSLRGSRT

SEQ ID NO: 837396 - protein, 163 aa, Homo sapiens
MSPVLSGIHSIYSAWVTSVNITDCKPPSISGAAHQGPTAPGRMVRILANGEIVQDDDPRVRTTTQPPRGSIPRQSFFNRGHGAPPGGPGPRQQQAGARLGAAQSPFNDLNRQLVNMGFPQWHLGNHAVEPVTSILLLFLLMMLGVRGLLLVGLVYLVSHLSQR

SEQ ID NO: 837397 - protein, 177 aa, Homo sapiens
VGGNRLEPPGVDAAEARSRACRHSIYSAWVTSVNITDCKPPSISGAAHQGPTAPGRMVRILANGEIVQDDDPRVRTTTQPPRGSIPRQSFFNRGHGAPPGGPGPRQQQAGARLGAAQSPFNDLNRQLVNMGFPQWHLGNHAVEPVTSILLLFLLMMLGVRGLLLVGLVYLVSHLSQR

SEQ ID NO: 837398 - protein, 177 aa, Homo sapiens; identical to SEQ ID NO: 837397

SEQ ID NO: 837399 - protein, 177 aa, Homo sapiens; identical to SEQ ID NO: 837397

SEQ ID NO: 837400 - protein, 121 aa, Homo sapiens
MVRILANGEIVQDDDPRVRTTTQPPRGSIPRQSFFNRGHGAPPGGPGPRQQQAGARLGAAQSPFNDLNRQLVNMGFPQWHLGNHAVEPVTSILLLFLLMMLGVRGLLLVGLVYLVSHLSQR

SEQ ID NO: 837401 - protein, 208 aa, Homo sapiens
MLGLLVALLALGLAVFALLDVWYLVRLPCAVLRARLLQPRVRDLLAEQRFPGRVLPSDLDLLLHMNNARYLREADFARVAHLTRCGVLGALRELRAHTVLAASCARHRRSLRLLEPFEVRTRLLGWDDRAFYLEARFVSLRDGFVCALLRFRQHLLGTSPERVVQHLCQRRVEPPELPADLQHWISYNEASSQLLRMESGLSDVTKDQ

SEQ ID NO: 837402 - protein, 208 aa, Homo sapiens; identical to SEQ ID NO: 837401

SEQ ID NO: 837403 - protein, 155 aa, Homo sapiens
MLGLLVALLALGLAVFALLDVWYLVRLPCAVLRARLLQPRVRDLLAEQRFPGRVLPSDLDLLLHMNNARYLREADFARVAHLTRCGVLGALRELRAHTVLAASCARHRRSLRLLEPFEVEPPELPADLQHWISYNEASSQLLRMESGLSDVTKDQ

SEQ ID NO: 837404 - protein, 208 aa, Homo sapiens; identical to SEQ ID NO: 837401

SEQ ID NO: 837405 - protein, 208 aa, Homo sapiens; identical to SEQ ID NO: 837401

SEQ ID NO: 837406 - protein, 208 aa, Homo sapiens; identical to SEQ ID NO: 837401

SEQ ID NO: 837407 - protein, 208 aa, Homo sapiens; identical to SEQ ID NO: 837401

SEQ ID NO: 837408 - protein, 204 aa, Homo sapiens
MLGLLVALLALGLAVFALLDVWYLVRLPCAVLRARLLQPRVRDLLAEQRFPGRVLPSDLDLLLHMNNARYLREADFARVAHLTRCGVLGALRELRAHTVLAASCARHRRSLRLLEPFEVRTRLLGWDDRAFYLEARFVSLRDGFVCALLRFRQHLLGTSPERVVQHLCQRRTDSHSVAQAGVQWRDLGSLQPPPSGFTPFSCFS

SEQ ID NO: 837409 - protein, 179 aa, Homo sapiens
MSTGSLSDVEDLQEVEMLECDGLKMDSNKEFVTSNESTEESSNCENGSPQKGRGGLGKRRKAPTKKSPLSGVSQEGKQVQRNAANARERARMRVLSKAFSRLKTTLPWVPPDTKLSKLDTLRLASSYIAHLRQILANDKYENGYIHPVNLTWPFMVAGKPESDLKEVVTASRLCGTTAS

SEQ ID NO: 837410 - protein, 109 aa, Homo sapiens
RLWEWGNREPVPLLQKSSGFLLTTLRRGKGCETQPDPNSSSQQEVAAPHSGGLLVSGSLCLSLTLFLAFSVSLPREHFTTTRRFVSKPEEINCTYKDSHLFNFINFYRE

SEQ ID NO: 837411 - protein, 99 aa, Homo sapiens
MWNHRVLTLEVRVWERRAPGGSGPREGDPCPQCSLSLLPPRNAPLSVPPRENTLQRRGDSFPNQRRSIVLTKIPIYLTLLTSTVNDSASLAGPSAICNY

SEQ ID NO: 837412 - protein, 179 aa, Homo sapiens; identical to SEQ ID NO: 837409

SEQ ID NO: 837413 - protein, 108 aa, Homo sapiens
RLWEWGNREPVPLLQKSSGFLLTTLRRGKGCETQPDPNSSSQQEVAAPHSGGLLVSGSLCLSLTLFLAFSVSLSLSLSLPRPLPQTCPPAPSAMWRTFKRWRCWNVTG

SEQ ID NO: 837414 - protein, 111 aa, Homo sapiens
MSTGSLSDVEDLQEVEMLECDGLKMDSNKEFVTSNESTEESSNCENGSPQKGRGGLGKRRKATPALSALCLCFPLAMLLSLSHPARTLYNDEEIRFQTRGDQLYLQRFPSI

SEQ ID NO: 837415 - protein, 457 aa, Homo sapiens
RRGHAFSGPQRGLGSRVFKSALVAAAVLTPVLGGQTGEMAAEVLPSARWQYCGAPDGSQRAVLVQFSNGKLQSPGNMRFTLYENKDSTNPRKRNQRILAAETDRLSYVGNNFGTGALKCNTLCRHFVGILNKTSGQMEVYDAELFNMQPLFSDVSVESELALESQTKTYREKMDSCIEAFGTTKQKRALNTRRMNRVGNESLNRAVAKAAETIIDTKGVTALVSDAIHNDLQDDSLYLPPCYDDAAKPEDVYKFEDLLSPAEYEALQSPSEAFRNVTSEEILKMIEENSHCTFVIEALKSLPSDVESRDRQARCIWFLDTLIKFRAHRVVKRKSALGPGVPHIINTKLLKHFTCLTYNNGRLRNLISDSMKAKITAYVIILALHIHDFQIDLTVLQRDLKLSEKRMMEIAKAMRLKISKRRVSVAAGSEEDHKLGTLSLPLPPAQTSDRLAKRRKIT

SEQ ID NO: 837416 - protein, 457 aa, Homo sapiens; identical to SEQ ID NO: 837415

SEQ ID NO: 837417 - protein, 457 aa, Homo sapiens; identical to SEQ ID NO: 837415

SEQ ID NO: 837418 - protein, 105 aa, Homo sapiens
SPLLPLFSRLRNLISDSMKAKITAYVIILALHIHDFQIDLTVLQRDLKLSEKRMMEIAKAMRLKISKRRVSVAAGSEEDHKLGTLSLPLPPAQTSDRLAKRRKIT

SEQ ID NO: 837419 - protein, 190 aa, Homo sapiens
MVQQDVQGLKAQSAGLSISQHLLSGCHGNIIPNPTTLSSRETAIIRRDLGFPRGSWASFLKRLLLSSATRNTRPAHPQHLCGDEGQSPTVPLPVLMRKGGKKTYPERLQYGHDTFKKPVLWSHDQKPECGEGQQPASEQPARRGVVNLGLVPRHDWLRAQCSTLWNVPWASVAFLSFAGRGLLPLWQLVS

SEQ ID NO: 837420 - protein, 190 aa, Homo sapiens; identical to SEQ ID NO: 837419

SEQ ID NO: 837421 - protein, 210 aa, Homo sapiens
EVGPGGRGLSVGLRSQGSSTPEHPRTCAQGSHKRFIGLSLGDSLQASGGDTSMERLWGLFQRAQQLSPRSSQTVYQRVEGPRKGHLEEEEEDGEEGAETLAHFCPMELRGPEPLGSRPRQPNLIPWAAAGRRAAPYLVLTALLIFTGAFLLGYVAFRGSCQACGDSVLVVSEDVNYEPDLDFHQGRLYWSDLQAMFLQFLGEGRLEDTIR

SEQ ID NO: 837422 - protein, 949 aa, Homo sapiens
EVGPGGRGLSVGLRSQGSSTPEHPRTCAQGGGRRGAVERLAGESTAPCALAWTRGPRLEGWTEARTVPPPLGVVRSSLGSGCLPGLIRGPPEGSHKRFIGLSLGDSLQASGGDTSMERLWGLFQRAQQLSPRSSQTVYQRVEGPRKGHLEEEEEDGEEGAETLAHFCPMELRGPEPLGSRPRQPNLIPWAAAGRRAAPYLVLTALLIFTGAFLLGYVAFRGSCQACGDSVLVVSEDVNYEPDLDFHQGRLYWSDLQAMFLQFLGEGRLEDTIRQTSLRERVAGSAGMAALTQDIRAALSRQKLDHVWTDTHYVGLQFPDPAHPNTLHWVDEAGKVGEQLPLEDPDVYCPYSAIGNVTGELVYAHYGRPEDLQDLRARGVDPVGRLLLVRVGVISFAQKVTNAQDFGAQGVLIYPEPADFSQDPPKPSLSSQQAVYGHVHLGTGDPYTPGFPSFNQTQFPPVASSGLPSIPAQPISADIASRLLRLECSGAILAHCNLHLPGSSDSSASDSRVSEDYRKLKGPVAPQEWQGSLLGSPYHLGPGPRLRLVVNNHRTSTPINNIFGCIEGRSEPDHYVVIGAQRDAWGPGAAKSAVGTAILLELVRTFSSMVSNGFRPRRSLLFISWDGGDFGSVGSTEWLEGYLSVLHLKAVVYVSLDNAVLGDDKFHAKTSPLLTSLIESVLKQVDSPNHSGQTLYEQVVFTNPSWDAEVIRPLPMDSSAYSFTAFVGVPAVEFSFMEDDQAYPFLHTKEDTYENLHKVLQGRLPAVAQAVAQLAGQLLIRLSHDRLLPLDFGRYGDVVLRHIGNLNEFSGDLKARGLTLQWVYSARGDYIRAAEKLRQEIYSSEERDERLTRMYNVRIMRVEFYFLSQYVSPADSPFRHIFMGRGDHTLGALLDHLRLLRSNSSGTPGATSSTGFQESRFRRQLALLTWTLQGAANALSGDVWNIDNNF

SEQ ID NO: 837423 - protein, 895 aa, Homo sapiens
EVGPGGRGLSVGLRSQGSSTPEHPRTCAQGGGRRGAVERLAGESTAPCALAWTRGPRLEGWTEARTVPPPLGVVRSSLGSGCLPGLIRGPPEGSHKRFIGLSLGDSLQASGGDTSMERLWGLFQRAQQLSPRSSQTVYQRVEGPRKGHLEEEEEDGEEGAETLAHFCPMELRGPEPLGSRPRQPNLIPWAAAGRRAAPYLVLTALLIFTGAFLLGYVAFRGSCQACGDSVLVVSEDVNYEPDLDFHQGRLYWSDLQAMFLQFLGEGRLEDTIRQTSLRERVAGSAGMAALTQDIRAALSRQKLDHVWTDTHYVGLQFPDPAHPNTLHWVDEAGKVGEQLPLEDPDVYCPYSAIGNVTGELVYAHYGRPEDLQDLRARGVDPVGRLLLVRVGVISFAQKVTNAQDFGAQGVLIYPEPADFSQDPPKPSLSSQQAVYGHVHLGTGDPYTPGFPSFNQTQKLKGPVAPQEWQGSLLGSPYHLGPGPRLRLVVNNHRTSTPINNIFGCIEGRSEPDHYVVIGAQRDAWGPGAAKSAVGTAILLELVRTFSSMVSNGFRPRRSLLFISWDGGDFGSVGSTEWLEGYLSVLHLKAVVYVSLDNAVLGDDKFHAKTSPLLTSLIESVLKQVDSPNHSGQTLYEQVVFTNPSWDAEVIRPLPMDSSAYSFTAFVGVPAVEFSFMEDDQAYPFLHTKEDTYENLHKVLQGRLPAVAQAVAQLAGQLLIRLSHDRLLPLDFGRYGDVVLRHIGNLNEFSGDLKARGLTLQWVYSARGDYIRAAEKLRQEIYSSEERDERLTRMYNVRIMRIPLSAQVEFYFLSQYVSPADSPFRHIFMGRGDHTLGALLDHLRLLRSNSSGTPGATSSTGFQESRFRRQLALLTWTLQGAANALSGDVWNIDNNF

SEQ ID NO: 837424 - protein, 847 aa, Homo sapiens
EVGPGGRGLSVGLRSQGSSTPEHPRTCAQGGGRRGAVERLAGESTAPCALAWTRGPRLEGWTEARTVPPPLGVVRSSLGSGCLPGLIRGPPEGSHKRFIGLSLGDSLQASGGDTSMERLWGLFQRAQQLSPRSSQTVYQRVEGPRKGHLEEEEEDGEEGAETLAHFCPMELRGPEPLGSRPRQPNLIPWAAAGRRAAPYLVLTALLIFTGAFLLGYVAFRGSCQACGDSVLVVSEDVNYEPDLDFHQGRLYWSDLQAMFLQFLGEGRLEDTIRQTSLRERVAGSAGMAALTQDIRAALSRQKLDHVWTDTHYVGLQFPDPAHPNTLHWVDEAGKVGEQLPLEDPDVYCPYSAIGNVTGELVYAHYGRPEDLQDLRARGVDPVGRLLLVRVGVISFAQKEAQRPCGPPRMAGEPPRLPYHLGPGPRLRLVVNNHRTSTPINNIFGCIEGRSEPGFRPRRSLLFISWDGGDFGSVGSTEWLEVIRGPGQVVRHWGEVGVGGSHSTLVTHPQGYLSVLHLKAVVYVSLDNAVLGDDKFHAKTSPLLTSLIESVLKQVDSPNHSGQTLYEQVVFTNPSWDAEVIRPLPMDSSAYSFTAFVGVPAVEFSFMEVRRPPPAPDTAQSFSLSASAPASTLSWQDDQAYPFLHTKEDTYENLHKVLQGRLPAVAQAVAQLAGQLLIRLSHDRLLPLDFGRYGDVVLRHIGNLNEFSGDLKARGLTLQWVYSARGDYIRAAEKLRQEIYSSEERDERLTRMYNVRIMRVEFYFLSQYVSPADSPFRHIFMGRGDHTLGALLDHLRLLRSNSSGTPGATSSTGFQESRFRRQLALLTWTLQGAANALSGDVWNIDNNF

SEQ ID NO: 837425 - protein, 858 aa, Homo sapiens
EVGPGGRGLSVGLRSQGSSTPEHPRTCAQGGGRRGAVERLAGESTAPCALAWTRGPRLEGWTEARTVPPPLGVVRSSLGSGCLPGLIRGPPEGSHKRFIGLSLGDSLQASGGDTSMERLWGLFQRAQQLSPRSSQTVYQRVEGPRKGHLEEEEEDGEEGAETLAHFCPMELRGPEPLGSRPRQPNLIPWAAAGRRAAPYLVLTALLIFTGAFLLGYVAFRGSCQACGDSVLVVSEDVNYEPDLDFHQGRLYWSDLQAMFLQFLGEGRLEDTIRQTSLRERVAGSAGMAALTQDIRAALSRQKLDHVWTDTHYVGLQFPDPAHPNTLHWVDEAGKVGEQLPLEDPDVYCPYSAIGNVTGELVYAHYGRPEDLQDLRARGVDPVGRLLLVRVGVISFAQKEAQRPCGPPRMAGEPPRLPLSPGPRATTAASGQQSQDLHPHQQHLRLHRRPLRARYYVVIGAQRDAWGPGAAKSAVGTAILLELVRTFSSMVSNGFRPRRSLLFISWDGGDFGSVGSTEWLEGYLSVLHLKAVVYVSLDNAVLGDDKFHAKTSPLLTSLIESVLKQVDSPNHSGQTLYEQVVFTNPSWDAEVIRPLPMDSSAYSFTAFVGVPAVEFSFMEVRRPPPAPDTALVLQPVCLRPSVHPVLQDDQAYPFLHTKEDTYENLHKVLQGRLPAVAQAVAQLAGQLLIRLSHDRLLPLDFGRYGDVVLRHIGNLNEFSGDLKARGLTLQWVYSARGDYIRAAEKLRQEIYSSEERDERLTRMYNVRIMRVEFYFLSQYVSPADSPFRHIFMGRGDHTLGALLDHLRLLRSNSSGTPGATSSTGFQESRFRRQLALLTWTLQGAANALSGDVWNIDNNF

SEQ ID NO: 837426 - protein, 642 aa, Homo sapiens
MDSCKQRPCHFLVSPALMNRVFFWEESSSHLPPQVTNAQDFGAQGVLIYPEPADFSQDPPKPSLSSQQAVYGHVHLGTGDPYTPGFPSFNQTQFPPVASSGLPSIPAQPISADIASRLLRLECSGAILAHCNLHLPGSSDSSASDSRVSEDYRKLKGPVAPQEWQGSLLGSPYHLGPGPRLRLVVNNHRTSTPINNIFGCIEGRSEPDHYVVIGAQRDAWGPGAAKSAVGTAILLELVRTFSSMVSNGFRPRRSLLFISWDGGDFGSVGSTEWLEVIRGPGQVVRHWGEVGVGGSHSTLVTHPQGYLSVLHLKAVVYVSLDNAVLGDDKFHAKTSPLLTSLIESVLKQVDSPNHSGQTLYEQVVFTNPSWDAEVIRPLPMDSSAYSFTAFVGVPAVEFSFMEVRRPPPAPDTALSFSLSASAPASTLSWQDDQAYPFLHTKEDTYENLHKVLQGRLPAVAQAVAQLAGQLLIRLSHDRLLPLDFGRYGDVVLRHIGNLNEFSGDLKARGLTLQWVYSARGDYIRAAEKLRQEIYSSEERDERLTRMYNVRIMRVEFYFLSQYVSPADSPFRHIFMGRGDHTLGALLDHLRLLRSNSSGTPGATSSTGFQESRFRRQLALLTWTLQGAANALSGDVWNIDNNF

SEQ ID NO: 837427 - protein, 493 aa, Homo sapiens
RARAGGARGGGRGSGRSPAPLPRAHPNTLHWVDEAGKVGEQLPLEDPDVYCPYSAIGNVTGELVYAHYGRPEDLQDLRARGVDPVGRLLLVRVGVISFAQKEAQRPCGPPRMAGEPPRLPLSPGPRARLRLVVNNHRTSTPINNIFGCIEGRSEPGFRPRRSLLFISWDGGDFGSVGSTEWLEGYLSVLHLKAVVYVSLDNAVLGDDKFHAKTSPLLTSLIESVLKQVDSPNHSGQTLYEQVVFTNPSWDAEVIRPLPMDSSAYSFTAFVGVPAVEFSFMEDDQAYPFLHTKEDTYENLHKVLQGRLPAVAQAVAQLAGQLLIRLSHDRLLPLDFGRYGDVVLRHIGNLNEFSGDLKARGLTLQWVYSARGDYIRAAEKLRQEIYSSEERDERLTRMYNVRIMRVEFYFLSQYVSPADSPFRHIFMGRGDHTLGALLDHLRLLRSNSSGTPGATSSTGFQESRFRRQLALLTWTLQGAANALSGDVWNIDNNF

SEQ ID NO: 837428 - protein, 480 aa, Homo sapiens
EVGPGGRGLSVGLRSQGSSTPEHPRTCAQGGGRRGAVERLAGESTAPCALAWTRGPRLEGWTEARTVPPPLGVVRSSLGSGCLPGLIRGPPEGSHKRFIGLSLGDSLQASGGDTSMERLWGLFQRAQQLSPRSSQTVYQRVEGPRKGHLEEEEEDGEEGAETLAHFCPMELRGPEPLGSRPRQPNLIPWAAAGRRAAPYLVLTALLIFTGAFLLGYVAFRGSCQACGDSVLVVSEDVNYEPDLDFHQGRLYWSDLQAMFLQFLGEGRLEDTIRQTSLRERVAGSAGMAALTQDIRAALSRQKLDHVWTDTHYVGLQFPDPAHPNTLHWVDEAGKVGEQLPLEDPDVYCPYSAIGNVTGELVYAHYGRPEDLQDLRARGVDPVGRLLLVRVGVISFAQKVTNAQDFGAQGVLIYPEPADFSQDPPKPSLSSQQAVYGHVHLGTGDPYTPGFPSFNQTQFPPVASSGLPSIPRPALWSLKKK

SEQ ID NO: 837429 - protein, 418 aa, Homo sapiens
EVGPGGRGLSVGLRSQGSSTPEHPRTCAQGGGRRGAVERLAGESTAPCALAWTRGPRLEGWTEARTVPPPLGVVRSSLGSGCLPGLIRGPPEGSHKRFIGLSLGDSLQASGGDTSMERLWGLFQRAQQLSPRSSQTVYQRVEGPRKGHLEEEEEDGEEGAETLAHFCPMELRGPEPLGSRPRQPNLIPWAAAGRRAAPYLVLTALLIFTGAFLLGYVAFRGSCQACGDSVLVVSEDVNYEPDLDFHQGRLYWSDLQAMFLQFLGEGRLEDTIRQTSLRERVAGSAGMAALTQDIRAALSRQKLDHVWTDTHYVGLQFPDPAHPNTLHWVDEAGKVGEQLPLEDPDVYCPYSAIGNVTGELVYAHYGRPEDLQDLRARGVDPVGRLLLVRVGVISFAQKVSVPGQREGLSPGTGGSDCQ

SEQ ID NO: 837430 - protein, 44 aa, Homo sapiens
MAGEPPRLPLSPGPRATTAASGQQSQDLHPHQQHLRLHRRPLRA

SEQ ID NO: 837431 - protein, 801 aa, Homo sapiens
MERLWGLFQRAQQLSPRSSQTVYQRVEGPRKGHLEEEEEDGEEGAETLAHFCPMELRGPEPLGSRPRQPNLIPWAAAGRRAAPYLVLTALLIFTGAFLLGYVAFRGSCQACGDSVLVVSEDVNYEPDLDFHQGRLYWSDLQAMFLQFLGEGRLEDTIRQTSLRERVAGSAGMAALTQDIRAALSRQKLDHVWTDTHYVGLQFPDPAHPNTLHWVDEAGKVGEQLPLEDPDVYCPYSAIGNVTGELVYAHYGRPEDLQDLRARGVDPVGRLLLVRVGVISFAQKVTNAQDFGAQGVLIYPEPADFSQDPPKPSLSSQQAVYGHVHLGTGDPYTPGFPSFNQTQFPPVASSGLPSIPAQPISADIASRLLRKLKGPVAPQEWQGSLLGSPYHLGPGPRLRLVVNNHRTSTPINNIFGCIEGRSEPDHYVVIGAQRDAWGPGAAKSAVGTAILLELVRTFSSMVSNGFRPRRSLLFISWDGGDFGSVGSTEWLEGYLSVLHLKAVVYVSLDNAVLGDDKFHAKTSPLLTSLIESVLKQVDSPNHSGQTLYEQVVFTNPSWDAEVIRPLPMDSSAYSFTAFVGVPAVEFSFMEDDQAYPFLHTKEDTYENLHKVLQGRLPAVAQAVAQLAGQLLIRLSHDRLLPLDFGRYGDVVLRHIGNLNEFSGDLKARGLTLQWVYSARGDYIRAAEKLRQEIYSSEERDERLTRMYNVRIMRVEFYFLSQYVSPADSPFRHIFMGRGDHTLGALLDHLRLLRSNSSGTPGATSSTGFQESRFRRQLALLTWTLQGAANALSGDVWNIDNNF

SEQ ID NO: 837432 - protein, 1006 aa, Homo sapiens
EVGPGGRGLSVGLRSQGSSTPEHPRTCAQGGGRRGAVERLAGESTAPCALAWTRGPRLEGWTEARTVPPPLGVVRSSLGSGCLPGLIRGPPEGSHKRFIGLSLGDSLQASGGDTSMERLWGLFQRAQQLSPRSSQTVYQRVEGPRKGHLEEEEEDGEEGAETLAHFCPMELRGPEPLGSRPRQPNLIPWAAAGRRAAPYLVLTALLIFTGAFLLGYVAFRGSCQACGDSVLVVSEDVNYEPDLDFHQGRLYWSDLQAMFLQFLGEGRLEDTIRQTSLRERVAGSAGMAALTQDIRAALSRQKLDHVWTDTHYVGLQFPDPAHPNTLHWVDEAGKVGEQLPLEDPDVYCPYSAIGNVTGELVYAHYGRPEDLQDLRARGVDPVGRLLLVRVGVISFAQKVTNAQDFGAQGVLIYPEPADFSQDPPKPSLSSQQAVYGHVHLGTGDPYTPGFPSFNQTQFPPVASSGLPSIPAQPISADIASRLLRLECSGAILAHCNLHLPGSSDSSASDSRVSEDYRKLKGPVAPQEWQGSLLGSPYHLGPGPRLRLVVNNHRTSTPINNIFGCIEGRSEPDHYVVIGAQRDAWGPGAAKSAVGTAILLELVRTFSSMVSNGFRPRRSLLFISWDGGDFGSVGSTEWLEVIRGPGQVVRHWGEVGVGGSHSTLVTHPQGYLSVLHLKAVVYVSLDNAVLGDDKFHAKTSPLLTSLIESVLKQVDSPNHSGQTLYEQVVFTNPSWDAEVIRPLPMDSSAYSFTAFVGVPAVEFSFMEVRRPPPAPDTALVLQPVCLRPSVHPVLEDDQAYPFLHTKEDTYENLHKVLQGRLPAVAQAVAQLAGQLLIRLSHDRLLPLDFGRYGDVVLRHIGNLNEFSGDLKARGLTLQWVYSARGDYIRAAEKLRQEIYSSEERDERLTRMYNVRIMRVEFYFLSQYVSPADSPFRHIFMGRGDHTLGALLDHLRLLRSNSSGTPGATSSTGFQESRFRRQLALLTWTLQGAANALSGDVWNIDNNF

SEQ ID NO: 837433 - protein, 676 aa, Homo sapiens
AARAGGARGGGRGSGRSPAPLPRAHPNTLHWVDEAGKVGEQLPLEDPDVYCPYSAIGNVTGELVYAHYGRPEDLQDLRARGVDPVGRLLLVRVGVISFAQKVTNAQDFGAQGVLIYPEPADFSQDPPKPSLSSQQAVYGHVHLGTGDPYTPGFPSFNQTQFPPVASSGLPSIPAQPISADIASRLLRKLKGPVAPQEWQGSLLGSPYHLGPGPRLRLVVNNHRTSTPINNIFGCIEGRSEPDHYVVIGAQRDAWGPGAAKSAVGTAILLELVRTFSSMVSNGFRPRRSLLFISWDGGDFGSVGSTEWLEVIRGPGQVVRHWGEVGVGGSHSTLVTHPQGYLSVLHLKAVVYVSLDNAVLGDDKFHAKTSPLLTSLIESVLKQVDSPNHSGQTLYEQVVFTNPSWDAEVIRPLPMDSSAYSFTAFVGVPAVEFSFMEVRRPPPAPDTALVLQPVCLRPSVHPVLEDDQAYPFLHTKEDTYENLHKVLQGRLPAVAQAVAQLAGQLLIRLSHDRLLPLDFGRYGDVVLRHIGNLNEFSGDLKARGLTLQWVYSARGDYIRAAEKLRQEIYSSEERDERLTRMYNVRIMRVEFYFLSQYVSPADSPFRHIFMGRGDHTLGALLDHLRLLRSNSSGTPGATSSTGFQESRFRRQLALLTWTLQGAANALSGDVWNIDNNF

SEQ ID NO: 837434 - protein, 505 aa, Homo sapiens
AVPRSRGHTFLLRIGLACFSFFLEAQLAALRGHPFPCRCTWELETPTHLASLPSIKPSSLQLHHQAFPASHAQPISADIASRLLRKLKGPVAPQEWQGSLLGSPYHLGPGPRLRLVVNNHRTSTPINNIFGCIEGRSEPGFRPRRSLLFISWDGGDFGSVGSTEWLEGYLSVLHLKAVVYVSLDNAVLGDDKFHAKTSPLLTSLIESVLKQVDSPNHSGQTLYEQVVFTNPSWDAEVIRPLPMDSSAYSFTAFVGVPAVEFSFMEVRRPPPAPDTALSFSLSASAPASTLSWQDDQAYPFLHTKEDTYENLHKVLQGRLPAVAQAVAQLAGQLLIRLSHDRLLPLDFGRYGDVVLRHIGNLNEFSGDLKARGLTLQWVYSARGDYIRAAEKLRQEIYSSEERDERLTRMYNVRIMRVEFYFLSQYVSPADSPFRHIFMGRGDHTLGALLDHLRLLRSNSSGTPGATSSTGFQESRFRRQLALLTWTLQGAANALSGDVWNIDNNF

SEQ ID NO: 837435 - protein, 1006 aa, Homo sapiens; identical to SEQ ID NO: 837432

SEQ ID NO: 837436 - protein, 107 aa, Homo sapiens
ARLDYIRAAGMYNVRIMRVEFYFLSQYVSPADSPFRHIFMGRGDHTLGALLDHLRLLRSNSSGTPGATSSTGFQESRFRRQLALLTWTLQGAANALSGDVWNIDNNF

SEQ ID NO: 837437 - protein, 138 aa, Homo sapiens
METVVIVAIGVLATIFLASFAALVLVCRQRYCRPRDLLQRYDSKPIVDLIGAMETQSEPSELELDDVVITNPHIEAILENEDWIEDASGLMSHCIAILKICHTLTEKLVAMTMGSGAKMKTSASVSDIIVVAKRISPR

SEQ ID NO: 837438 - protein, 226 aa, Homo sapiens
METVVIVAIGVLATIFLASFAALVLVCRQRYCRPRDLLQRYDSKPIVDLIGAMETQSEPSELELDDVVITNPHIEAILENEDWIEDASGLMSHCIAILKICHTLTEKLVAMTMGSGAKMKTSASVSDIIVVAKRISPRVDDVVKSMYPPLDPKLLDARTTALLLSVSHLVLVTRNACHLTGGLDWIDQSLSAAEEHLEVLREAALASEPDKGLPGPEGFLQEQSAI

SEQ ID NO: 837439 - protein, 226 aa, Homo sapiens; identical to SEQ ID NO: 837438

SEQ ID NO: 837440 - protein, 209 aa, Homo sapiens
GTSANRKMVCRQRYCRPRDLLQRYDSKPIVDLIGAMETQSEPSELELDDVVITNPHIEAILENEDWIEDASGLMSHCIAILKICHTLTEKLVAMTMGSGAKMKTSASVSDIIVVAKRISPRVDDVVKSMYPPLDPKLLDARTTALLLSVSHLVLVTRNACHLTGGLDWIDQSLSAAEEHLEVLREAALASEPDKGLPGPEGFLQEQSAI

SEQ ID NO: 837441 - protein, 206 aa, Homo sapiens
METVVIVAIGVLATIFLASFAALVLVCRQRYCRPRDLLQRYDSKPIVDLIGAMETQSEPSELELDDVVITNPHIEAILENEDWIEDASGLMSHCIAILKICHTLTEKLVAMTMGSGAKMKTSASVSDIIVVAKRISPRTTALLLSVSHLVLVTRNACHLTGGLDWIDQSLSAAEEHLEVLREAALASEPDKGLPGPEGFLQEQSAI

SEQ ID NO: 837442 - protein, 226 aa, Homo sapiens; identical to SEQ ID NO: 837438

SEQ ID NO: 837443 - protein, 226 aa, Homo sapiens; identical to SEQ ID NO: 837438

SEQ ID NO: 837444 - protein, 226 aa, Homo sapiens; identical to SEQ ID NO: 837438

SEQ ID NO: 837445 - protein, 226 aa, Homo sapiens; identical to SEQ ID NO: 837438

SEQ ID NO: 837446 - protein, 156 aa, Homo sapiens
SSCNRTRLSVCRPDGPPRGREEGVLGRQARLPAAPAAGGPGGDGGAWRRGFGAGRGPGAGARGREAGFLGPRRFPACSAAGPRPRPDLTTALLLSVSHLVLVTRNACHLTGGLDWIDQSLSAAEEHLEVLREAALASEPDKGLPGPEGFLQEQSAI

SEQ ID NO: 837447 - protein, 1883 aa, Homo sapiens
RCPPRPHPPNPRARPRTVPARPRAAAPSPSGSPGAEGASPPRGRSRTGAQQQPRLAGRGRKRMAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTGCGWKFEPLLGEELDCGASRGGCPRSSSPRVGQQRALLRRRGPHGPPDDGGAGGKGGSLPRSATPGPPGEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGPTLGAQHLEAGGSLTRHVTQEFVSRTLTTSGTLSTHMDQQFFQT

SEQ ID NO: 837448 - protein, 1826 aa, Homo sapiens
RCPPRPHPPNPRARPRTVPARPRAAAPSPSGSPGAEGASPPRGRSRTGAQQQPRLAGRGRKRMAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENVRTQELGLAEMWLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGPTLGAQHLEAGGSLTRHVTQEFVSRTLTTSGTLSTHMDQQFFQT

SEQ ID NO: 837449 - protein, 1866 aa, Homo sapiens
RCPPRPHPPNPRARPRTVPARPRAAAPSPSGSPGAEGASPPRGRSRTGAQQQPRLAGRGRKRMAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENVRTQELGLAEMWLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRTEFRSVAQLECNGTISAHRNLHLSGSSDSAASASLVAGIQDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGPTLGAQHLEAGGSLTRHVTQEFVSRTLTTSGTLSTHMDQQFFQT

SEQ ID NO: 837450 - protein, 1826 aa, Homo sapiens; identical to SEQ ID NO: 837448

SEQ ID NO: 837451 - protein, 1826 aa, Homo sapiens; identical to SEQ ID NO: 837448

SEQ ID NO: 837452 - protein, 734 aa, Homo sapiens
MTLASAPSHDPDPDPLHSQDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGPTLGAQHLEAGGSLTRHVTQEFVSRTLTTSGTLSTHMDQQFFQT

SEQ ID NO: 837453 - protein, 1762 aa, Homo sapiens
RCPPRPHPPNPRARPRTVPARPRAAAPSPSGSPGAEGASPPRGRSRTGAQQQPRLAGRGRKRMAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENVRTQELGLAEMWLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLEQSCGLYGNGVEL

SEQ ID NO: 837454 - protein, 1645 aa, Homo sapiens
RCPPRPHPPNPRARPRTVPARPRAAAPSPSGSPGAEGASPPRGRSRTGAQQQPRLAGRGRKRMAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENVRTQELGLAEMWLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPAHPHAQSRG

SEQ ID NO: 837455 - protein, 481 aa, Homo sapiens
RHDRSSRYRTGDAVENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGPTLGAQHLEAGGSLTRHVTQEFVSRTLTTSGTLSTHMDQQFFQT

SEQ ID NO: 837456 - protein, 1568 aa, Homo sapiens
RCPPRPHPPNPRARPRTVPARPRAAAPSPSGSPGAEGASPPRGRSRTGAQQQPRLAGRGRKRMAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENVRTQELGLAEMWLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCVGPTLGHAPYS

SEQ ID NO: 837457 - protein, 1387 aa, Homo sapiens
RCPPRPHPPNPRARPRTVPARPRAAAPSPSGSPGAEGASPPRGRSRTGAQQQPRLAGRGRKRMAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENVRTQELGLAEMWLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPETTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGPTLGAQHLEAGGSLTRHVTQEFVSRTLTTSGTLSTHMDQQFFQT

SEQ ID NO: 837458 - protein, 1375 aa, Homo sapiens
RCPPRPHPPNPRARPRTVPARPRAAAPSPSGSPGAEGASPPRGRSRTGAQQQPRLAGRGRKRMAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPETTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGPTLGAQHLEAGGSLTRHVTQEFVSRTLTTSGTLSTHMDQQFFQT

SEQ ID NO: 837459 - protein, 376 aa, Homo sapiens
MDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGPTLGAQHLEAGGSLTRHVTQEFVSRTLTTSGTLSTHMDQQFFQT

SEQ ID NO: 837460 - protein, 380 aa, Homo sapiens
PWHRNDHDQGAAAPMGTPNPWKAPPNNQLAPPHPGRYVLNATSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGPTLGAQHLEAGGSLTRHVTQEFVSRTLTTSGTLSTHMDQQFFQT

SEQ ID NO: 837461 - protein, 259 aa, Homo sapiens
YRRRLLCELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGPTLGAQHLEAGGSLTRHVTQEFVSRTLTTSGTLSTHMDQQFFQT

SEQ ID NO: 837462 - protein, 424 aa, Homo sapiens
RCPPRPHPPNPRARPRTVPARPRAAAPSPSGSPGAEGASPPRGRSRTGAQQQPRLAGRGRKRMAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSGSAPTWTSGP

SEQ ID NO: 837463 - protein, 309 aa, Homo sapiens
RCPPRPHPPNPRARPRTVPARPRAAAPSPSGSPGAEGASPPRGRSRTGAQQQPRLAGRGRKRMAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISAQLLHPCTPGGPAHPHAQSRG

SEQ ID NO: 837464 - protein, 1814 aa, Homo sapiens
RCPPRPHPPNPRARPRTVPARPRAAAPSPSGSPGAEGASPPRGRSRTGAQQQPRLAGRGRKRMAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGPTLGAQHLEAGGSLTRHVTQEFVSRTLTTSGTLSTHMDQQFFQT

SEQ ID NO: 837465 - protein, 132 aa, Homo sapiens
GQTHRQAECKSRVTAISPCKATRSRERAEEVVVRCSFRDEDDDCTYSYTMEGDGAPGPNSTVLVHKKKDCPPGSFWWLIPLLLLLLPLLALLLLLCWKYCACCKACLALLPCCNRGHMVGQNISCILKSQLA

SEQ ID NO: 837466 - protein, 1867 aa, Homo sapiens
RCPPRPHPPNPRARPRTVPARPRAAAPSPSGSPGAEGASPPRGRSRTGAQQQPRLAGRGRKRMAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHGLPPIWEHGRSRLPLSWALGSRSRAQMKGFPPSRGPRDSIILAGRPAAPSWGPDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGPTLGAQHLEAGGSLTRHVTQEFVSRTLTTSGTLSTHMDQQFFQT

SEQ ID NO: 837467 - protein, 1802 aa, Homo sapiens
RCPPRPHPPNPRARPRTVPARPRAAAPSPSGSPGAEGASPPRGRSRTGAQQQPRLAGRGRKRMAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPGLLTGGAAGGLRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGPTLGAQHLEAGGSLTRHVTQEFVSRTLTTSGTLSTHMDQQFFQT

SEQ ID NO: 837468 - protein, 1116 aa, Homo sapiens
GQTHRQAECKSRVTAISPCKATRSRERAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGPTLGAQHLEAGGSLTRHVTQEFVSRTLTTSGTLSTHMDQQFFQT

SEQ ID NO: 837469 - protein, 1730 aa, Homo sapiens
RCPPRPHPPNPRARPRTVPARPRAAAPSPSGSPGAEGASPPRGRSRTGAQQQPRLAGRGRKRMAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENVRTQELGLAEMWLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESSATPSLHPWGPSPPACTEQGLGVSWEA

SEQ ID NO: 837470 - protein, 502 aa, Homo sapiens
PSRTVISPVLEGRQGPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGPTLGAQHLEAGGSLTRHVTQEFVSRTLTTSGTLSTHMDQQFFQT

SEQ ID NO: 837471 - protein, 1287 aa, Homo sapiens
RCPPRPHPPNPRARPRTVPARPRAAAPSPSGSPGAEGASPPRGRSRTGAQQQPRLAGRGRKRMAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENVRTQELGLAEMWLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDDQCCCLWHPPEPTRAPPRAKHILHPHTGLQLTDPLRTLTLDHTAQGLLHPHLRLLPRLSPDCWCARHAHPPGVLCPGAHISQSELAGAAVRAAAAGLQCGVPAAERR

SEQ ID NO: 837472 - protein, 1525 aa, Homo sapiens
RCPPRPHPPNPRARPRTVPARPRAAAPSPSGSPGAEGASPPRGRSRTGAQQQPRLAGRGRKRMAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENVRTQELGLAEMWLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHGE

SEQ ID NO: 837473 - protein, 376 aa, Homo sapiens; identical to SEQ ID NO: 837459

SEQ ID NO: 837474 - protein, 433 aa, Homo sapiens
MKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGPTLGAQHLEAGGSLTRHVTQEFVSRTLTTSGTLSTHMDQQFFQT

SEQ ID NO: 837475 - protein, 335 aa, Homo sapiens [sequence omitted]

SEQ ID NO: 837476 - protein, 773 aa, Homo sapiens
RCPPRPHPPNPRARPRTVPARPRAAAPSPSGSPGAEGASPPRGRSRTGAQQQPRLAGRGRKRMAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAHGPTVLPNLTAPCPTPAMSH

SEQ ID NO: 837477 - protein, 295 aa, Homo sapiens
MPVHTLSPGAPSAPALPCRLRTRVPGYLLRGPADGGARKPSAVERLEADKAKYVKSLHVANTRQEPVQPLLSKQPLFSPETRRTVLTPSRRALPGPCRRPQLDLDILSSLIDLCDSPVSPAEASRTPGRAEGAGRPPPATPPRPPPSTSAVRRVDVRPLPASPARPCPSPGPAAASSPARPPGLQRSKSDLSERFSRAAADLERFFNFCGLDPEEARGLGVAHLARASSDIVSLAGPSAGPGSSEGGCSRRSSVTVEERARERVPYGVSVVERNARVIKWLYGLRQARESPAAEG

SEQ ID NO: 837478 - protein, 295 aa, Homo sapiens; identical to SEQ ID NO: 837477

SEQ ID NO: 837479 - protein, 295 aa, Homo sapiens; identical to SEQ ID NO: 837477

SEQ ID NO: 837480 - protein, 295 aa, Homo sapiens; identical to SEQ ID NO: 837477

SEQ ID NO: 837481 - protein, 112 aa, Homo sapiens
PHATLWALPSLVLWLHPLRSYLGFHTHSTQRKSQLTHIRFWAGPPAKVVGGHDTAPGMASSKCLSNDTASDGMMPLPTVSQALPSRLCSAASRWVYGHSKTAIPVNESACRD

SEQ ID NO: 837482 - protein, 295 aa, Homo sapiens; identical to SEQ ID NO: 837477

SEQ ID NO: 837483 - protein, 92 aa, Homo sapiens
MKVITEILDTLIGKVPVEMSPGKLFLHVASGLERLHGLHDMKVGHILVCQLRVLRHVDILLGHHDSLLKKEFINGNPVLLRHQHLCGCRVRG

SEQ ID NO: 837484 - protein, 295 aa, Homo sapiens; identical to SEQ ID NO: 837477

SEQ ID NO: 837485 - protein, 295 aa, Homo sapiens; identical to SEQ ID NO: 837477

SEQ ID NO: 837486 - protein, 108 aa, Homo sapiens
KKERKEGRKRERKEGRERKEGRKRERKEGRKERKKERKKGRGNCDLRLNDYKMTADWCPDEGVNGSDHTGGACLLHKRNIGNMECICGGRLGCLRKVHTSRTEDLGGT

SEQ ID NO: 837487 - protein, 125 aa, Homo sapiens
MAMQAAKRANIRLPPEVNRILYIRNLPYKITAEEMYDIFGKYGPIRQIRVGNTPETRGTAYVVYEDIFDAKNACDHLSGFNVCNRYLVVLYYNANRAFQKMDTKKKEEQLKLLKEKYGINTDPPK

SEQ ID NO: 837488 - protein, 125 aa, Homo sapiens; identical to SEQ ID NO: 837487

SEQ ID NO: 837489 - protein, 110 aa, Homo sapiens
MAMQAAKRANIRLPPEVNRILYIRNLPYKITAEEMGNTPETRGTAYVVYEDIFDAKNACDHLSGFNVCNRYLVVLYYNANRAFQKMDTKKKEEQLKLLKEKYGINTDPPK

SEQ ID NO: 837490 - protein, 88 aa, Homo sapiens
GLESRSGSVLPRSLFEGGCYVSASQRKTALFRCNSFRRVLDVDVLHLTRCNPRSRASSGGISVSATVTSSARQDGDASGQEGEHSTST

SEQ ID NO: 837491 - protein, 125 aa, Homo sapiens; identical to SEQ ID NO: 837487

SEQ ID NO: 837492 - protein, 125 aa, Homo sapiens; identical to SEQ ID NO: 837487

SEQ ID NO: 837493 - protein, 165 aa, Homo sapiens
GLESRSGSVLPRSLFEGGCYVSASQRKTALFRCNSFRRVLDVDVLHLTRCNPRSRASSGGISVSATVTSSARQDGDASGQEGEREYRVFCGGWENFGFDFLSGVDRSILAPPPSPERRTPEFLSCQRRHYPAPSSEICSLSHISVPTPFESSSVSTLVSVIVLPL

SEQ ID NO: 837494 - protein, 91 aa, Homo sapiens
RAAGIRHEGPIRQIRVGNTPETRGTAYVVYEDIFDAKNACDHLSGFNVCNRYLVVLYYNANRAFQKMDTKKKEEQLKLLKEKYGINTDPPK

SEQ ID NO: 837495 - protein, 93 aa, Homo sapiens
LRVRSVMTKKEKKAGALEGNTPETRGTAYVVYEDIFDAKNACDHLSGFNVCNRYLVVLYYNANRAFQKMDTKKKEEQLKLLKEKYGINTDPPK

SEQ ID NO: 837496 - protein, 88 aa, Homo sapiens; identical to SEQ ID NO: 837490

SEQ ID NO: 837497 - protein, 125 aa, Homo sapiens; identical to SEQ ID NO: 837487

SEQ ID NO: 837498 - protein, 206 aa, Homo sapiens
MLRTAGRDGLCRLSTYLEELEAVELKKFKLYLGTATELGEGKIPWGSMEKAGPLEMAQLLITHFGPEEAWRLALSTFERINRKDLWERGQREDLVRDTPPGGPSSLGNQSTCLLEVSLVTPRKDPQETYRDYVRRKFRLMEDRNARLGECVNLSHRYTRLLLVKEHSNPMQVQQQLLDTGRGHARTVGHQASPIKIETLFEPDEER

SEQ ID NO: 837499 - protein, 105 aa, Homo sapiens
MEFALVQAGVQWHDLGSPQTLPPGFKRFSCLSLLSSWDYRHAPPQLANFVFLGKTGFLHVGQAGLEFSISGDPPASAPQSAGITGVSHGAQPSFANFIKDNAKRK

SEQ ID NO: 837500 - protein, 133 aa, Homo sapiens
IGRWTAPRPRGEADTGGSSAKAKSRSKWWDSRRGRGDVKSSRGSSRCGSALALALLALRPGPGPGPAPAMEKTELIQKAKLAEQAEASYDDMATCMKAVTEQGAELSNEERNLLSVAYKNVVGGRRSALEGHL

SEQ ID NO: 837501 - protein, 133 aa, Homo sapiens; identical to SEQ ID NO: 837500

SEQ ID NO: 837502 - protein, 133 aa, Homo sapiens; identical to SEQ ID NO: 837500

SEQ ID NO: 837503 - protein, 133 aa, Homo sapiens; identical to SEQ ID NO: 837500

SEQ ID NO: 837504 - protein, 107 aa, Homo sapiens
KISLGRAGFELARSSRGSSRCGSALALALLALRPGPGPGPAPAMEKTELIQKAKLAEQAEASYDDMATCMKAVTEQGAELSNEERNLLSVAYKNVVGGRRSALEGHL

SEQ ID NO: 837505 - protein, 133 aa, Homo sapiens; identical to SEQ ID NO: 837500

SEQ ID NO: 837506 - protein, 133 aa, Homo sapiens; identical to SEQ ID NO: 837500

SEQ ID NO: 837507 - protein, 66 aa, Homo sapiens
TRVAARRREALEAPPAGPPWRVISSIEQKTDTSDKKLQLIKDYREKVESELRSICTTVLGTCWINI

SEQ ID NO: 837508 - protein, 103 aa, Homo sapiens
MVVLTFSSSLSLLFVFSHSHRVRAPGRSTNLLDKYLIANATNPESKVFYLKMKGDYFRYLAEVACGDDRKQTIDNSQGAYQEAFDITQERDATHTPNPPGACS

SEQ ID NO: 837509 - protein, 133 aa, Homo sapiens; identical to SEQ ID NO: 837500

SEQ ID NO: 837510 - protein, 133 aa, Homo sapiens; identical to SEQ ID NO: 837500

SEQ ID NO: 837511 - protein, 133 aa, Homo sapiens; identical to SEQ ID NO: 837500

SEQ ID NO: 837512 - protein, 71 aa, Homo sapiens
GWVSLCTWMPDKGWSMSAAGGRKFSVFYYEILNNPELACTLAKTAFDEAIAELDTLNEDSYKGQHPHHAVA

SEQ ID NO: 837513 - protein, 85 aa, Homo sapiens
GRVGRPTRPSTHAAADARVRTHASAFGHQTVQEKNVMRQKGLKTKSIQGVILLSFKKPFYTSPFLIPLGFPIAKKPIHVYGINCL

SEQ ID NO: 837514 - protein, 78 aa, Homo sapiens
GRVGRPTRPSTHAAADARVRTHASAHISIPYSTWISYSKETHSCVWNQLFIVFSHCSFGKTSFLDLCLSWPSWCAVLL

SEQ ID NO: 837515 - protein, 105 aa, Homo sapiens
EKAILVHIPVLAVRRRVSVKMKHIVINMSGIYSYSRLPWINDYVRLDSRAACKNTPVEESRSASEHIPNAEFMTSLSLRIYSTQFPHIRDYEYQIHRRPGTDNCL

SEQ ID NO: 837516 - protein, 116 aa, Homo sapiens
CCCVCLFGRAAVSCRVLFLCLFCGVFFLFFFVLLWLLGVSSGLVSRVSRLLSMAFSVLSFLCLCVLVRCVCCVSGLLVGVVVSFLPFVRFSRSRLSAVLVAFDVRVCSVSYFCSLV

SEQ ID NO: 837517 - protein, 91 aa, Homo sapiens
GGRKGVGEGGFVFLEIQNLLDKYLIANATNPESKVFYLKMKGDYFRYLAEVACGDDRKQTIDNSQGAYQEAFDITQERDATHTPNPPGACS

SEQ ID NO: 837518 - protein, 133 aa, Homo sapiens; identical to SEQ ID NO: 837500

SEQ ID NO: 837519 - protein, 132 aa, Homo sapiens
WAVDRPSAPGYADTGGSSAKAKSRSKWWDSRRGRGDVKSSRGSSRCGSALALALLALRPGPGPGPAPAMEKTELIQKAKLAEQAEASYDDMATCMKAVTEQGAELSNEERNLLSVAYKNVVGGRRSALEGHL

SEQ ID NO: 837520 - protein, 170 aa, Homo sapiens
AGAAAARAPCARGLRAAPASSSRGPRPPRVPSGGGGGGEGNSSGRVCGRQKRAAGRIVRRRSLSAFCSRLAAPPLRSSRGSSRCGSALALALLALRPGPGPGPAPAMEKTELIQKAKLAEQAEASYDDMATCMKAVTEQGAELSNEERNLLSVAYKNVVGGRRSALEGHL

SEQ ID NO: 837521 - protein, 106 aa, Homo sapiens
MPLPSGTAPGGKSSRGSSRCGSALALALLALRPGPGPGPAPAMEKTELIQKAKLAEQAEASYDDMATCMKAVTEQGAELSNEERNLLSVAYKNVVGGRRSALEGHL

SEQ ID NO: 837522 - protein, 133 aa, Homo sapiens; identical to SEQ ID NO: 837500

SEQ ID NO: 837523 - protein, 133 aa, Homo sapiens; identical to SEQ ID NO: 837500

SEQ ID NO: 837524 - protein, 133 aa, Homo sapiens; identical to SEQ ID NO: 837500

SEQ ID NO: 837525 - protein, 133 aa, Homo sapiens; identical to SEQ ID NO: 837500

SEQ ID NO: 837526 - protein, 133 aa, Homo sapiens; identical to SEQ ID NO: 837500

SEQ ID NO: 837527 - protein, 133 aa, Homo sapiens; identical to SEQ ID NO: 837500

SEQ ID NO: 837528 - protein, 133 aa, Homo sapiens; identical to SEQ ID NO: 837500

SEQ ID NO: 837529 - protein, 133 aa, Homo sapiens; identical to SEQ ID NO: 837500

SEQ ID NO: 837530 - protein, 78 aa, Homo sapiens; identical to SEQ ID NO: 837514

SEQ ID NO: 837531 - protein, 108 aa, Homo sapiens
RSVPGEQAHSSPRRRPGLALPWRLGQRVSRMAPLPGAELVRRPLQLYRYLLRCCQQLPTKGIQQHYKHAVRQSFRVHSDEDNPERIQQIIKRAIEDADWIMNKYKKQN

SEQ ID NO: 837532 - protein, 108 aa, Homo sapiens; identical to SEQ ID NO: 837531

SEQ ID NO: 837533 - protein, 108 aa, Homo sapiens; identical to SEQ ID NO: 837531

SEQ ID NO: 837534 - protein, 122 aa, Homo sapiens
RSVPGEQAHSSPRRRPGLALPWRLGQRVSRMAPLPGAELVRRPLQLYRYLLRCCQQLPTKGIQQHYKHAVRQSFRVHSDEDNPERIQQIIKRAIEDADWIMNKLRMVPVEEATSQLLPSSRS

SEQ ID NO: 837535 - protein, 108 aa, Homo sapiens; identical to SEQ ID NO: 837531

SEQ ID NO: 837536 - protein, 108 aa, Homo sapiens; identical to SEQ ID NO: 837531

SEQ ID NO: 837537 - protein, 108 aa, Homo sapiens; identical to SEQ ID NO: 837531

SEQ ID NO: 837538 - protein, 494 aa, Homo sapiens
MEVVEAAAAQLETLKFNGTDFGVGEGPAAPSPGSAPVPGTQPPLQSFEGSPDAGQTVEVKPAGEQPLQPVLNAVAAGTPAPQPQPPAESPACGDCVTSPGAAEPARAPDSLETSDSDSDSDSETDSDSSSSSSSSSSSSSSSSSSCISLPPVLSDGDDDLQVEKENKNFPLKTKDELLLNELPSVEELTIILPEDIELKPLGMVSSIIEQLVIIESMTNLPPVNEETVIFKSDRQAAGKIFEIFGPVAHPFYVLRFNSSDHIESKGIKIKETMYFAPSMKDFTQYIFTEKLKQDKGSDASWKNDQEPPPEALDFSDDEKEKEAKQRKKSQIQGRKKLKSEFNEPGEDFTEVHQNWNAHSSASEHAKGYRNREFTRGFSRARYPRSCHGRPPPQHFYNSEHMVSQETSGFPSQRQNNPIMPQYPFPLPVFDMHNFPLRPPPPPPPPPVNMGWATPNMAAHPLLNLPYSLPPPPPPPPLPPPPSSGDSNSHFGPYY

SEQ ID NO: 837539 - protein, 494 aa, Homo sapiens; identical to SEQ ID NO: 837538

SEQ ID NO: 837540 - protein, 314 aa, Homo sapiens
MEVVEAAAAQLETLKFNGTDFGVGEGPAAPSPGSAPVPGTQPPLQSFEGSPDAGQTVEVKPAGEQPLQPVLNAVAAGTPAPQPQPPAESPACGDCVTSPGAAEPARAPDSLETSDSDSDSDSETDSDSSSSSSSSSSSSSSSSSSCISLPPVLSDGDDDLQVEKENKNFPLKTKDELLLNELPSVEELTIILPEDIELKPLGMVSSIIEQLVIIESMTNLPPVNEETVIFKSDRQAAGKIFEIFGPVAHPFYVLRFNSSDHIESKGIKIKETMYFAPSMKDFTQYIFTEKLKQDKGSDASWKNDQEPPPETMVD

SEQ ID NO: 837541 - protein, 181 aa, Homo sapiens [sequence omitted]

SEQ ID NO: 837542 - protein, 494 aa, Homo sapiens; identical to SEQ ID NO: 837538

SEQ ID NO: 837543 - protein, 182 aa, Homo sapiens
MADSENQGPAEPSQAAAAAEAAAEEVMAEGGAQGGDCDSAAGDPDSAAGQMAEEPQTPAENAPKPKNDFIESLPNSVKCRVLALKKLQKRCDKIEAKFDKEFQALEKKYNDIYKPLLAKIQELTGEMEGCAWTLEGEEEEEEEYEDDEEEGEDEEEEEAAAEAAAGAKHDDAHAEMPDDAKK

SEQ ID NO: 837544 - protein, 182 aa, Homo sapiens; identical to SEQ ID NO: 837543

SEQ ID NO: 837545 - protein, 131 aa, Homo sapiens
RQLMWEASQVPRKQEAGPRPTSFPRPHVTATCRIRKISLDQLGCRASAGALLDLCGFSSNMADSENQGPAEPSQAAAAAEAAAEEVMAEGGAQGGDCDSAAGDPDSAAGQMAEEPQTPAENAPKPKNEKKV

SEQ ID NO: 837546 - protein, 32 aa, Homo sapiens
LVRLDKNIVMDRAQVVPECISDSWANNQSMLK

SEQ ID NO: 837547 - protein, 701 aa, Homo sapiens
GTRISGAGAAPRRHPHLLPAAAAAEPGRSSAPSTAAPGNPERAPQAGGRARASQPSLFHLLLREGKMSESSSKSSQPLASKQEKDGTEKRGRGRPRKQPPVSPGTALVGSQKEPSEVPTPKRPRGRPKGSKNKGAAKTRKTTTTPGRKPRGRPKKLEKEEEEGISQESSEEEAVTHACRLLLTGGAASFWDWTALLRSHRPRPFPRPTITTASGRHPHLPPVPSPPHYTAHQPLQGSHGLSGEQFSPGLSSQLPPPTHAYTHALLDKANIPLSRTLHLLRPHSLGGGDIALLGFWFGGALSAPSLFPTTSLTSSSTSGSSDKVYAHQMVRTDSREQKLDAFLQPLSKPLSSQPQAIVTEDKTDISSGRARQQDEEMLELPAPAEVAAKNQSLEGDTTKGTSEMSEKRGPTSSNPRKRHREDSDVEMVEDDSRKEMTAACTPRRRIINLTSVLSLQEEINEQGHEVLREMLHNHSFVGCVNPQWALAQHQTKLYLLNTTKLSEELFYQILIYDFANFGVLRLSEPAPLFDLAMLALDSPESGWTEEDGPKEGLAEYIVEFLKKKAEMLADYFSLEIDEEGNLIGLPLLIDNYVPPLEGLPIFILRLATEVNWDEEKECFESLSKECAMFYSIRKQYISEESTLSGQQSEVPGSIPNSWKWTVEHIVYKALRSHILPPKHFTEDGNILQLANLPDLYKVFERC

SEQ ID NO: 837548 - protein, 205 aa, Homo sapiens
MLPSQGFYTTVFDLTASDSFNYHRYQEPAPLFDLAMLALDSPESGWTEEDGPKEGLAEYIVEFLKKKAEMLADYFSLEIDEEGNLIGLPLLIDNYVPPLEGLPIFILRLATEVNWDEEKECFESLSKECAMFYSIRKQYISEESTLSGQQSEVPGSIPNSWKWTVEHIVYKALRSHILPPKHFTEDGNILQLANLPDLYKVFERC

SEQ ID NO: 837549 - protein, 201 aa, Homo sapiens
VTIWVAGGGFEATGLSLEAQTQEPAPLFDLAMLALDSPESGWTEEDGPKEGLAEYIVEFLKKKAEMLADYFSLEIDEEGNLIGLPLLIDNYVPPLEGLPIFILRLATEVNWDEEKECFESLSKECAMFYSIRKQYISEESTLSGQQSEVPGSIPNSWKWTVEHIVYKALRSHILPPKHFTEDGNILQLANLPDLYKVFERC

SEQ ID NO: 837550 - protein, 398 aa, Homo sapiens
MVKSTTSLTSSSTSGSSDKVYAHQMVRTDSREQKLDAFLQPLSKPLSSQPQAIVTEDKTDISSGRARQQDEEMLELPAPAEVAAKNQSLEGDTTKGTSEMSEKRGPTSSNPRKRHREDSDVEMVEDDSRKEMTAACTPRRRIINLTSVLSLQEEINEQGHEVLREMLHNHSFVGCVNPQWALAQHQTKLYLLNTTKLSEELFYQILIYDFANFGVLRLSEPAPLFDLAMLALDSPESGWTEEDGPKEGLAEYIVEFLKKKAEMLADYFSLEIDEEGNLIGLPLLIDNYVPPLEGLPIFILRLATEVNWDEEKECFESLSKECAMFYSIRKQYISEESTLSGQQSEVPGSIPNSWKWTVEHIVYKALRSHILPPKHFTEDGNILQLANLPDLYKVFERC

SEQ ID NO: 837551 - protein, 723 aa, Homo sapiens
MSFVAGVIRRLDETVVNRIAAGEVIQRPANAIKEMIENCLDAKSTSIQVIVKEGGLKLIQIQDNGTGIRALASISHVAHVTITTKTADGKCAYRASYSDGKLKAPPKPCAGNQGTQITVEDLFYNIATRRKALKNPSEEYGKILEVVGRYSVHNAGISFSVKKQGETVADVRTLPNASTVDNIRSIFGNAVSRELIEIGCEDKTLAFKMNGYISNANYSVKKCIFLLFINHRLVESTSLRKAIETVYAAYLPKNTHPFLYLSLEISPQNVDVNVHPTKHEVHFLHEESILERVQQHIESKLLGSNSSRMYFTQTLLPGLAGPSGEMVKSTTSLTSSSTSGSSDKVYAHQMVRTDSREQKLDAFLQPLSKPLSSQPQAIVTEDKTDISSGRARQQDEEMLELPAPAEVAAKNQSLEGDTTKGTSEMSEKRGPTSSNPRKRHREDSDVEMVEDDSRKEMTAACTPRRRIINLTSVLSLQEEINEQGHEVLREMLHNHSFVGCVNPQWALAQHQTKLYLLNTTKLSEELFYQILIYDFANFGVLRLSEPAPLFDLAMLALDSPESGWTEEDGPKEGLAEYIVEFLKKKAEMLADYFSLEIDEEGNLIGLPLLIDNYVPPLEGLPIFILRLATEVNWDEEKECFESLSKECAMFYSIRKQYISEESTLSGQQSEVPGSIPNSWKWTVEHIVYKALRSHILPPKHFTEDGNILQLANLPDLYKVFERC

SEQ ID NO: 837552 - protein, 398 aa, Homo sapiens; identical to SEQ ID NO: 837550

SEQ ID NO: 837553 - protein, 756 aa, Homo sapiens
MSFVAGVIRRLDETVVNRIAAGEVIQRPANAIKEMIENCLDAKSTSIQVIVKEGGLKLIQIQDNGTGIRKEDLDIVCERFTTSKLQSFEDLASISTYGFRGEALASISHVAHVTITTKTADGKCAYRASYSDGKLKAPPKPCAGNQGTQITVEDLFYNIATRRKALKNPSEEYGKILEVVGRYSVHNAGISFSVKKQGETVADVRTLPNASTVDNIRSIFGNAVSRELIEIGCEDKTLAFKMNGYISNANYSVKKCIFLLFINHRLVESTSLRKAIETVYAAYLPKNTHPFLYLSLEISPQNVDVNVHPTKHEVHFLHEESILERVQQHIESKLLGSNSSRMYFTQTLLPGLAGPSGEMVKSTTSLTSSSTSGSSDKVYAHQMVRTDSREQKLDAFLQPLSKPLSSQPQAIVTEDKTDISSGRARQQDEEMLELPAPAEVAAKNQSLEGDTTKGTSEMSEKRGPTSSNPRKRHREDSDVEMVEDDSRKEMTAACTPRRRIINLTSVLSLQEEINEQGHEVLREMLHNHSFVGCVNPQWALAQHQTKLYLLNTTKLSEELFYQILIYDFANFGVLRLSEPAPLFDLAMLALDSPESGWTEEDGPKEGLAEYIVEFLKKKAEMLADYFSLEIDEEGNLIGLPLLIDNYVPPLEGLPIFILRLATEVNWDEEKECFESLSKECAMFYSIRKQYISEESTLSGQQSEVPGSIPNSWKWTVEHIVYKALRSHILPPKHFTEDGNILQLANLPDLYKVFERC

SEQ ID NO: 837554 - protein, 756 aa, Homo sapiens; identical to SEQ ID NO: 837553

SEQ ID NO: 837555 - protein, 711 aa, Homo sapiens
MSFVAGVIRRLDETVVNRIAAGEVIQRPANAIKEMIENCLDAKSTSIQVIVKEGGLKLIQIQDNGTGIRKEDLDIVCERFTTSKLQSFEDLASISTYGFRGEALASISHVAHVTITTKTADGKCAYRASYSDGKLKAPPKPCAGNQGTQITVEDLFYNIATRRKALKNPSEEYGKILEVVGRYSVHNAGISFSVKKQGETVADVRTLPNASTVDNIRSIFGNAVSRELIEIGCEDKTLAFKMNGYISNANYSVKKCIFLLFINHRLVESTSLRKAIETVYAAYLPKNTHPFLYLSLEISPQNVDVNVHPTKHEVHFLHEESILERVQQHIESKLLGSNSSRMYFTQTLLPGLAGPSGEMVKSTTSLTSSSTSGSSDKVYAHQMVRTDSREQKLDAFLQPLSKPLSSQPQAIVTEDKTDISSGRARQQDEEMLELPAPAEVAAKNQSLEGDTTKGTSEMSEKRGPTSSNPRKRHREDSDVEMVEDDSRKEMTAACTPRRRIINLTSVLSLQEEINEQGHEVLREMLHNHSFVGCVNPQWALAQHQTKLYLLNTTKLSEELFYQILIYDFANFGVLRLSEPAPLFDLAMLALDSPESGWTEEDGPKEGLAEYIVEFLKKKAEMLADYFSLEIDEEGNLIGLPLLIDNYVPPLEGLPIFILRLATEVNWDEEKECFESLSKECAMFYSIRKYVVDYILEPSANMPWFKGWKVTR

SEQ ID NO: 837556 - protein, 643 aa, Homo sapiens
MSFVAGVIRRLDETVVNRIAAGEVIQRPANAIKEMIENCLDAKSTSIQVIVKEGGLKLIQIQDNGTGIRKEDLDIVCERFTTSKLQSFEDLASISTYGFRGEALASISHVAHVTITTKTADGKCAYRASYSDGKLKAPPKPCAGNQGTQITVEDLFYNIATRRKALKNPSEEYGKILEVVGRYSVHNAGISFSVKKQGETVADVRTLPNASTVDNIRSIFGNAVSRELIEIGCEDKTLAFKMNGYISNANYSVKKCIFLLFINHRLVESTSLRKAIETVYAAYLPKNTHPFLYLSLEISPQNVDVNVHPTKHEVHFLHEESILERVQQHIESKLLGSNSSRMYFTQTLLPGLAGPSGEMVKSTTSLTSSSTSGSSDKVYAHQMVRTDSREQKLDAFLQPLSKPLSSQPQAIVTEDKTDISSGRARQQDEEMLELPAPAEVAAKNQSLEGDTTKGTSEMSEKRGPTSSNPRKRHREDSDVEMVEDDSRKEMTAACTPRRRIINLTSVLSLQEEINEQGHEVLREMLHNHSFVGCVNPQWALAQHQTKLYLLNTTKLSEELFYQILIYDFANFGVLRLSEPAPLFDLAMLALDSPESGWTEEDGPKEGLAEYIVEFLKKKAEMLADYFSLEIDESVNALRSLYSP

SEQ ID NO: 837557 - protein, 522 aa, Homo sapiens
MSFVAGVIRRLDETVVNRIAAGEVIQRPANAIKEMIENCLDAKSTSIQVIVKEGGLKLIQIQDNGTGIRKEDLDIVCERFTTSKLQSFEDLASISTYGFRGEALASISHVAHVTITTKTADGKCAYRASYSDGKLKAPPKPCAGNQGTQITVEDLFYNIATRRKALKNPSEEYGKILEVVGRYSVHNAGISFSVKKQGETVADVRTLPNASTVDNIRSIFGNAVSRELIEIGCEDKTLAFKMNGYISNANYSVKKCIFLLFINHRLVESTSLRKAIETVYAAYLPKNTHPFLYLSLEISPQNVDVNVHPTKHEVHFLHEESILERVQQHIESKLLGSNSSRMYFTQTLLPGLAGPSGEMVKSTTSLTSSSTSGSSDKVYAHQMVRTDSREQKLDAFLQPLSKPLSSQPQAIVTEDKTDISSGRARQQDEEMLELPAPAEVAAKNQSLEGDTTKGTSEMSEKRGPTSSNPRKKTSGKILMGKSGEDDSRKGMDWVVPPERSNSMVEFGENRGDRGRESGTPSG

SEQ ID NO: 837558 - protein, 286 aa, Homo sapiens
MSFVAGVIRRLDETVVNRIAAGEVIQRPANAIKEMIENCLDAKSTSIQVIVKEGGLKLIQIQDNGTGIRKEDLDIVCERFTTSKLQSFEDLASISTYGFRGEALASISHVAHVTITTKTADGKCAYRASYSDGKLKAPPKPCAGNQGTQITVEDLFYNIATRRKALKNPSEEYGKILEVVGRYSVHNAGISFSVKKQGETVADVRTLPNASTVDNIRSIFGNAVSRELIEIGCEDKTLAFKMNGYISNANYSVKKCIFLLFINPSLVKSLLKRLKRFGYSKKTIRS

SEQ ID NO: 837559 - protein, 235 aa, Homo sapiens
MSFVAGVIRRLDETVVNRIAAGEVIQRPANAIKEMIENCLDAKSTSIQVIVKEGGLKLIQIQDNGTGIRKEDLDIVCERFTTSKLQSFEDLASISTYGFRGEALASISHVAHVTITTKTADGKCAYRASYSDGKLKAPPKPCAGNQGTQITVEDLFYNIATRRKALKNPSEEYGKILEVVGRYSVHNAGISFSVKKQGETVADVRTLPNASTVDNIRSIFGNAVSRELFKNGCEG

SEQ ID NO: 837560 - protein, 756 aa, Homo sapiens; identical to SEQ ID NO: 837553

SEQ ID NO: 837561 - protein, 515 aa, Homo sapiens
MNGYISNANYSVKKCIFLLFINHRLVESTSLRKAIETVYAAYLPKNTHPFLYLSLEISPQNVDVNVHPTKHEVHFLHEESILERVQQHIESKLLGSNSSRMYFTQTLLPGLAGPSGEMVKSTTSLTSSSTSGSSDKVYAHQMVRTDSREQKLDAFLQPLSKPLSSQPQAIVTEDKTDISSGRARQQDEEMLELPAPAEVAAKNQSLEGDTTKGTSEMSEKRGPTSSNPRKRHREDSDVEMVEDDSRKEMTAACTPRRRIINLTSVLSLQEEINEQGHEVLREMLHNHSFVGCVNPQWALAQHQTKLYLLNTTKLSEELFYQILIYDFANFGVLRLSEPAPLFDLAMLALDSPESGWTEEDGPKEGLAEYIVEFLKKKAEMLADYFSLEIDEEGNLIGLPLLIDNYVPPLEGLPIFILRLATEVNWDEEKECFESLSKECAMFYSIRKQYISEESTLSGQQSEVPGSIPNSWKWTVEHIVYKALRSHILPPKHFTEDGNILQLANLPDLYKVFERC

SEQ ID NO: 837562 - protein, 783 aa, Homo sapiens
RLGTRLGGAGSLTSGVRPSPFPQTVCFFTALPRDLLRVVWSTESHFVTQAGVQWRDLSCLQPPPHSLDAKSTSIQVIVKEGGLKLIQIQDNGTGIRKEDLDIVCERFTTSKLQSFEDLASISTYGFRGEALASISHVAHVTITTKTADGKCAYRASYSDGKLKAPPKPCAGNQGTQITVEDLFYNIATRRKALKNPSEEYGKILEVVGRYSVHNAGISFSVKKQGETVADVRTLPNASTVDNIRSIFGNAVSRELIEIGCEDKTLAFKMNGYISNANYSVKKCIFLLFINHRLVESTSLRKAIETVYAAYLPKNTHPFLYLSLEISPQNVDVNVHPTKHEVHFLHEESILERVQQHIESKLLGSNSSRMYFTQTLLPGLAGPSGEMVKSTTSLTSSSTSGSSDKVYAHQMVRTDSREQKLDAFLQPLSKPLSSQPQAIVTEDKTDISSGRARQQDEEMLELPAPAEVAAKNQSLEGDTTKGTSEMSEKRGPTSSNPRKRHREDSDVEMVEDDSRKEMTAACTPRRRIINLTSVLSLQEEINEQGHEVLREMLHNHSFVGCVNPQWALAQHQTKLYLLNTTKLSEELFYQILIYDFANFGVLRLSEPAPLFDLAMLALDSPESGWTEEDGPKEGLAEYIVEFLKKKAEMLADYFSLEIDEEGNLIGLPLLIDNYVPPLEGLPIFILRLATEVNWDEEKECFESLSKECAMFYSIRKQYISEESTLSGQQSEVPGSIPNSWKWTVEHIVYKALRSHILPPKHFTEDGNILQLANLPDLYKVFERC

SEQ ID NO: 837563 - protein, 415 aa, Homo sapiens
MYFTQTLLPGLAGPSGEMVKSTTSLTSSSTSGSSDKVYAHQMVRTDSREQKLDAFLQPLSKPLSSQPQAIVTEDKTDISSGRARQQDEEMLELPAPAEVAAKNQSLEGDTTKGTSEMSEKRGPTSSNPRKRHREDSDVEMVEDDSRKEMTAACTPRRRIINLTSVLSLQEEINEQGHEVLREMLHNHSFVGCVNPQWALAQHQTKLYLLNTTKLSEELFYQILIYDFANFGVLRLSEPAPLFDLAMLALDSPESGWTEEDGPKEGLAEYIVEFLKKKAEMLADYFSLEIDEEGNLIGLPLLIDNYVPPLEGLPIFILRLATEVNWDEEKECFESLSKECAMFYSIRKQYISEESTLSGQQSEVPGSIPNSWKWTVEHIVYKALRSHILPPKHFTEDGNILQLANLPDLYKVFERC

SEQ ID NO: 837564 - protein, 725 aa, Homo sapiens
MSFVAGVIRRLDETVVNRIAAGEVIQRPANAIKEMIENCLDAKSTSIQVIVKEGGLKLIQIQDNGTGIRKEDLDIVCERFTTSKLQSFEDLASISTYGFRGEALASISHVAHVTITTKTADGKCAYRASYSDGKLKAPPKPCAGNQGTQITVEDLFYNIATRRKALKNPSEEYGKILEVVGRYSVHNAGISFSVKKQGETVADVRTLPNASTVDNIRSIFGNAVSRELIEIGCEDKTLAFKMNGYISNANYSVKKCIFLLFINHRLVESTSLRKAIETVYAAYLPKNTHPFLYLSLEISPQNVDVNVHPTKHEVHFLHEESILERVQQHIESKLLGSNSSRMYFTQTLLPGLAGPSGEMVKSTTSLTSSSTSGSSDKVYAHQMVRTDSREQKLDAFLQPLSKPLSSQPQAIVTEDKTDISSGRARQQDEEMLELPAPAEVAAKNQSLEGDTTKGTSEMSEKRGPTSSNPRKRHREDSDVEMVEDDSRKEMTAACTPRRRIINLTSVLSLQEEINEQGHEVLREMLHNHSFVGCVNPQWALAQHQTKLYLLNTTKLSEELFYQILIYDFANFGVLRLSEPAPLFDLAMLALDSPESGWTEEDGPKEGLAEYIVEFLKKKAEMLADYFSLEIDEVNWDEEKECFESLSKECAMFYSIRKQYISEESTLSGQQSEVPGSIPNSWKWTVEHIVYKALRSHILPPKHFTEDGNILQLANLPDLYKVFERC

SEQ ID NO: 837565 - protein, 201 aa, Homo sapiens; identical to SEQ ID NO: 837549

SEQ ID NO: 837566 - protein, 725 aa, Homo sapiens; identical to SEQ ID NO: 837564

SEQ ID NO: 837567 - protein, 646 aa, Homo sapiens
MSFVAGVIRRLDETVVNRIAAGEVIQRPANAIKEMIENCLDAKSTSIQVIVKEGGLKLIQIQDNGTGIRKEDLDIVCERFTTSKLQSFEDLASISTYGFRGEALASISHVAHVTITTKTADGKCAYRASYSDGKLKAPPKPCAGNQGTQITVEDLFYNIATRRKALKNPSEEYGKILEVVGRYSVHNAGISFSVKKQGETVADVRTLPNASTVDNIRSIFGNAVSRELIEIGCEDKTLAFKMNGYISNANYSVKKCIFLLFINHRLVESTSLRKAIETVYAAYLPKNTHPFLYLSLEISPQNVDVNVHPTKHEVHFLHEESILERVQQHIESKLLGSNSSRMYFTQTLLPGLAGPSGEMVKSTTSLTSSSTSGSSDKVYAHQMVRTDSREQKLDAFLQPLSKPLSSQPQAIVTEDKTDISSGRARQQDEEMLELPAPAEVAAKNQSLEGDTTKGTSEMSEKRGPTSSNPRKRHREDSDVEMVEDDSRKEMTAACTPRRRIINLTSVLSLQEEINEQGHEVLREMLHNHSFVGCVNPQWALAQHQTKLYLLNTTKLSEELFYQILIYDFANFGVLRLSEPAPLFDLAMLALDSPESGWTEEDGPKEGLAEYIVEFLKKKAEMLADYFSLEIDERCDSHSYTSVVFFK

SEQ ID NO: 837568 - protein, 480 aa, Homo sapiens
MSFVAGVIRRLDETVVNRIAAGEVIQRPANAIKEMIENCLDAKSTSIQVIVKEGGLKLIQIQDNGTGIRKEDLDIVCERFTTSKLQSFEDLASISTYGFRGEALASISHVAHVTITTKTADGKCAYRASYSDGKLKAPPKPCAGNQGTQITVEDLFYNIATRRKALKNPSEEYGKILEVVGRYSVHNAGISFSVKKQGETVADVRTLPNASTVDNIRSIFGNAVSRELIEIGCEDKTLAFKMNGYISNANYSVKKCIFLLFINHRLVESTSLRKAIETVYAAYLPKNTHPFLYLSLEISPQNVDVNVHPTKHEVHFLHEESILERVQQHIESKLLGSNSSRMYFTQTLLPGLAGPSGEMVKSTTSLTSSSTSGSSDKVYAHQMVRTDSREQKLDAFLQPLSKPLSSQPQAIVTEDKTDISSGRARQQDEEMLELPAPAEVAAKNQSLEGDTTKGTSEMSEKRGPTSSNPRKETFGKFLDV

SEQ ID NO: 837569 - protein, 170 aa, Homo sapiens
MSFVAGVIRRLDETVVNRIAAGEVIQRPANAIKEMIENCLDAKSTSIQVIVKEGGLKLIQIQDNGTGIRKEDLDIVCERFTTSKLQSFEDLASISTYGFRGEALASISHVAHVTITTKTADGKCAYRASYSDGKLKAPPKPCAGNQGTQITVQDLFHYIPTRSKPSTISN

SEQ ID NO: 837570 - protein, 131 aa, Homo sapiens
MLALETRASPGHTPGCVTFVLNDHSMAFTGDALLIRGCGRTDFQQGCAKTLYHSVHEKIFTLPGDCLIYPAHDYHGFTVSTVEEERTLNPRLTLSCEEFVKIMGNLNLPKPQQIDFAVPANMRCGVQTPTA

SEQ ID NO: 837571 - protein, 254 aa, Homo sapiens; identical to SEQ ID NO: 776272

SEQ ID NO: 837572 - protein, 115 aa, Homo sapiens
MKNTLSLSSLLIPFLLLNPESYPCLAKSTFPSCKGKDRNALCFKGLEKGAINFTPRGPDVLLETRIGTKQASSNGDQAQNSRWERNWEVSIWRKATRRTRTSEIPKTIHQRCNRG

SEQ ID NO: 837573 - protein, 81 aa, Homo sapiens
GLRCRRHPLGRGHVVLRALPAWPWDSDPRLPFPAPLAWPRASVSRPYSRSRLGGTGAGIGPATPSLRCAAVAAVLGYWCPV

SEQ ID NO: 837574 - protein, 513 aa, Homo sapiens
MASGSVAECLQQETTCPVCLQYFAEPMMLDCGHNICCACLARCWGTAETNVSCPQCRETFPQRHMRPNRHLANVTQLVKQLRTERPSGPGGEMGVCEKHREPLKLYCEEDQMPICVVCDRSREHRGHSVLPLEEAVEGFKEQIQNQLDHLKRVKDLKKRRRAQGEQARAELLSLTQMEREKIVWEFEQLYHSLKEHEYRLLARLEELDLAIYNSINGAITQFSCNISHLSSLIAQLEEKQQQPTRELLQDIGDTLSRAERIRIPEPWITPPDLQEKIHIFAQKCLFLTESLKQFTEKMQSDMEKIQELREAQLYSVDVTLDPDTAYPSLILSDNLRQVRYSYLQQDLPDNPERFNLFPCVLGSPCFIAGRHYWEVEVGDKAKWTIGVCEDSVCRKGGVTSAPQNGFWAVSLWYGKEYWALTSPMTALPLRTPLQRVGIFLDYDAGEVSFYNVTERCHTFTFSHATFCGPVRPYFSLSYSGGKSAAPLIICPMSGIDGFSGHVGNHGHSMETSP

SEQ ID NO: 837575 - protein, 513 aa, Homo sapiens; identical to SEQ ID NO: 837574

SEQ ID NO: 837576 - protein, 358 aa, Homo sapiens
MASGSVAECLQQETTCPVCLQYFAEPMMLDCGHNICCACLARCWGTAETNVSCPQCRETFPQRHMRPNRHLANVTQLVKQLRTERPSGPGGEMGVCEKHREPLKLYCEEDQMPICVVCDRSREHRGHSVLPLEEAVEGFKEQIQNQLDHLKRVKDLKKRRRAQGEQARAELLSLTQMEREKIVWEFEQLYHSLKEHEYRLLARLEELDLAIYNSINGAITQFSCNISHLSSLIAQLEEKQQQPTRELLQDIGDTLSRAERIRIPEPWITPPDLQEKIHIFAQKCLFLTESLKQFTEKMQSDMEKIQELREAQLYSVDVTLDPDTAYPSLILSDNLRQVRYSYLQQDLPDNPERSPSTT

SEQ ID NO: 837577 - protein, 262 aa, Homo sapiens
MFFKFRAERIRIPEPWITPPDLQEKIHIFAQKCLFLTESLKQFTEKMQSDMEKIQELREAQLYSVDVTLDPDTAYPSLILSDNLRQVRYSYLQQDLPDNPERFNLFPCVLGSPCFIAGRHYWEVEVGDKAKWTIGVCEDSVCRKGGVTSAPQNGFWAVSLWYGKEYWALTSPMTALPLRTPLQRVGIFLDYDAGEVSFYNVTERCHTFTFSHATFCGPVRPYFSLSYSGGKSAAPLIICPMSGIDGFSGHVGNHGHSMETSP

SEQ ID NO: 837578 - protein, 262 aa, Homo sapiens; identical to SEQ ID NO: 837577

SEQ ID NO: 837579 - protein, 277 aa, Homo sapiens
MTSHGYFFSFLLQDIGDTLSRAERIRIPEPWITPPDLQEKIHIFAQKCLFLTESLKQFTEKMQSDMEKIQELREAQLYSVDVTLDPDTAYPSLILSDNLRQVRYSYLQQDLPDNPERFNLFPCVLGSPCFIAGRHYWEVEVGDKAKWTIGVCEDSVCRKGGVTSAPQNGFWAVSLWYGKEYWALTSPMTALPLRTPLQRVGIFLDYDAGEVSFYNVTERCHTFTFSHATFCGPVRPYFSLSYSGGKSAAPLIICPMSGIDGFSGHVGNHGHSMETSP

SEQ ID NO: 837580 - protein, 354 aa, Homo sapiens
MASGSVAECLQQETTCPVCLQYFAEPMMLDCGHNICCACLARCWGTAETNVSCPQCRETFPQRHMRPNRHLANVTQLVKQLRTERPSGPGGEMGVCEKHREPLKLYCEEDQMPICVVCDRSREHRGHSVLPLEEAVEGFKEQIQNQLDHLKRVKDLKKRRRAQGEQARAELLSLTQMEREKIVWEFEQLYHSLKEHEYRLLARLEELDLAIYNSINGAITQFSCNISHLSSLIAQLEEKQQQPTRELLQDIGDTLSRAERIRIPEPWITPPDLQEKIHIFAQKCLFLTESLKQFTEKMQSDMEKIQELREAQLYSVDVTLDPDTAYPSLILSDNLRQVRYSYLQQDLPDNPERL

SEQ ID NO: 837581 - protein, 263 aa, Homo sapiens [sequence omitted]

SEQ ID NO: 837582 - protein, 513 aa, Homo sapiens; identical to SEQ ID NO: 837574

SEQ ID NO: 837583 - protein, 513 aa, Homo sapiens; identical to SEQ ID NO: 837574

SEQ ID NO: 837584 - protein, 537 aa, Homo sapiens
MASGSVAECLQQETTCPVCLQYFAEPMMLDCGHNICCACLARCWGTAETNVSCPQCRETFPQRHMRPNRHLANVTQLVKQLRTERPSGPGGEMGVCEKHREPLKLYCEEDQMPICVVCDRSREHRGHSVLPLEEAVEGFKEQIQNQLDHLKRVKDLKKRRRAQGEQARAELLSLTQMEREKIVWEFEQLYHSLKEHEYRLLARLEELDLAIYNSINGAITQFSCNISHLSSLIAQLEEKQQQPTRELLQDIGDTLSRAERIRIPEPWITPPDLQEKIHIFAQKCLFLTESLKQFTEKMQSDMEKIQESADSLEGGILDLGSVLSHILPVSELREAQLYSVDVTLDPDTAYPSLILSDNLRQVRYSYLQQDLPDNPERFNLFPCVLGSPCFIAGRHYWEVEVGDKAKWTIGVCEDSVCRKGGVTSAPQNGFWAVSLWYGKEYWALTSPMTALPLRTPLQRVGIFLDYDAGEVSFYNVTERCHTFTFSHATFCGPVRPYFSLSYSGGKSAAPLIICPMSGIDGFSGHVGNHGHSMETSP

SEQ ID NO: 837585 - protein, 450 aa, Homo sapiens
KSLRGSRQSVVTQLVKQLRTERPSGPGGEMGVCEKHREPLKLYCEEDQMPICVVCDRSREHRGHSVLPLEEAVEGFKEQIQNQLDHLKRVKDLKKRRRAQGEQARAELLSLTQMEREKIVWEFEQLYHSLKEHEYRLLARLEELDLAIYNSINGAITQFSCNISHLSSLIAQLEEKQQQPTRELLQDIGDTLSRAERIRIPEPWITPPDLQEKIHIFAQKCLFLTESLKQFTEKMQSDMEKIQELREAQLYSVDVTLDPDTAYPSLILSDNLRQVRYSYLQQDLPDNPERFNLFPCVLGSPCFIAGRHYWEVEVGDKAKWTIGVCEDSVCRKGGVTSAPQNGFWAVSLWYGKEYWALTSPMTALPLRTPLQRVGIFLDYDAGEVSFYNVTERCHTFTFSHATFCGPVRPYFSLSYSGGKSAAPLIICPMSGIDGFSGHVGNHGHSMETSP

SEQ ID NO: 837586 - protein, 262 aa, Homo sapiens; identical to SEQ ID NO: 837577

SEQ ID NO: 837587 - protein, 242 aa, Homo sapiens
MFFKFRAERIRIPEPWITPPDLQEKIHIFAQKCLFLTESLKQFTVDVTLDPDTAYPSLILSDNLRQVRYSYLQQDLPDNPERFNLFPCVLGSPCFIAGRHYWEVEVGDKAKWTIGVCEDSVCRKGGVTSAPQNGFWAVSLWYGKEYWALTSPMTALPLRTPLQRVGIFLDYDAGEVSFYNVTERCHTFTFSHATFCGPVRPYFSLSYSGGKSAAPLIICPMSGIDGFSGHVGNHGHSMETSP

SEQ ID NO: 837588 - protein, 172 aa, Homo sapiens
HNHGFSHGVLIPIGGLLHKCLSILPRGNGHYWEVEVGDKAKWTIGVCEDSVCRKGGVTSAPQNGFWAVSLWYGKEYWALTSPMTALPLRTPLQRVGIFLDYDAGEVSFYNVTERCHTFTFSHATFCGPVRPYFSLSYSGGKSAAPLIICPMSGIDGFSGHVGNHGHSMETSP

SEQ ID NO: 837589 - protein, 69 aa, Homo sapiens
GSTTTPTCCPATRACCCGTPTATLGLGDGSPCGCQAKAVTGALTPGHTDGHGPTWEGEQEQGCACLGPL

SEQ ID NO: 837590 - protein, 69 aa, Homo sapiens; identical to SEQ ID NO: 837589

SEQ ID NO: 837591 - protein, 400 aa, Homo sapiens
MGKNPVRPPRALPPVPSQDDIPLSRPKKKKPRTKNTPASASLEGLAQTAGRRPSEGNEPSTKELKEHPEAPVQRRQKKTRLPLELETSSTQKKSSSSSLLRNENGIDAEPAEEAVIQKPRRKTKKTQPAELQYANELGVEDEDIITDEQTTVEQQSVFTAPTGISQPVGKVFVEKSRRFQAADRSELIKTTENIDVSMDVKPSWTTRDVALTVHRAFRMIGLFSHGFLAGCAVWNIVVIYVLAGDQLSNLSNLLQQYKTLAYPFQSLLYLLLALSTISAFDRIDFAKISVAIRNFLALDPTALASFLYFTALILSLSQQMTSDRIHLYTPSSVNGSLWEAGIEEQILQPWIVVNLVVALLVGLSWLFLSYRPGMDLSEELMFSSEVEEYPDKEKEIKASS

SEQ ID NO: 837592 - protein, 74 aa, Homo sapiens
SSVTPRFPQTNHRHHLGNHGKAVIAAPRSPDFCSWAHYPQLRGPLFGRASLDWPIQVPARLSPQHPRRALRAGY

SEQ ID NO: 837593 - protein, 440 aa, Homo sapiens
PGVPQVPEAAASRGAGLGPPAVAPGQPRGESTMRTDSGARLEEGHLRPPRALPPVPSQDDIPLSRPKKKKPRTKNTPASASLEGLAQTAGRRPSEGNEPSTKELKEHPEAPVQRRQKKTRLPLELETSSTQKKSSSSSLLRNENGIDAEPAEEAVIQKPRRKTKKTQPAELQYANELGVEDEDIITDEQTTVEQQSVFTAPTGISQPVGKVFVEKSRRFQAADRSELIKTTENIDVSMDVKPSWTTRDVALTVHRAFRMIGLFSHGFLAGCAVWNIVVIYVLAGDQLSNLSNLLQQYKTLAYPFQSLLYLLLALSTISAFDRIDFAKISVAIRNFLALDPTALASFLYFTALILSLSQQMTSDRIHLYTPSSVNGSLWEAGIEEQILQPWIVVNLVVALLVGLSWLFLSYRPGMDLSEELMFSSEVEEYPDKEKEIKASS

SEQ ID NO: 837594 - protein, 400 aa, Homo sapiens; identical to SEQ ID NO: 837591

SEQ ID NO: 837595 - protein, 471 aa, Homo sapiens
PGVPQVPEAAASRGAGLGPPAVAPGQPRGESTMRTDSGARLEEGHLRPPRALPPVPSQDDIPLSRPKKKKPRTKNTPASASLEGLAQTAGRRPSEGNEPSTKELKEHPEAPVQRRQKKTRLPLENGVSGLDGRIIGVEGQELEKSGEWSIILEGKLETSSTQKKSSSSSLLRNENGIDAEPAEEAVIQKPRRKTKKTQPAELQYANELGVEDEDIITDEQTTVEQQSVFTAPTGISQPVGKVFVEKSRRFQAADRSELIKTTENIDVSMDVKPSWTTRDVALTVHRAFRMIGLFSHGFLAGCAVWNIVVIYVLAGDQLSNLSNLLQQYKTLAYPFQSLLYLLLALSTISAFDRIDFAKISVAIRNFLALDPTALASFLYFTALILSLSQQMTSDRIHLYTPSSVNGSLWEAGIEEQILQPWIVVNLVVALLVGLSWLFLSYRPGMDLSEELMFSSEVEEYPDKEKEIKASS

SEQ ID NO: 837596 - protein, 350 aa, Homo sapiens
MEPSEGNEPSTKELKEHPEAPVQRRQKKTRLPLELETSSTQKKSSSSSLLRNENGIDAEPAEEAVIQKPRRKTKKTQPAELQYANELGVEDEDIITDEQTTVEQQSVFTAPTGISQPVGKVFVEKSRRFQAADRSELIKTTENIDVSMDVKPSWTTRDVALTVHRAFRMIGLFSHGFLAGCAVWNIVVIYVLAGDQLSNLSNLLQQYKTLAYPFQSLLYLLLALSTISAFDRIDFAKISVAIRNFLALDPTALASFLYFTALILSLSQQMTSDRIHLYTPSSVNGSLWEAGIEEQILQPWIVVNLVVALLVGLSWLFLSYRPGMDLSEELMFSSEVEEYPDKEKEIKASS

SEQ ID NO: 837597 - protein, 453 aa, Homo sapiens
PGVPQVPEAAASRGAGLGPPAVAPGQPRGESTMRTDSGARLEEGHLVSGEGRVGLERWRRPPRALPPVPSQDDIPLSRPKKKKPRTKNTPASASLEGLAQTAGRRPSEGNEPSTKELKEHPEAPVQRRQKKTRLPLELETSSTQKKSSSSSLLRNENGIDAEPAEEAVIQKPRRKTKKTQPAELQYANELGVEDEDIITDEQTTVEQQSVFTAPTGISQPVGKVFVEKSRRFQAADRSELIKTTENIDVSMDVKPSWTTRDVALTVHRAFRMIGLFSHGFLAGCAVWNIVVIYVLAGDQLSNLSNLLQQYKTLAYPFQSLLYLLLALSTISAFDRIDFAKISVAIRNFLALDPTALASFLYFTALILSLSQQMTSDRIHLYTPSSVNGSLWEAGIEEQILQPWIVVNLVVALLVGLSWLFLSYRPGMDLSEELMFSSEVEEYPDKEKEIKASS

SEQ ID NO: 837598 - protein, 409 aa, Homo sapiens
ATAERSYCRMGKNPVRPPRALPPVPSQDDIPLSRPKKKKPRTKNTPASASLEGLAQTAGRRPSEGNEPSTKELKEHPEAPVQRRQKKTRLPLELETSSTQKKSSSSSLLRNENGIDAEPAEEAVIQKPRRKTKKTQPAELQYANELGVEDEDIITDEQTTVEQQSVFTAPTGISQPVGKVFVEKSRRFQAADRSELIKTTENIDVSMDVKPSWTTRDVALTVHRAFRMIGLFSHGFLAGCAVWNIVVIYVLAGDQLSNLSNLLQQYKTLAYPFQSLLYLLLALSTISAFDRIDFAKISVAIRNFLALDPTALASFLYFTALILSLSQQMTSDRIHLYTPSSVNGSLWEAGIEEQILQPWIVVNLVVALLVGLSWLFLSYRPGMDLSEELMFSSEVEEYPDKEKEIKASS

SEQ ID NO: 837599 - protein, 319 aa, Homo sapiens
MAKLETSSTQKKSSSSSLLRNENGIDAEPAEEAVIQKPRRKTKKTQPAELQYANELGVEDEDIITDEQTTVEQQSVFTAPTGISQPVGKVFVEKSRRFQAADRSELIKTTENIDVSMDVKPSWTTRDVALTVHRAFRMIGLFSHGFLAGCAVWNIVVIYVLAGDQLSNLSNLLQQYKTLAYPFQSLLYLLLALSTISAFDRIDFAKISVAIRNFLALDPTALASFLYFTALILSLSQQMTSDRIHLYTPSSVNGSLWEAGIEEQILQPWIVVNLVVALLVGLSWLFLSYRPGMDLSEELMFSSEVEEYPDKEKEIKASS

SEQ ID NO: 837600 - protein, 321 aa, Homo sapiens
MGKNPVRPPRALPPVPSQDDIPLSRPKKKKPRTKNTPASASLEGLAQTAGRRPSEGNEPSTKELKEHPEAPVQRRQKKTRLPLELETSSTQKKSSSSSLLRNENGIDAEPAEEAVIQKPRRKTKKTQPAELQYANELGVEDEDIITDEQTTVEQQSVFTAPTGISQPVGKVFVEKSRRFQAADRSELIKTTENIDVSMDVKPSWTTRDVALTVHRAFRMIGLFSHGFLAGCAVWNIVVIYVLAGDQLSNLSNLLQQYKTLAYPFQSLLYLLLALSTISAFDRIDFAKISVAIRNFLALDPTALASFWKQELRNRFSSHGLW

SEQ ID NO: 837601 - protein, 66 aa, Homo sapiens
IQSNILSTSVVDFNLATDGLGSQPDASMNPVITRFPSLSKLLNSSNLTDAPSSPWTNWLGVLKEAG

SEQ ID NO: 837602 - protein, 265 aa, Homo sapiens
MEEIGILVEKAQDEIPALSVSRPQTGLSFLGPEPEDLEDLYSRYKKLQQELEFLEVQEEYIKDEQKNLKKEFLHAQEEVKRIQSIPLVIGQFLEAVDQNTAIVGSTTGSNYYVRILSTIDRELLKPNASVALHKHSNALVDVLPPEADSSIMMLTSDQKPDVMYADIGGMDIQKQEVREAVELPLTHFELYKQIGIDPPRGVLMYGPPGCGKTMLAKAVAHHTTGCIHPGRGLGVCTESILGEGPPHGPGCVPPGQGECTWPSSS

SEQ ID NO: 837603 - protein, 286 aa, Homo sapiens
NVARYEAWLIIGRGTEAGLVTMEEIGILVEKAQDEIPALSVSRPQTGLSFLGPEPEDLEDLYSRYKKLQQELEFLEVQEEYIKDEQKNLKKEFLHAQEEVKRIQSIPLVIGQFLEAVDQNTAIVGSTTGSNYYVRILSTIDRELLKPNASVALHKHSNALVDVLPPEADSSIMMLTSDQKPDVMYADIGGMDIQKQEVREAVELPLTHFELYKQIGIDPPRGVLMYGPPGCGKTMLAKAVAHHTTGCIHPGRGLGVCTESILGEGPPHGPGCVPPGQGECTWPSSS

SEQ ID NO: 837604 - protein, 265 aa, Homo sapiens; identical to SEQ ID NO: 837602

SEQ ID NO: 837605 - protein, 276 aa, Homo sapiens
HTLVRACAENRPREIGILVEKAQDEIPALSVSRPQTGLSFLGPEPEDLEDLYSRYKKLQQELEFLEVQEEYIKDEQKNLKKEFLHAQEEVKRIQSIPLVIGQFLEAVDQNTAIVGSTTGSNYYVRILSTIDRELLKPNASVALHKHSNALVDVLPPEADSSIMMLTSDQKPDVMYADIGGMDIQKQEVREAVELPLTHFELYKQIGIDPPRGVLMYGPPGCGKTMLAKAVAHHTTGCIHPGRGLGVCTESILGEGPPHGPGCVPPGQGECTWPSSS

SEQ ID NO: 837606 - protein, 265 aa, Homo sapiens; identical to SEQ ID NO: 837602

SEQ ID NO: 837607 - protein, 265 aa, Homo sapiens; identical to SEQ ID NO: 837602

SEQ ID NO: 837608 - protein, 265 aa, Homo sapiens; identical to SEQ ID NO: 837602

SEQ ID NO: 837609 - protein, 255 aa, Homo sapiens
MVARYEAWLIIGRGTEAGLVTMEEIGILVEKAQDEIPALSVSRPQTGLSFLGPEPEDLEDLYSRYKEEVKRIQSIPLVIGQFLEAVDQNTAIVGSTTGSNYYVRILSTIDRELLKPNASVALHKHSNALVDVLPPEADSSIMMLTSDQKPDVMYADIGGMDIQKQEVREAVELPLTHFELYKQIGIDPPRGVLMYGPPGCGKTMLAKAVAHHTTGCIHPGRGLGVCTESILGEGPPHGPGCVPPGQGECTWPSSS

SEQ ID NO: 837610 - protein, 217 aa, Homo sapiens
MEEIGILVEKAQDEIPALSVSRPQTGLSFLGPEPEDLEDLYSRYKKLQQELEFLEVQEEYIKDEQKILSTIDRELLKPNASVALHKHSNALVDVLPPEADSSIMMLTSDQKPDVMYADIGGMDIQKQEVREAVELPLTHFELYKQIGIDPPRGVLMYGPPGCGKTMLAKAVAHHTTGCIHPGRGLGVCTESILGEGPPHGPGCVPPGQGECTWPSSS

SEQ ID NO: 837611 - protein, 293 aa, Homo sapiens
MEEIGILVEKAQDEIPALSVSRPQTGLSFLGPEPEDLEDLYSRYKKLQQELEFLEVQEEYIKDEQKNLKKEFLHAQEEVKRIQSIPLVIGQFLEAVDQNTAIVGSTTGSNYYVRILSTIDRELLKPNASVALHKHSNALVDVLPPEADSSIMMLTSGKGGACSWEGPMGTLRTWPGAPALLLPPDQKPDVMYADIGGMDIQKQEVREAVELPLTHFELYKQIGIDPPRGVLMYGPPGCGKTMLAKAVAHHTTGCIHPGRGLGVCTESILGEGPPHGPGCVPPGQGECTWPSSS

SEQ ID NO: 837612 - protein, 187 aa, Homo sapiens
MCSAWPRRMHLAIIFIDEIDAIATKRFDAQTGADREVQRILLELLNQMDGFDQNVNVKVIMATNRADTLDPALLRPGRLDRKIEFPLPDRRQKRLIFSTITSKMNLSEEVDLEDYVARPDKISGADINSICQESGTGGCPVKPYIVLGRLRKAIRLAHEGAHGLISVTFPLPNIGWVFPPLSNLPFF

SEQ ID NO: 837613 - protein, 135 aa, Homo sapiens
MEEIGILVEKAQDEIPALSVSRPQTGLSFLGPEPEDLEDLYSRYKKLQQELEFLEVQEEYIKDEQKNLKKEFLHAQEEVKRIQSIPLVIGQFLEAVDQNTAIVGSTTGVLRTPHSFICPLNNYFLPCARQQQTRQ

SEQ ID NO: 837614 - protein, 166 aa, Homo sapiens
VGPLGFPAKRSLLILKRSCSFPPKKSFLKGPQEVEILLDLLNEDGGFDQDFNFKVIMATNRADTLDPALLRPGRLDRKIEFPLPDRRQKRLIFSTITSKMNLSEEVDLEDYVARPDKISGADINSICQESGMLAVRENRYIVLAKDFEKAYKTVIKKDEQEHEFYK

SEQ ID NO: 837615 - protein, 265 aa, Homo sapiens; identical to SEQ ID NO: 837602

SEQ ID NO: 837616 - protein, 265 aa, Homo sapiens; identical to SEQ ID NO: 837602

SEQ ID NO: 837617 - protein, 265 aa, Homo sapiens; identical to SEQ ID NO: 837602

SEQ ID NO: 837618 - protein, 265 aa, Homo sapiens; identical to SEQ ID NO: 837602

SEQ ID NO: 837619 - protein, 265 aa, Homo sapiens; identical to SEQ ID NO: 837602

SEQ ID NO: 837620 - protein, 265 aa, Homo sapiens; identical to SEQ ID NO: 837602

SEQ ID NO: 837621 - protein, 265 aa, Homo sapiens; identical to SEQ ID NO: 837602

SEQ ID NO: 837622 - protein, 170 aa, Homo sapiens
MCSAWPRRMHLAIIFIDEIDAIATKRFDAQTGADREVQRILLELLNQMDGFDQNVNVKVIMATNRADTLDPALLRPGRLDRKIEFPLPDRRQKRLIFSTITSKMNLSEEVDLEDYVARPDKISGADINSICQESGMLAVRENRYIVLAKDFEKAYKTVIKKDEQEHEFYK

SEQ ID NO: 837623 - protein, 178 aa, Homo sapiens
RQGDGVNRTRQNQPFVGSTTGSNYYVRILSTIDRELLKPNASVALHKHSNALVDVLPPEADSSIMMLTSDQKPDVMYADIGGMDIQKQEVREAVELPLTHFELYKQIGIDPPRGVLMYGPPGCGKTMLAKAVAHHTTGCIHPGRGLGVCTESILGEGPPHGPGCVPPGQGECTWPSSS

SEQ ID NO: 837624 - protein, 786 aa, Homo sapiens
GRWRRCRRPPEEPPVAAQVAAQVAAPVALPSPPTPSDGGTKRPGLRALKKMGLTEDEDVRAMLRGSRLRKIRSRTWHKERLYRLQEDGLSVWFQRRIPRAPSQHIFFVQHIEAVREGHQSEGLRRFGGAFAPARCLTIAFKGRRKNLDLAAPTAEEAQRWVRGLTKLRARLDAMSQRERLDHWIHSYLHRADSNQDSKMSFKEIKSLLRMVNVDMNDMYAYLLFKECDHSNNDRLEGAEIEEFLRRLLKRPELEEIFHQYSGEDRVLSAPELLEFLEDQGEEGATLARAQQLIQTYELNETAKQHELMTLDGFMMYLLSPEGAALDNTHTCVFQDMNQPLAHYFISSSHNTYLTDSQIGGPSSTEAYVRAFAQGCRCVELDCWEGPGGEPVIYHGHTLTSKILFRDVVQAVRDHAFTLSPYPVILSLENHCGLEQQAAMARHLCTILGDMLVTQALDSPNPEELPSPEQLKGRVLVKGKKLPAARSEDGRALSDREEEEEDDEEEEEEVEAAAQRRLAKQISPELSALAVYCHATRLRTLHPAPNAPQPCQVSSLSERKAKKLIREAGNSFVRHNARQLTRVYPLGLRMNSANYSPQEMWNSGCQLVALNFQTPGYEMDLNAGRFLVNGQCGYVLKPACLRQPDSTFDPEYPGPPRTTLSIQVLTAQQLPKLNAEKPHSIVDPLVRIEIHGVPADCARQETDYVLNNGFNPRWGQTLQFQLRAPELALVRFVVEDYDATSPNDFVGQFTLPLSSLKQGYRHIHLLSKDGASLSPATLFIQIRIQRS

SEQ ID NO: 837625 - protein, 770 aa, Homo sapiens
GRWRRCRRPPEEPPVAAQVAAQVAAPVALPSPPTPSDGGTKRPGLRALKKMGLTEDEDVRAMLRGSRLRKIRSRTWHKERLYRLQEDGLSVWFQRRIPRAPSQHIFFVQHIEAVREGHQSEGLRRFGGAFAPARCLTIAFKGRRKNLDLAAPTAEEAQRWVRGLTKLRARLDAMSQRERLDHWIHSYLHRADSNQDSKMSFKEIKSLLRMVNVDMNDMYAYLLFKECDHSNNDRLEGAEIEEFLRRLLKRPELEEIFHQYSGEDRVLSAPELLEFLEDQGEEGATLARAQQLIQTYELNETAKQHELMTLDGFMMYLLSPEGAALDNTHTCVFQDMNQPLAHYFISSSHNTYLTDSQIGGPSSTEAYVRAFAQGCRCVELDCWEGPGGEPVIYHGHTLTSKILFRDVVQAVRDHAFTLSPYPVILSLENHCGLEQQAAMARHLCTILGDMLVTQALDSPNPEELPSPEQLKGRVLVKGKKLPAARSEDGRALSDREEEEEDDEEEEEEVEAAAQRRLAKQISPELSALAVYLPRHPPADPAPCPQRPTTLPGNSFVRHNARQLTRVYPLGLRMNSANYSPQEMWNSGCQLVALNFQTPGYEMDLNAGRFLVNGQCGYVLKPACLRQPDSTFDPEYPGPPRTTLSIQVLTAQQLPKLNAEKPHSIVDPLVRIEIHGVPADCARQETDYVLNNGFNPRWGQTLQFQLRAPELALVRFVVEDYDATSPNDFVGQFTLPLSSLKQGYRHIHLLSKDGASLSPATLFIQIRIQRS

SEQ ID NO: 837626 - protein, 786 aa, Homo sapiens; identical to SEQ ID NO: 837624

SEQ ID NO: 837627 - protein, 786 aa, Homo sapiens; identical to SEQ ID NO: 837624

SEQ ID NO: 837628 - protein, 736 aa, Homo sapiens
GRWRRCRRPPEEPPVAAQVAAQVAAPVALPSPPTPSDGGTKRPGLRALKKMGLTEDEDVRAMLRGSRLRKIRSRTWHKERLYRLQEDGLSVWFQRRIPRAPSQHIFFVQHIEAVREGHQSEGLRRFGGAFAPARCLTIAFKGRRKNLDLAAPTAEEAQRWVRGLTKLRARLDAMSQRERLDHWIHSYLHRADSNQDSKMSFKEIKSLLRMVNVDMNDMYAYLLFKECDHSNNDRLEGAEIEEFLRRLLKRPELEEIFHQYSGEDRVLSAPELLEFLEDQGEEGATLARAQQLIQTYELNETAKQHELMTLDGFMMYLLSPEGAALDNTHTCVFQDMNQPLAHYFISSSHNTYLTDSQIGGPSSTEAYVRAFAQGCRCVELDCWEGPGGEPVIYHGHTLTSKILFRDVVQAVRDHAFTLSPYPVILSLENHCGLEQQAAMARHLCTILGDMLVTQALDSPNPEELPSPEQLKGRVLVKGKKLPAARSEDGRALSDREEEEEDDEEEEEEVEAAAQRRLAKQISPELSALAVYCHATRLRTLHPAPNAPQPCQVSSLSERKAKKLIREAGNSFVRHNARQLTRVYPLGLRMNSANYSPQEMWNSGCQLVALNFQTPGYEMDLNAGRFLVNGQCGYVLKPACLRQPDSTFDPEYPGPPRTTLSIQVLTAQQLPKLNAEKPHSIVDPLVRIEIHGVPADCARQETDYVLNNGYRHIHLLSKDGASLSPATLFIQIRIQRS

SEQ ID NO: 837629 - protein, 901 aa, Homo sapiens
GRWRRCRRPPEEPPVAAQVAAQVAAPVALPSPPTPSDGGTKRPGLRALKKMGLTEDEDVRAMLRGSRLRKIRSRTWHKERLYRLQEDGLSVWFQRRIPRAPSQHIFFVQHIEAVREGHQSEGLRRFGGAFAPARCLTIAFKGRRKNLDLAAPTAEEAQRWVRGLTKLRARLDAMSQRERLDHWIHSYLHRADSNQDSKMSFKEIKSLLRMVNVDMNDMYAYLLFKECDHSNNDRLEGAEIEEFLRRLLKRPELEEIFHQYSGEDRVLSAPELLEFLEDQGEEGATLARAQQLIQTYELNETAKQHELMTLDGFMMYLLSPEGAALDNTHTCVFQDMNQPLAHYFISSSHNTYLTDSQIGGPSSTEAYVRAFAQGCRCVELDCWEGPGGEPVIYHGHTLTSKILFRDVVQAVRDHAFTLSPYPVILSLENHCGLEQQAAMARHLCTILGDMLVTQALDSPNPEELPSPEQLKGRVLVKGKKLPAARSEDGRALSDREEEEEDDEEEEEEVEAAAQRRLAKQISPELSALAVYCHATRLRTLHPAPNAPQPCQVSSLSERKAKKLIREAGNSFVRHNARQLTRVYPLGLRMNSANYSPQEMWNSGCQLVALNFQTPGYEMDLNAGRFLVNGQCGYVLKPACLRQPDSTFDPEYPGPPRTTLSIQVLTAQQLPKLNAEKPHSIVDPLVRIEIHGVPADCARQETDYVLNNGFNPRWGQTLQFQLRAPELALVRFVVEDYDATSPNDFVGQFTLPLSSLKQGYRHIHLLSKDGASLSPATLFIQIRIQRSLSSPLSSRGPSQPPSPRGAQSLHLAPTPSLAPKPSFTPGLPGLLPPAPEPELPFPSQSKKGALRHEALGKLAVGFGFYFLRQGLAPSPRLECNVAIMAHCSFELPGSSDPPISAS

SEQ ID NO: 837630 - protein, 374 aa, Homo sapiens
GRWRRCRRPPEEPPVAAQVAAQVAAPVALPSPPTPSDGGTKRPGLRALKKMGLTEDEDVRAMLRGSRLRKIRSRTWHKERLYRLQEDGLSVWFQRRIPRAPSQHIFFVQHIEAVREGHQSEGLRRFGGAFAPARCLTIAFKGRRKNLDLAAPTAEEAQRWVRGLTKLRARLDAMSQRERLDHWIHSYLHRADSNQDSKMSFKEIKSLLRMVNVDMNDMYAYLLFKECDHSNNDRLEGAEIEEFLRRLLKRPELEEIFHQYSGEDRVLSAPELLEFLEDQGEEGATLARAQQLIQTYELNETAKQHELMTLDGFMMYLLSPEGAALDNTHTCVFQDMNQPLAHYFISSSHNTYLTDSQIGGPSSTEAYVRYCSRG

SEQ ID NO: 837631 - protein, 818 aa, Homo sapiens
GRWRRCRRPPEEPPVAAQVAAQVAAPVALPSPPTPSDGGTKRPGLRALKKMGLTEDEDVRAMLRGSRLRKIRSRTWHKERLYRLQEDGLSVWFQRRIPRAPSQHIFFVQHIEAVREGHQSEGLRRFGGAFAPARCLTIAFKGRRKNLDLAAPTAEEAQRWVRGLTKLRARLDAMSQRERLDHWIHSYLHRADSNQDSKMSFKEIKSLLRMVNVDMNDMYAYLLFKECDHSNNDRLEGAEIEEFLRRLLKRPELEEIFHQYSGEDRVLSAPELLEFLEDQGEEGATLARAQQLIQTYELNETAKQHELMTLDGFMMYLLSPEGAALDNTHTCVFQDMNQPLAHYFISSSHNTYLTDSQIGGPSSTEAYVRAFAQGCRCVELDCWEGPGGEPVIYHGHTLTSKILFRDVVQAVRDHAFTLSPYPVILSLENHCGLEQQAAMARHLCTILGDMLVTQALDSPNPEELPSPEPAPHKAVVEELTDWLPQGREGLTLHPPRWPPQQLKGRVLVKGKKLPAARSEDGRALSDREEEEEDDEEEEEEVEAAAQRRLAKQISPELSALAVYCHATRLRTLHPAPNAPQPCQVSSLSERKAKKLIREAGNSFVRHNARQLTRVYPLGLRMNSANYSPQEMWNSGCQLVALNFQTPGYEMDLNAGRFLVNGQCGYVLKPACLRQPDSTFDPEYPGPPRTTLSIQVLTAQQLPKLNAEKPHSIVDPLVRIEIHGVPADCARQETDYVLNNGFNPRWGQTLQFQLRAPELALVRFVVEDYDATSPNDFVGQFTLPLSSLKQGYRHIHLLSKDGASLSPATLFIQIRIQRS

SEQ ID NO: 837632 - protein, 753 aa, Homo sapiens
GRWRRCRRPPEEPPVAAQVAAQVAAPVALPSPPTPSDGGTKRPGLRALKKMGLTEDEDVRAMLRGSRLRKIRSRTWHKERLYRLQEDGLSVWFQRRIPRAPSQHIFFVQHIEAVREGHQSEGLRRFGGAFAPARCLTIAFKGRRKNLDLAAPTAEEAQRWVRGLTKLRARLDAMSQRERLDHWIHSYLHRADSNQDSKMSFKEIKSLLRMVNVDMNDMYAYLLFKECDHSNNDRLEGAEIEEFLRRLLKRPELEEIFHQYSGEDRVLSAPELLEFLEDQGEEGATLARAQQLIQTYELNETGHEPAPCPLLHLFLPQTYLTDSQIGGPSSTEAYVRAFAQGCRCVELDCWEGPGGEPVIYHGHTLTSKILFRDVVQAVRDHAFTLSPYPVILSLENHCGLEQQAAMARHLCTILGDMLVTQALDSPNPEELPSPEQLKGRVLVKGKKLPAARSEDGRALSDREEEEEDDEEEEEEVEAAAQRRLAKQISPELSALAVYCHATRLRTLHPAPNAPQPCQVSSLSERKAKKLIREAGNSFVRHNARQLTRVYPLGLRMNSANYSPQEMWNSGCQLVALNFQTPGYEMDLNAGRFLVNGQCGYVLKPACLRQPDSTFDPEYPGPPRTTLSIQVLTAQQLPKLNAEKPHSIVDPLVRIEIHGVPADCARQETDYVLNNGFNPRWGQTLQFQLRAPELALVRFVVEDYDATSPNDFVGQFTLPLSSLKQGYRHIHLLSKDGASLSPATLFIQIRIQRS

SEQ ID NO: 837633 - protein, 219 aa, Homo sapiens
MKARGYWRGRQLTRVYPLGLRMNSANYSPQEMWNSGCQLVALNFQTPGYEMDLNAGRFLVNGQCGYVLKPACLRQPDSTFDPEYPGPPRTTLSIQVLTAQQLPKLNAEKPHSIVDPLVRIEIHGVPADCARQETDYVLNNGFNPRWGQTLQFQLRAPELALVRFVVEDYDATSPNDFVGQFTLPLSSLKQGYRHIHLLSKDGASLSPATLFIQIRIQRS

SEQ ID NO: 837634 - protein, 149 aa, Homo sapiens [sequence omitted]

SEQ ID NO: 837635 - protein, 103 aa, Homo sapiens
RLQFVPFQFYSDIARSDYAARSDYAARSDYAARSDYAARSDYAARSDYAARSDSRLIPHTSSKDSYWEKPYHCNRCGKTFYDCTDFSQHPGTFIRERVFEYHH

SEQ ID NO: 837636 - protein, 434 aa, Homo sapiens
ITQKQVSTEGDLYECDSHGPVTDALIREEKNSYKCEECGKVFKKNALLVQHERIHTQVKPYECTECGKTFSKSTHLLQHLIIHTGEKPYKCMECGKAFNRRSHLTRHQRIHSGEKPYKCSECGKAFTHRSTFVLHHRSHTGEKPFVCKECGKAFRDRPGFIRHYIIHTGEKPYECIECGKAFNRRSYLTWHQQIHTGVKPFECNECGKAFCESADLIQHYIIHTGEKPYKCMECGKAFNRRSHLKQHQRIHTGEKPYECSECGKAFTHCSTFVLHKRTHTGEKPYECKECGKAFSDRADLIRHFSIHTGEKPYECVECGKAFNRSSHLTRHQQIHTGEKPYECIQCGKAFCRSANLIRHSIIHTGEKPYECSECGKAFNRGSSLTHHQRIHTGRNPTIVTDVGRPFMTAQTSVNIQELLLGKEFLNITTEENLW

SEQ ID NO: 837637 - protein, 207 aa, Homo sapiens
MKWVWALLLLAALGSGRAERDCRVSSFRVKENFDKARFSGTWYAMAKKDPEGLFLQDNIVAEFSVDETGQMSATAKGRVRLLNNWDVCADMVGTFTDTEDPAKFKMKYWGVASFLQKGNDDHWIVDTDYDTYAVQYSCRLLNLDGTCAGQLLLRVFPGPQRPAPRSAEDCKAAAGGAVPGQAVQADRPQRLLRWQIRKKPFVAISRI

SEQ ID NO: 837638 - protein, 207 aa, Homo sapiens; identical to SEQ ID NO: 837637

SEQ ID NO: 837639 - protein, 213 aa, Homo sapiens
LFFCVLSCLLFTASCSLMLGSGRAERDCRVSSFRVKENFDKARFSGTWYAMAKKDPEGLFLQDNIVAEFSVDETGQMSATAKGRVRLLNNWDVCADMVGTFTDTEDPAKFKMKYWGVASFLQKGNDDHWIVDTDYDTYAVQYSCRLLNLDGTCAGQLLLRVFPGPQRPAPRSAEDCKAAAGGAVPGQAVQADRPQRLLRWQIRKKPFVAISRI

SEQ ID NO: 837640 - protein, 205 aa, Homo sapiens
MNYSKIPAQVDLRRQAERDCRVSSFRVKENFDKARFSGTWYAMAKKDPEGLFLQDNIVAEFSVDETGQMSATAKGRVRLLNNWDVCADMVGTFTDTEDPAKFKMKYWGVASFLQKGNDDHWIVDTDYDTYAVQYSCRLLNLDGTCAGQLLLRVFPGPQRPAPRSAEDCKAAAGGAVPGQAVQADRPQRLLRWQIRKKPFVAISRI

SEQ ID NO: 837641 - protein, 215 aa, Homo sapiens
PGLQDSARARTLRADLRAGPLSGGGFLGKMKWVWALLLLAALGSGRAERDCRVSSFRVKENFDKARFSGTWYAMAKKDPEGLFLQDNIVADNWDVCADMVGTFTDTEDPAKFKMKYWGVASFLQKGNDDHWIVDTDYDTYAVQYSCRLLNLDGTCAGQLLLRVFPGPQRPAPRSAEDCKAAAGGAVPGQAVQADRPQRLLRWQIRKKPFVAISRI

SEQ ID NO: 837642 - protein, 186 aa, Homo sapiens
MKWVWALLLLAALGSGRAERDCRVSSFRVKENFDKARFSGTWYAMAKKDPEGLFLQDNIVAEFSVDETGQMSATAKGRVRLLNNWDVCADMVGTFTDTEDPAKFKMKYWGVASFLQKGNDDHWIVDTDYDTYAVQYSCRLLNLDGTCAGQAQKIVRQRQEELCLARQYRLIVHNGYCDGRSERNLL

SEQ ID NO: 837643 - protein, 207 aa, Homo sapiens; identical to SEQ ID NO: 837637

SEQ ID NO: 837644 - protein, 207 aa, Homo sapiens; identical to SEQ ID NO: 837637

SEQ ID NO: 837645 - protein, 236 aa, Homo sapiens
PGLQDSARARTLRADLRAGPLSGGGFLGKMKWVWALLLLAALGSGRAERDCRVSSFRVKENFDKARFSGTWYAMAKKDPEGLFLQDNIVAEFSVDETGQMSATAKGRVRLLNNWDVCADMVGTFTDTEDPAKFKMKYWGVASFLQKGNDDHWIVDTDYDTYAVQYSCRLLNLDGTCAGQLLLRVFPGPQRPAPRSAEDCKAAAGGAVPGQAVQADRPQRLLRWQIRKKPFVAISRI

SEQ ID NO: 837646 - protein, 207 aa, Homo sapiens; identical to SEQ ID NO: 837637

SEQ ID NO: 837647 - protein, 137 aa, Homo sapiens
MKWVWALLLLAALGSGRAERDCRVSSFRVKENFDKARFSGTWYAMAKKDPEGLFLQDNIVAEFSVDETGQMSATAKGRVRLLNNWDVCADMVGTFTDTEDPAKFKMKYWGVASFLQKGTLRNTYNLNSVAQLCLCEL

SEQ ID NO: 837648 - protein, 135 aa, Homo sapiens
YVLTHPYVLTLSSILRFFVKSLANKTSDWLGYMRFLIIPLGSHPVAKYLGSVDSKYSSSFLDSGWRDLFSRSEPPVSEQLDVAGRVMQYVNGAATTHQLPVAEAMLTCRHKFPDEDSYQKFIPFIGVSTDSLCLA

SEQ ID NO: 837649 - protein, 985 aa, Homo sapiens
MAERGGAGGGPGGAGGGSGQRGSGVAQSPQQPPPQQQQQQPPQQPTPPKLAQATSSSSSTSAAAASSSSSSTSTSMAVAVASGSAPPGVCPVGAQCRNSPATGVHDATLYRRPCGSVAPGSLDPSVRCTEVLIQAIGPAERKPLSIAKEDKCDKKILKLSVVIGLVKARRGSKRILRSNEIVLPASGLVETELQLTFSLQYPHFLKRDANKLQIMLQRRKRYKNRTILGYKTLAVGLINMAEVMQHPNEGALVLGLHSNVKDVSVPVAEIKIYSLSSQPIDHEGIKSKLSDRSPDIDNYSEEEEESFSSEQEGSDDPLHGQDLFYEDEDLRKVKKTRRKLTSTSAITRQPNIKQKFVALLKRFKVSDEVGFGLEHVSREQIREVEEDLDELYDSLEMYNPSDSGPEMEETESILSTPKPKLKPFFEGMSQSSSQTEIGSLNSKGSLGKDTTSPMELAALEKIKSTWIKNQDDSLTETDTLEITDQDMFGDASTSLVVPEKVKTPMKSSKTDLQGSASPSKVEGVHTPRQKRSTPLKERQLSKPLSERTNSSDSERSPDLGHSTQIPRKVVYDQLNQILVSDAALPENVILVNTTDWQGQYVAELLQDQRKPVVCTCSTVEVQAVLSALLTRIQRYCNCNSSMPRPVKVAAVGGQSYLSSILRFFVKSLANKTSDWLGYMRFLIIPLGSHPVAKYLGSVDSKYSSSFLDSGWRDLFSRSEPPVSEQLDVAGRVMQYVNGAATTHQLPVAEAMLTCRHKFPDEDSYQKFIPFIGVVKVGLVEDSPSTAGDGDDSPVVSLTVPSTSPPSSSGLSRDATATPPSSPSMSSALAIVGSPNSPYGDVIGLQVDYWLGHPGERRREGDKRDASSKNTLKSVFRSVQVSRLPHSGEAQLSGTMAMTVVTKEKNKKVPTIFLSKKPREKEVDSKSQVIEGISRLICSAKQQQTMLRVSIDGVEWSDIKFFQLAAQWPTHVKHFPVGLFSGSKAT

SEQ ID NO: 837650 - protein, 976 aa, Homo sapiens
MAERGGAGGGPGGAGGGSGQRGSGVAQSPQQPPPQQQQQQPPQQPTPPKLAQATSSSSSTSAAAASSSSSSTSTSMAVAVASGSAPPGGPGPGRTPAPVQMNLYATWEVDRSSSSCVPRLFSLTLKKLVMLKEMDKDLNSVVIAVKLQGSKRILRSNEIVLPASGLVETELQLTFSLQYPHFLKRDANKLQIMLQRRKRYKNRTILGYKTLAVGLINMAEVMQHPNEGALVLGLHSNVKDVSVPVAEIKIYSLSSQPIDHEGIKSKPTIDHEGIKSKLSVSDRSPDIDNYSEEEEESFSSEQEGSDDPLHGQDLFYEDEDLRKVKKTRRKLTSTSAITRQPNIKQKFVALLKRFKVSDEVGFGLEHVSREQIREVEEDLDELYDSLEMYNPSDSGPEMEETESILSTPKPKLKPFFEGMSQSSSQTEIGSLNSKGSLGKDTTSPMELAALEKIKSTWIKNQDDSLTETDTLEITDQDMFGDASTSLVVPEKVKTPMKSSKTDLQGSASPSKVEGVHTPRQKRSTPLKERQLSKPLSERTNSSDSERSPDLGHSTQIPRKVVYDQLNQILVSDAALPENVILVNTTDWQGQYVAELLQDQRKPVVCTCSTVEVQAVLSALLTRIQRYCNCNSSMPRPVKVAAVGGQSYLSSILRFFVKSLANKTSDWLGYMRFLIIPLGSHPVAKYLGSVDSKYSSSFLDSGWRDLFSRSEPPVSEQLDVAGRVMQYVNGAATTHQLPVAEAMLTCRHKFPDEDSYQKFIPFIGVVKVGLVEDSPSTAGDGDDSPVVSLTVPSTSPPSSSGLSRDATATPPSSPSMSSALAIVGSPNSPYGDVIGLQVDYWLGHPGERRREGDKRDASSKNTLKSVFRSVQVSRLPHSGEAQLSGTMAMTVVTKEKNKKVPTIFLSKKPREKEVDSKSQVIEGISRLICSAKQQQTMLRVSIDGVEWSDIKFFQLAAQWPTHVKHFPVGLFSGSKAT

SEQ ID NO: 837651 - protein, 730 aa, Homo sapiens
MHSNVKDVSVPVAEIKIYSLSSQPIDHEGIKSKLSDRSPDIDNYSEEEEESFSSEQEGSDDPLHGQDLFYEDEDLRKVKKTRRKLTSTSAITRQPNIKQKFVALLKRFKVSDEVGFGLEHVSREQIREVEEDLDELYDSLEMYNPSDSGPEMEETESILSTPKPKLKPFFEGMSQSSSQTEIGSLNSKGSLGKDTTSPMELAALEKIKSTWIKNQDDSLTETDTLEITDQDMFGDASTSLVVPEKVKTPMKSSKTDLQGSASPSKVEGVHTPRQKRSTPLKERQLSKPLSERTNSSDSERSPDLGHSTQIPRKVVYDQLNQILVSDAALPENVILVNTTDWQGQYVAELLQDQRKPVVCTCSTVEVQAVLSALLTRIQRYCNCNSSMPRPVKVAAVGGQSYLSSILRFFVKSLANKTSDWLGYMRFLIIPLGSHPVAKYLGSVDSKYSSSFLDSGWRDLFSRSEPPVSEQLDVAGRVMQYVNGAATTHQLPVAEAMLTCRHKFPDEDSYQKFIPFIGVVKVGLVEDSPSTAGDGDDSPVVSLTVPSTSPPSSSGLSRDATATPPSSPSMSSALAIVGSPNSPYGDVIGLQVDYWLGHPGERRREGDKRDASSKNTLKSVFRSVQVSRLPHSGEAQLSGTMAMTVVTKEKNKKVPTIFLSKKPREKEVDSKSQVIEGISRLICSAKQQQTMLRVSIDGVEWSDIKFFQLAAQWPTHVKHFPVGLFSGSKAT

SEQ ID NO: 837652 - protein, 879 aa, Homo sapiens
MAERGGAGGGPGGAGGGSGQRGSGVAQSPQQPPPQQQQQQPPQQPTPPKLAQATSSSSSTSAAAASSSSSSTSTSMAVAVASGSAPPGGPGPGRTPAPVQMNLYATWEVDRSSSSCVPRLFSLTLKKLVMLKEMDKDLNSVVIAVKLQGSKRILRSNEIVLPASGLVETELQLTFSLQYPHFLKRDANKLQIMLQRRKRYKNRTILGYKTLAVGLINMAEVMQHPNEGALVLGLHSNVKDVSVPVAEIKIYSLSSQPIDHEGIKSKLSDRSPDIDNYSEEEEESFSSEQEGSDDPLHGQDLFYEDEDLRKVKKTRRKLTSTSAITRQPNIKQKFVALLKRFKVSDEVGFGLEHVSREQIREVEEDLDELYDSLEMYNPSDSGPEMEETESILSTPKPKLKPFFEGMSQSSSQTEIGSLNSKGSLGKDTTSPMELAALEKIKSTWIKNQDDSLTETDTLIPRKVVYDQLNQILVSDAALPENVILVNTTDWQGQYVAELLQDQRKPVVCTCSTVEVQAVLSALLTRIQRYCNCNSSMPRPVKVAAVGGQSYLSSILRFFVKSLANKTSDWLGYMRFLIIPLGSHPVAKYLGSVDSKYSSSFLDSGWRDLFSRSEPPVSEQLDVAGRVMQYVNGAATTHQLPVAEAMLTCRHKFPDEDSYQKFIPFIGVVKVGLVEDSPSTAGDGDDSPVVSLTVPSTSPPSSSGLSRDATATPPSSPSMSSALAIVGSPNSPYGDVIGLQVDYWLGHPGERRREGDKRDASSKNTLKSVFRSVQVSRLPHSGEAQLSGTMAMTVVTKEKNKKVPTIFLSKKPREKEVDSKSQVIEGISRLICSAKQQQTMLRVSIDGVEWSDIKFFQLAAQWPTHVKHFPVGLFSGSKAT

SEQ ID NO: 837653 - protein, 629 aa, Homo sapiens
MTLNSETPFSLQVGFGLEHVSREQIREVEEDLDELYDSLEMYNPSDSGPEMEETESILSTPKPKLKPFFEGMSQSSSQTEIGSLNSKGSLGKDTTSPMELAALEKIKSTWIKNQDDSLTETDTLEITDQDMFGDASTSLVVPEKVKTPMKSSKTDLQGSASPSKVEGVHTPRQKRSTPLKERQLSKPLSERTNSSDSERSPDLGHSTQIPRKVVYDQLNQILVSDAALPENVILVNTTDWQGQYVAELLQDQRKPVVCTCSTVEVQAVLSALLTRIQRYCNCNSSMPRPVKVAAVGGQSYLSSILRFFVKSLANKTSDWLGYMRFLIIPLGSHPVAKYLGSVDSKYSSSFLDSGWRDLFSRSEPPVSEQLDVAGRVMQYVNGAATTHQLPVAEAMLTCRHKFPDEDSYQKFIPFIGVVKVGLVEDSPSTAGDGDDSPVVSLTVPSTSPPSSSGLSRDATATPPSSPSMSSALAIVGSPNSPYGDVIGLQVDYWLGHPGERRREGDKRDASSKNTLKSVFRSVQVSRLPHSGEAQLSGTMAMTVVTKEKNKKVPTIFLSKKPREKEVDSKSQVIEGISRLICSAKQQQTMLRVSIDGVEWSDIKFFQLAAQWPTHVKHFPVGLFSGSKAT

SEQ ID NO: 837654 - protein, 345 aa, Homo sapiens
KKKKKLNAEPPVSARGLSSILRFFVKSLANKTSDWLGYMRFLIIPLGSHPVAKYLGSVDSKYSSSFLDSGWRDLFSRSEPPVSEQLDVAGRVMQYVNGAATTHQLPVAEAMLTCRHKFPDEDSYQKFIPFIGVVKVGLVEDSPSTAGDGDDSPVVSLTVPSTSPPSSSGLSRDATATPPSSPSMSSALAIVGSPNSPYGDVIGLQVDYWLGHPGERRREGDKRDASSKNTLKSVFRSVQVSRLPHSGEAQLSGTMAMTVVTKEKNKKVPTIFLSKKPREKEVDSKSQVIEGISRLICSAKQQQTMLRVSIDGVEWSDIKFFQLAAQWPTHVKHFPVGLFSGSKAT

SEQ ID NO: 837655 - protein, 963 aa, Homo sapiens
MAERGGAGGGPGGAGGGSGQRGSGVAQSPQQPPPQQQQQQPPQQPTPPKLAQATSSSSSTSAAAASSSSSSTSTSMAVAVASGSAPPGGPGPGRTPAPVQMNLYATWEVDRSSSSCVPRLFSLTLKKLVMLKEMDKDLNSVVIAVKLQGSKRILRSNEIVLPASGLVETELQLTFSLQYPHFLKRDANKLQIMLQRRKRYKNRTILGYKTLAVGLINMAEVMQHPNEGALVLGLHSNVKDVSVPVAEIKIYSLSSQPIDHEGIKSKLSDRSPDIDNYSEEEEESFSSEQEGSDDPLHGQDLFYEDEDLRKVKKTRRKLTSTSAITRQPNIKQKFVALLKRFKVSDEVGFGLEHVSREQIREVEEDLDELYDSLEMYNPSDSGPEMEETESILSTPKPKLKPFFEGMSQSSSQTEIGSLNSKGSLGKDTTSPMELAALEKIKSTWIKNQDDSLTETDTLEITDQDMFGDASTSLVVPEKVKTPMKSSKTDLQGSASPSKVEGVHTPRQKRSTPLKERQLSKPLSERTNSSDSERSPDLGHSTQIPRKVVYDQLNQILVSDAALPENVILVNTTDWQGQYVAELLQDQRKPVVCTCSTVEVQAVLSALLTRIQRYCNCNSSMPRPVKVAAVGGQSYLSSILRFFVKSLANKTSDWLGYMRFLIIPLGSHPVAKYLGSVDSKYSSSFLDSGWRDLFSRSEPPVSEQLDVAGRVMQYVNGAATTHQLPVAEAMLTCRHKFPDEDSYQKFIPFIGVVKVGLVEDSPSTAGDGDDSPVVSLTVPSTSPPSSSGLSRDATATPPSSPSMSSALAIVGSPNSPYGDVIGLQVDYWLGHPGERRREGDKRDASSKNTLKSVFRSVQVSRLPHSGEAQLSGTMAMTVVTKEKNKKVPTIFLSKKPREKEVDSKSQVIEGISRLICSAKQQQTMLRVSIDGVEWSDIKFFQLAAQWPTHVKHFPVGLFSGSKAT

SEQ ID NO: 837656 - protein, 162 aa, Homo sapiens [sequence omitted]

SEQ ID NO: 837657 - protein, 195 aa, Homo sapiens
AGRVAPAAVLRLHWSRPQGFCRAQAFSPARGSVWPRLCLLGVSPNSPYGDVIGLQVDYWLGHPGERRREGDKRDASSKNTLKSVFRSVQVSRLPHSGEAQLSGTMAMTVVTKEKNKKVPTIFLSKKPREKEVDSKSQVIEGISRLICSAKQQQTMLRVSIDGVEWSDIKFFQLAAQWPTHVKHFPVGLFSGSKAT

SEQ ID NO: 837658 - protein, 963 aa, Homo sapiens; identical to SEQ ID NO: 837655

SEQ ID NO: 837659 - protein, 963 aa, Homo sapiens; identical to SEQ ID NO: 837655

SEQ ID NO: 837660 - protein, 963 aa, Homo sapiens; identical to SEQ ID NO: 837655

SEQ ID NO: 837661 - protein, 786 aa, Homo sapiens
MAERGGAGGGPGGAGGGSGQRGSGVAQSPQQPPPQQQQQQPPQQPTPPKLAQATSSSSSTSAAAASSSSSSTSTSMAVAVASGSAPPGGPGPGRTPAPVQMNLYATWEVDRSSSSCVPRLFSLTLKKLVMLKEMDKDLNSVVIAVKLQGSKRILRSNEIVLPASGLVETELQLTFSLQYPHFLKRDANKLQIMLQRRKRYKNRTILGYKTLAVGLINMAEVMQHPNEGALVLGLHSNVKDVSVPVAEIKIYSLSSQPIDHEGIKSKLSDRSPDIDNYSEEEEESFSSEQEGSDDPLHGQDLFYEDEDLRKVKKTRRKLTSTSAITRQPNIKQKFVALLKRFKVSDEVGFGLEHVSREQIREVEEDLDELYDSLEMYNPSDSGPEMEETESILSTPKPKLKPFFEGMSQSSSQTEIGSLNSKGSLGKDTTSPMELAALEKIKSTWIKNQDDSLTETDTLEITDQDMFGDASTSLVVPEKVKTPMKSSKTDLQGSASPSKVEGVHTPRQKRSTPLKERQLSKPLSERTNSSDSERSPDLGHSTQIPRKVVYDQLNQILVSDAALPENVILVNTTDWQGQYVAELLQDQRKPVVCTCSTVEVQAVLSALLTRIQRYCNCNSSMPRPVKVAAVGGQSYLSSILRFFVKSLANKTSDWLGYMRFLIIPLGSHPVAKYLGSVDSKYSSSFLDSGWRDLFSRSEPPVSEQLDVAGRVMQYVNGAATTLQNDRALTHVNACQIEFQEVDSYQKVNTLRGVMKVGRVEDSPCTAGELIRVVTVISRYIDADIVSH

SEQ ID NO: 837662 - protein, 496 aa, Homo sapiens [sequence omitted]

SEQ ID NO: 837663 - protein, 963 aa, Homo sapiens; identical to SEQ ID NO: 837655

SEQ ID NO: 837664 - protein, 963 aa, Homo sapiens; identical to SEQ ID NO: 837655

SEQ ID NO: 837665 - protein, 963 aa, Homo sapiens; identical to SEQ ID NO: 837655

SEQ ID NO: 837666 - protein, 923 aa, Homo sapiens
MAERGGAGGGPGGAGGGSGQRGSGVAQSPQQPPPQQQQQQPPQQPTPPKLAQATSSSSSTSAAAASSSSSSTSTSMAVAVASGSAPPGGPGPGRTPAPVQMNLYATWEVDRSSSSCVPRLFSLTLKKLVMLKEMDKDLNSVVIAVKLQGSKRILRSNEIVLPASGLVETELQLTFSLQYPHFLKRDANKLQIMLQRRKRYKNRTILGYKTLAVGLINMAEVMQHPNEGALVLGLHSNVKDVSVPVAEIKIYSLSSQPIDHEGIKSKLSDRSPDIDNYSEEEEESFSSEQEGSDDPLHGQDLFYEDEDLRKVKKTRRKLTSTSAITRQPNIKQKFVALLKRFKVSDEVGFGLEHVSREQIREVEEDLDELYDSLEMYNPSDSGPEMEETESILSTPKPKLKPFFEGMSQSSSQTEIGSLNSKGSLGKDTTSPMELAALEKIKSTWIKNQDDSLTETDTLEITDQDMFGDASTSLVVPEKVKTPMKSSKTDLQGSASPSKVEGVHTPRQKRSTPLKERQLSKPLSERTNSSDSERSPDLGHSTQIPRKVVYDQLNQILVSDAALPENVILVNTTDWQGQYVAELLQDQRKPVVCTCSTVEVQAVLSALLTRIQRYCNCNSSMPRPVKVAAVGGQSYLSSILRFFVKSLANKTSDWLGYMRFLIIPLGSHPVAKYLGSVDSKYSSSFLDSGWRDLFSRSEPPVSEQLDVAGRVMQYVNGAATTHQLPVAEAMLTCRHKFPDEDSYQKFIPFIGVVKVGLVEDSPSTAGDGDDSPVVSLTVPSTSPPSSSGLSRDATATPPSSPSMSSALAIVGSPNSPYGDVIGLQVDYWLGHPGERRREGDKRDASSKNTLKSVFRSVQVSRLPHSGEAQLSGTMAMTVVTKEKNKKVPSPPLQPTPAQPLLLPAFPLLPPAPGPRRVGFAFWCP

SEQ ID NO: 837667 - protein, 843 aa, Homo sapiens
MAERGGAGGGPGGAGGGSGQRGSGVAQSPQQPPPQQQQQQPPQQPTPPKLAQATSSSSSTSAAAASSSSSSTSTSMAVAVASGSAPPGGPGPGRTPAPVQMNLYATWEVDRSSSSCVPRLFSLTLKKLVMLKEMDKDLNSVVIAVKLQGSKRILRSNEIVLPASGLVETELQLTFSLQYPHFLKRDANKLQIMLQRRKRYKNRTILGYKTLAVGLINMAEVMQHPNEGALVLGLHSNVKDVSVPVAEIKIYSLSSQPIDHEGIKSKLSDRSPDIDNYSEEEEESFSSEQEGSDDPLHGQDLFYEDEDLRKVKKTRRKLTSTSAITRQPNIKQKFVALLKRFKVSDEVGFGLEHVSREQIREVEEDLDELYDSLEMYNPSDSGPEMEETESILSTPKPKLKPFFEGMSQSSSQTEIGSLNSKGSLGKDTTSPMELAALEKIKSTWIKNQDDSLTETDTLEITDQDMFGDASTSLVVPEKVKTPMKSSKTDLQGSASPSKVEGVHTPRQKRSTPLKERQLSKPLSERTNSSDSERSPDLGHSTQIPRKVVYDQLNQILVSDAALPENVILVNTTDWQGQYVAELLQDQRKPVVCTCSTVEVQAVLSALLTRIQRYCNCNSSMPRPVKVAAVGGQSYLSSILRFFVKSLANKTSDWLGYMRFLIIPLGSHPVAKYLGSVDSKYSSSFLDSGWRDLFSRSEPPVSEQLDVAGRVMQYVNGAATTHQLPVAEAMLTCRHKFPDEDSYQKFIPFIGVVKVGLVEDSPSTAGDGDDSPVVSLTVPSTSPPPSLAPGSASHSPRSRRTLPQGRLPSPPLQPTPAQPLLLPAFPLLPPAPGPRRVGFAFWCP

SEQ ID NO: 837668 - protein, 1006 aa, Homo sapiens
MAERGGAGGGPGGAGGGSGQRGSGVAQSPQQPPPQQQQQQPPQQPTPPKLAQATSSSSSTSAAAASSSSSSTSTSMAVAVASGSAPPGGPGPGRTPAPVQMNLYATWEVDRSSSSCVPRLFSLTLKKLVMLKEMDKDLNSVVIAVKLQGSKRILRSNEIVLPASGLVETELQLTFSLQYPHFLKRDANKLQIMLQRRKRYKNRTILGYKTLAVGLINMAEVMQHPNEGALVLGLHSNVKDVSVPVAEIKIYSLSSQPIDHEGIKSKLSDRSPDIDNYSEEEEESFSSEQEGSDDPLHGQDLFYEDEDLRKVKKTRRKLTSTSAITRQPNIKQKFVALLKRFKVSDEVGFGLEHVSREQIREVEEDLDELYDSLEMYNPSDSGPEMEETESILSTPKPKLKPFFEGMSQSSSQTEIGSLNSKGSLGKDTTSPMELAALEKIKSTWIKNQDDSLTETDTLEITDQDMFGDASTSLVVPEKVKTPMKSSKTDLQGSASPSKVEGVHTPRQKRSTPLKERQLSKPLSERTNSSDSERSPDLGHSTQIPRKVVYDQLNQILVSDAALPENVILVNTTDWQGQYVAELLQDQRKPVVCTCSTVEVQAVLSALLTRIQRYCNCNSSMPRPVKVAAVGGQSYLSSILRFFVKSLANKTSDWLGYMRFLIIPLGSHPVAKYLGSVDSKYSSSFLDSGWRDLFSRSEPPVSEQLDVAGRVMQYVNGAATTHQLPVAEAMLTCRHKFPDEDSYQKFIPFIGVVKVGLVEDSPSTAGDGDDSPVVSLTVPSTSPPSSSGLSRDATATPPSSPSMSSALAIVGSPNSPYGDVIGLQVDYWLGHPGERRREGDKRDASSKNTLKSVFRSVQVSRLPHSGEAQLSGTMAMTVVTKEKNKKVPTIFLSKKPREKEVDSKSQVIEGISRLISPSLGPSLGPDPSSQPGFPPAGSFPPCHLPLTNPGSEPLIPDRPCSQEWLRTQGPSPALCTPQPGHLRPTAPLELFSCPLTPSQKFLHRTSF

SEQ ID NO: 837669 - protein, 154 aa, Homo sapiens
MGSSGVTSSSSSWQPSGPPMSSTFQWDSSVAARPPEALSPSHFPSWHCHQPHRLRAGGGQQARAQHPFPGTRVCLSLAQVPKDTATGTPSLPSPPAHPCTAPPPSRFSPSPSCSRPKACWFCLLVPIVPWTESPRPSFTRLPNSSLWYQFPSRK

SEQ ID NO: 837670 - protein, 963 aa, Homo sapiens; identical to SEQ ID NO: 837655

SEQ ID NO: 837671 - protein, 190 aa, Homo sapiens
YSRGPPRLARQHASLLVVPCDTPCALVAVFVASTLVNDAPASASQPLTQHSSAWTWRDGRQTPTTIHAVCGPSDILFHLPFISLLPPCQFFCLSLLCSSPSLGPSLGPDPSSQPGFPPAGSFPPCHLPLTNPGSEPLIPDRPCSQEWLRTQGPSPALCTPQPGHLRPTAPLELFSCPLTPSQKFLHRTSF

SEQ ID NO: 837672 - protein, 167 aa, Homo sapiens
GGGLPPISPSPGRAVLGEGLGGRGRSIINKGGSHEDSDQCTGCVTWYNQEDILFHLPFISLLPPCQFFCLSLLCSSPSLGPSLGPDPSSQPGFPPAGSFPPCHLPLTNPGSEPLIPDRPCSQEWLRTQGPSPALCTPQPGHLRPTAPLELFSCPLTPSQKFLHRTSF

SEQ ID NO: 837673 - protein, 159 aa, Homo sapiens
CFILWIGLLFPCGLLRSQKVSSGPPPGRILAPLSTAMTLPFLPSCNCNSSMPRPVKVAAVGGQSYLSSILRFFVKSLANKTSDWLGYMRFLIIPLGKDGRHQEGVGHEGSIDRCLIWNRTVGLGPRKGQSRRPRPWPGTAAPTLSHLLTNSPPLVFHLP

SEQ ID NO: 837674 - protein, 50 aa, Homo sapiens
SNGSGDVCNFLCGLWTALWVQPRRQQPSCAPDSQADREGCILHAPAWTPP

SEQ ID NO: 837675 - protein, 84 aa, Homo sapiens
PLLPRPPPRPRPAQAALASSGGPAGGRVGRMRRRSRMLLCFAFLWVLGIAYYMYSGGGSALAGGAGGGAGRKLQTLCSVLQCWS

SEQ ID NO: 837676 - protein, 558 aa, Homo sapiens
VYTNEKHWLEIIYVECGQGKVPVAPMADREDWNEIDPIKKKDLHHSNGEEKAQSMETLPPGKVRWPDFNQEAYVGGTMVRSGQDPYARNKFNQVESDKLRMDRAIPDTRHDQCQRKQWRVDLPATSVVITFHNEARSALLRTVVSVLKKSPPHLIKEIILVDDYSNDPEDGALLGKIEKVRVLRNDRREGLMRSRVRGADAAQAKVLTFLDSHCECNEHWLEPLLERVAEDRTRVVSPIIDVINMDNFQYVGASADLKGGFDWNLVFKWDYMTPEQRRSRQGNPVAPIKTPMIAGGLFVMDKFYFEELGKYDMMMDVWGGENLEISFRVWQCGGSLEIIPCSRVGHVFRKQHPYTFPGGSGTVFARNTRRAAEVWMDEYKNFYYAAVPSARNVPYGNIQSRLELRKKLSCKPFKWYLENVYPELRVPDHQDIAFGALQQGTNCLDTLGHFADGVVGVYECHNAGGNQEWALTKEKSVKHMDLCLTVVDRAPGSLIKLQGCRENDSRQKWEQIEGNSKLRHVGSNLCLDSRTAKSGGLSVEVCGPALSQQWKFTLNLQQ

SEQ ID NO: 837677 - protein, 571 aa, Homo sapiens
MRRRSRMLLCFAFLWVLGIAYYMYSGGGSALAGGAGGGAGRKEDWNEIDPIKKKDLHHSNGEEKAQSMETLPPGKVRWPDFNQEAYVGGTMVRSGQDPYARNKFNQVESDKLRMDRAIPDTRHDQCQRKQWRVDLPATSVVITFHNEARSALLRTVVSVLKKSPPHLIKEIILVDDYSNDPEDGALLGKIEKVRVLRNDRREGLMRSRVRGADAAQAKVLTFLDSHCECNEHWLEPLLERVAEDRTRVVSPIIDVINMDNFQYVGASADLKGGFDWNLVFKWDYMTPEQRRSRQGNPVAPIKTPMIAGGLFVMDKFYFEELGKYDMMMDVWGGENLEISFRVWQCGGSLEIIPCSRVGHVFRKQHPYTFPGGSGTVFARNTRRAAEVWMDEYKNFYYAAVPSARNVPYGNIQSRLELRKKLSCKPFKWYLENVYPELRVPDHQDIAFGALQQGTNCLDTLGHFADGVVGVYECHNAGGNQEWALTKEKSVKHMDLCLTVVDRAPGSLIKLQGCRENDSRQKWEQIEGNSKLRHVGSNLCLDSRTAKSGGLSVEVCGPALSQQWKFTLNLQQ

SEQ ID NO: 837678 - protein, 224 aa, Homo sapiens
MSFLAPELPSISFTLLILRECISLMCMREANIPKVHNDINTKDAYMNVRSVPYGFCRSSSSCIFPTKPFAASGRRGQSPVGPRFPSARKGGTAGTGAWGGPPFFIWGFPPPPFGEWPPEFQPSWCYCCGQLGGFLQTTGLGPGIPVGRQPESPYCASESTLRAVRICEPGAVTYFDRYHFGSFYIKFLFSKEGSEPNNTCSFTLRIQGGRQEPWGPVKPQTVMN

SEQ ID NO: 837679 - protein, 571 aa, Homo sapiens; identical to SEQ ID NO: 837677

SEQ ID NO: 837680 - protein, 571 aa, Homo sapiens; identical to SEQ ID NO: 837677

SEQ ID NO: 837681 - protein, 151 aa, Homo sapiens
YVVPRVWDIVDQRLAELRVPDHQDIAFGALQQGTNCLDTLGHFADGVVGVYECHNAGGNQEWALTKEKSVKHMDLCLTVVDRAPGSLIKLQGCRENDSRQKWEQIEGNSKLRHVGSNLCLDSRTAKSGGLSVEVCGPALSQQWKFTLNLQQ

SEQ ID NO: 837682 - protein, 128 aa, Homo sapiens [sequence omitted]

SEQ ID NO: 837683 - protein, 128 aa, Homo sapiens [sequence omitted]

SEQ ID NO: 837684 - protein, 571 aa, Homo sapiens; identical to SEQ ID NO: 837677

SEQ ID NO: 837685 - protein, 571 aa, Homo sapiens; identical to SEQ ID NO: 837677

SEQ ID NO: 837686 - protein, 544 aa, Homo sapiens
MRRRSRMLLCFAFLWVLGIAYYMYSGGGSALAGGAGGGAGRKEDWNEIDPIKKKDLHHSNGEEKAQSMETLPPGKVRWPDFNQEAYVGGTMVRSGQDPYARNKFNQVESDKLRMDRAIPDTRHDQCQRKQWRVDLPATSVVITFHNEARSALLRTVVSVLKKSPPHLIKEIILVDDYSNDPEDGALLGKIEKVRVLRNDRREGLMRSRVRGADAAQAKVLTFLDSHCECNEHWLEPLLERVAEDRTRVVSPIIDVINMDNFQYVGASADLKGGFDWNLVFKWDYMTPEQRRSRQGNPVAPIKTPMIAGGLFVMDKFYFEELGKYDMMMDVWGGENLEISFRVWQCGGSLEIIPCSRVGHVFRKQHPYTFPGGSGTVFARNTRRAAEVWMDEYKNFYYAAVPSARNVPYGNIQSRLELRKKLSCKPFKWYLENVYPELRVPDHQDIAFGALQQGTNCLDTLGHFADGVVGVYECHNAGGNQEWALTKEKSVKHMDLCLTVVDRAPGSLIKLQGCRENDSRQKWEQIEGNSKLRHVGSNLCLDSRN

SEQ ID NO: 837687 - protein, 1353 aa, Homo sapiens
MASPPHQQLLHHHSTEVSCDSSGDSNSVRVKINPKQLSSNSHPKHCKYSISSSCSSSGDSGGVPRRVGGGGRLRRQKKLPQLFERASSRWWDPKFDSVNLEEACLERCFPQTQRRFRYALFYIGFACLLWSIYFAVHMRSRLIVMVAPALCFLLVCVGFFLFTFTKLYARHYAWTSLALTLLVFALTLAAQFQVLTPVSGRGDSSNLTATARPTDTCLSQVGSFSMCIEVLFLLYTVMHLPLYLSLCLGVAYSVLFETFGYHFRDEACFPSPGAGALHWELLSRGLLHGCIHAIGVHLFVMSQVRSRSTFLKVGQSIMHGKDLEVEKALKERMIHSVMPRIIADDLMKQGDEESENSVKRHATSSPKNRKKKSSIQKAPIAFRPFKMQQIEEVSILFADIVGFTKMSANKSAHALVGLLNDLFGRFDRLCEETKCEKISTLGDCYYCVAGCPEPRADHAYCCIEMGLGMIKAIEQFCQEKKEMVNMRVGVHTGTVLCGILGMRRFKFDVWSNDVNLANLMEQLGVAGKVHISEATAKYLDDRYEMEDGKVIERLGQSVVADQLKGLKTYLISGQRAKESRCSCAEALLSGFEVIDGSQVSSGPRGQGTASSGNVSDLAQTVKTFDNLKTCPSCGITFAPKSEAGAEGGAPQNGCQDEHKNSTKASGGPNPKTQNGLLSPPQEEKLTNSQTSLCEILQEKGRWAGVSLDQSALLPLRFKNIREKTDAHFVDVIKEDSLMKDYFFKPPINQFSLNFLDQELERSYRTSYQEEVIKNSPVKTFASPTFSSLLDVFLSTTVFLTLSTTCFLKYEAATVPPPPAALAVFSAALLLEVLSLAVSIRMVFFLEDVMACTKRLLEWIAGWLPRHCIGAILVSLPALAVYSHVTSEYETNIHFPVFTGSAALIAVVHYCNFCQLSSWMRSSLATVVGAGPLLLLYVSLCPDSSVLTSPLDAVQNFSSERNPCNSSVPRDLRRPASLIGQEVVLVFFLLLLLVWFLNREFEVSYRLHYHGDVEADLHRTKIQSMRDQADWLLRNIIPYHVAEQLKVSQTYSKNHDSGGVIFASIVNFSEFYEENYEGGKECYRVLNELIGDFDELLSKPDYSSIEKIKTIGATYMAASGLNTAQAQDGSHPQEHLQILFEFAKEMMRVVDDFNNNMLWFNFKLRVGFNHGPLTAGVIGTTKLLYDIWGDTVNIASRMDTTGVECRIQVSEESYRVLSKMGYDFDYRGTVNVKGKGQMKTYLYPKCTDHRVIPQHQLSISPDIRVQVDGSIGRSPTDEIANLVPSVQYVDKTSLGSDSSTQAKDAHLSPKRPWKEPVKAEERGRFGKAIEKDDCDETGIEEANELTKLNVSKSV

SEQ ID NO: 837688 - protein, 1372 aa, Homo sapiens
MASPPHQQLLHHHSTEVSCDSSGDSNSVRVKINPKQLSSNSHPKHCKYSISSSCSSSGDSGGVPRRVGGGGRLRRQKKLPQLFERASSRWWDPKFDSVNLEEACLERCFPQTQRRFRYALFYIGFACLLWSIYFAVHMRSRLIVMVAPALCFLLVCVGFFLFTFTKLYARHYAWTSLALTLLVFALTLAAQFQVLTPVSGRGDSSNLTATARPTDTCLSQVGSFSMCIEVLFLLYTVMHLPLYLSLCLGVAYSVLFETFGYHFRDEACFPSPGAGALHWELLSRGLLHGCIHAIGVHLFVMSQVRSRSTFLKVGQSIMHGKDLEVEKALKERMIHSVMPRIIADDLMKQGDEESENSVKRHATSSPKNRKKKSSIQKAPIAFRPFKMQQIEEVSILFADIVGFTKMSANKSAHALVGLLNDLFGRFDRLCEETKCEKISTLGDCYYCVAGCPEPRADHAYCCIEMGLGMIKAIEQFCQEKKEMVNMRVGVHTGTVLCGILGMRRFKFDVWSNDVNLANLMEQLGVAGKVHISEATAKYLDDRYEMEDGKVIERLGQSVVADQLKGLKTYLISGQRAKESRCSCAEALLSGFEVIDGSQVSSGPRGQGTASSGNVSDLAQTVKTFDNLKTCPSCGITFAPKSEAGAEGGAPQNGCQDEHKNSTKVTSSWLLFLSVPLLAHPPKASGGPNPKTQNGLLSPPQEEKLTNSQTSLCEILQEKGRWAGVSLDQSALLPLRFKNIREKTDAHFVDVIKEDSLMKDYFFKPPINQFSLNFLDQELERSYRTSYQEEVIKNSPVKTFASPTFSSLLDVFLSTTVFLTLSTTCFLKYEAATVPPPPAALAVFSAALLLEVLSLAVSIRMVFFLEDVMACTKRLLEWIAGWLPRHCIGAILVSLPALAVYSHVTSEYETNIHFPVFTGSAALIAVVHYCNFCQLSSWMRSSLATVVGAGPLLLLYVSLCPDSSVLTSPLDAVQNFSSERNPCNSSVPRDLRRPASLIGQEVVLVFFLLLLLVWFLNREFEVSYRLHYHGDVEADLHRTKIQSMRDQADWLLRNIIPYHVAEQLKVSQTYSKNHDSGGVIFASIVNFSEFYEENYEGGKECYRVLNELIGDFDELLSKPDYSSIEKIKTIGATYMAASGLNTAQAQDGSHPQEHLQILFEFAKEMMRVVDDFNNNMLWFNFKLRVGFNHGPLTAGVIGTTKLLYDIWGDTVNIASRMDTTGVECRIQVSEESYRVLSKMGYDFDYRGTVNVKGKGQMKTYLYPKCTDHRVIPQHQLSISPDIRVQVDGSIGRSPTDEIANLVPSVQYVDKTSLGSDSSTQAKDAHLSPKRPWKEPVKAEERGRFGKAIEKDDCDETGIEEANELTKLNVSKSV

SEQ ID NO: 837689 - protein, 1372 aa, Homo sapiens; identical to SEQ ID NO: 837688

SEQ ID NO: 837690 - protein, 1322 aa, Homo sapiens
MASPPHQQLLHHHSTEVSCDSSGDSNSVRVKINPKQLSSNSHPKHCKYSISSSCSSSGDSGGVPRRVGGGGRLRRQKKLPQLFERASSRWWDPKFDSVNLEEACLERCFPQTQRRFRYALFYIGFACLLWSIYFAVHMRSRLIVMVAPALCFLLVCVGFFLFTFTKLYARHYAWTSLALTLLVFALTLAAQFQVLTPVSGRGDSSNLTATARPTDTCLSQVGSFSMCIEVLFLLYTVMHLPLYLSLCLGVAYSVLFETFGYHFRDEACFPSPGAGALHWELLSRGLLHGCIHAIGVHLFVMSQVRSRSTFLKVGQSIMHGKDLEVEKALKERMIHSVMPRIIADDLMKQGDEESENSVKRHATSSPKNRKKKSSIQKAPIAFRPFKMQQIEEVSILFADIVGFTKMSANKSAHALVGLLNDLFGRFDRLCEETKCEKISTLGDCYYCVAGCPEPRADHAYCCIEMGLGMIKAIEQFCQEKKEMVNMRVGVHTGTVLCGILGMRRFKFDVWSNDVNLANLMEQLGVAGKVHISEATAKYLDDRYEMEDGKVIERLGQSVVADQLKGLKTYLISGQRAKESRCSCAEALLSGFEVIDGSQVSSGPRGQGTASSGNVSDLAQTVKTFDNLKTCPSCGITFAPKSEAGAEGGAPQNGCQDEHKNSTKVTSSWLLFLSVPLLAHPPKASGGPNPKTQNGLLSPPQEEKLTNSQTSLCEILQEKGRWAGVSLDQSALLPLRFKNIREKTDAHFVDVIKEDSLMKDYFFKPPINQFSLNFLDQELERSYRTSYQEEVIKNSPVKTFASPTFSSLLDVFLSTTVFLTLSTTCFLKYEAATVPPPPAALAVFSAALLLEVLSLAVSIRMVFFLEDVMACTKRLLEWIAGWLPRHCIGAILVSLPALAVYSHVTSEYETNIHFPVFTGSAALIAVVHYCNFCQLSSWMRSSLATVVGAGPLLLLYVSLCPDSSVLTSPLDAVQNFSSERNPCNSSVPRDLRRPASLIGQEVVLVFFLLLLLVWFLNREFEVSYRLHYHGDVEADLHRTKIQSMRDQADWLLRNIIPYHVAEQLKVSQTYSKNHDSGGVIFASIVNFSEFYEENYEGGKECYRVLNELIGDFDELLSKPDYSSIEKIKTIGATYMAASGLNTAQAQDGSHPQEHLQILFEFAKEMMRVVDDFNNNMLWFNFKLRVGFNHGPLTAGVIGTTKLLYDIWGDTVNIASRMDTTGVECRIQVSEESYRVLSKMGYDFDYRGTVNVKGKGQTSASRWMAASDGLPQTRLPTWCLLSSMWTRHLWVLTAARRPRMPTCPPRDRGRSPSKPKKGVDLAKP

SEQ ID NO: 837691 - protein, 583 aa, Homo sapiens [sequence omitted]

SEQ ID NO: 837692 - protein, 114 aa, Homo sapiens
MLASPIWGGQAGIPAPSFPPALYPGPFQLPPRPPWAMLSVACAQCFPELPVGSCPITPSEQPSSWHSLPSCLSALLCFWGPLPKEPSPANPFRVHFPRTQTRHPQAPGWFVFPL

SEQ ID NO: 837693 - protein, 513 aa, Homo sapiens
MVFFLEDVMACTKRLLEWIAGWLPRHCIGAILVSLPALAVYSHVTSEYETNIHFPVFTGSAALIAVVHYCNFCQLSSWMRSSLATVVGAGPLLLLYVSLCPDSSVLTSPLDAVQNFSSERNPCNSSVPRDLRRPASLIGQEVVLVFFLLLLLVWFLNREFEVSYRLHYHGDVEADLHRTKIQSMRDQADWLLRNIIPYHVAEQLKVSQTYSKNHDSGGVIFASIVNFSEFYEENYEGGKECYRVLNELIGDFDELLSKPDYSSIEKIKTIGATYMAASGLNTAQAQDGSHPQEHLQILFEFAKEMMRVVDDFNNNMLWFNFKLRVGFNHGPLTAGVIGTTKLLYDIWGDTVNIASRMDTTGVECRIQVSEESYRVLSKMGYDFDYRGTVNVKGKGQMKTYLYPKCTDHRVIPQHQLSISPDIRVQVDGSIGRSPTDEIANLVPSVQYVDKTSLGSDSSTQAKDAHLSPKRPWKEPVKAEERGRFGKAIEKDDCDETGIEEANELTKLNVSKSV

SEQ ID NO: 837694 - protein, 1372 aa, Homo sapiens; identical to SEQ ID NO: 837688

SEQ ID NO: 837695 - protein, 181 aa, Homo sapiens
GRGAEPCGLERKNAGAERRSGSRLEEDPGRRQSLAPVGVGVETYFTVVLWTITMGIQGGSVLFGLLLVLAVFCHSGHSLQCYNCPNPTADCKTAVNCSSDFDACLITKAGLQVYNKCWKFEHCNFNDVTTRLRENELTYYCCKKDLCNFNEQLENGGTSLSEKTVLLLVTPFLAAAWSLHP

SEQ ID NO: 837696 - protein, 128 aa, Homo sapiens
MGIQGGSVLFGLLLVLAVFCHSGHSLQCYNCPNPTADCKTAVNCSSDFDACLITKAGLQVYNKCWKFEHCNFNDVTTRLRENELTYYCCKKDLCNFNEQLENGGTSLSEKTVLLLVTPFLAAAWSLHP

SEQ ID NO: 837697 - protein, 146 aa, Homo sapiens
IILLTVRSQSFQVLWTITMGIQGGSVLFGLLLVLAVFCHSGHSLQCYNCPNPTADCKTAVNCSSDFDACLITKAGLQVYNKCWKFEHCNFNDVTTRLRENELTYYCCKKDLCNFNEQLENGGTSLSEKTVLLLVTPFLAAAWSLHP

SEQ ID NO: 837698 - protein, 166 aa, Homo sapiens
GRGAEPCGLERKNAGAERRSGSRLEEDPGRRQVLWTITMGIQGGSVLFGLLLVLAVFCHSGHSLQCYNCPNPTADCKTAVNCSSDFDACLITKAGLQVYNKCWKFEHCNFNDVTTRLRENELTYYCCKKDLCNFNEQLENGGTSLSEKTVLLLVTPFLAAAWSLHP

SEQ ID NO: 837699 - protein, 128 aa, Homo sapiens; identical to SEQ ID NO: 837696

SEQ ID NO: 837700 - protein, 175 aa, Homo sapiens
GSIDPLFASGKIRHERRLEEDLGRRQSLAPVGVGVETYFTVVLWTITMGIQGGSVLFGLLLVLAVFCHSGHSLQCYNCPNPTADCKTAVNCSSDFDACLITKAGLQVYNKCWKFEHCNFNDVTTRLRENELTYYCCKKDLCNFNEQLENGGTSLSEKTVLLLVTPFLAAAWSLHP

SEQ ID NO: 837701 - protein, 86 aa, Homo sapiens
FFYSPPPGPEVVASPLVPCPSTPRLASASHPEELCELEIRIKELELLTITGDGFDSQSYTFLKALKDEKLQGLKTKQPGKKSASLS

SEQ ID NO: 837702 - protein, 166 aa, Homo sapiens; identical to SEQ ID NO: 837698

SEQ ID NO: 837703 - protein, 166 aa, Homo sapiens; identical to SEQ ID NO: 837698

SEQ ID NO: 837704 - protein, 166 aa, Homo sapiens; identical to SEQ ID NO: 837698

SEQ ID NO: 837705 - protein, 181 aa, Homo sapiens; identical to SEQ ID NO: 837695

SEQ ID NO: 837706 - protein, 166 aa, Homo sapiens; identical to SEQ ID NO: 837698

SEQ ID NO: 837707 - protein, 128 aa, Homo sapiens; identical to SEQ ID NO: 837696

SEQ ID NO: 837708 - protein, 154 aa, Homo sapiens
IRLGTRPVLIGRGEDPGRRQVLWTITMGIQGGSVLFGLLLVLAVFCHSGHSLQCYNCPNPTADCKTAVNCSSDFDACLITKAGLQVYNKCWKFEHCNFNDVTTRLRENELTYYCCKKDLCNFNEQLENGGTSLSEKTVLLLVTPFLAAAWSLHP

SEQ ID NO: 837709 - protein, 128 aa, Homo sapiens; identical to SEQ ID NO: 837696

SEQ ID NO: 837710 - protein, 128 aa, Homo sapiens; identical to SEQ ID NO: 837696

SEQ ID NO: 837711 - protein, 172 aa, Homo sapiens
GRGAEPCGLERKNAGAERRSGSRLEEDPGRRQSLAPVGVGVETYFTVVLWTITMGIQGGSVLFGLLLVLAVFCHSGHSLQCYNCPNPTADCKTAVNCSSDFDACLITKAELGYHYVAQAGRRQSSHFSLLKCWDYRCEPSHWPHCPYFNWGYKCITSVGSLSIAISTTSQPA

SEQ ID NO: 837712 - protein, 166 aa, Homo sapiens; identical to SEQ ID NO: 837698

SEQ ID NO: 837713 - protein, 175 aa, Homo sapiens; identical to SEQ ID NO: 837700

SEQ ID NO: 837714 - protein, 166 aa, Homo sapiens; identical to SEQ ID NO: 837698

SEQ ID NO: 837715 - protein, 86 aa, Homo sapiens
YSLEAHSIEDARFRNVPDCCGLHYVSNDEFLNGLVLGHASGTVSAANRLHVPRPFLARPLFLLFFVILEARVYSMNAVGTPFVVTV

SEQ ID NO: 837716 - protein, 144 aa, Homo sapiens
GRGAEPCGLERKNAGAERRSGSRLEEDPGRRQSLAPVGVGVETYFTVVLWTITMGIQGGSVLFGLLLVLAVFCHSGHSLQCYNCPNPTADCKTAVNCSSDFDACLITKADTHPLRGGGQDSYACSYKLRSVVFQALHGIGVTSV

SEQ ID NO: 837717 - protein, 85 aa, Homo sapiens
MGIQGGSVLFGLLLVLAVFCHSGHSLQCYNCPNPTADCKTAVNCSSDFDACLITKAGTGLQVGGGMQFTLVNPLGKHATLRGLTY

SEQ ID NO: 837718 - protein, 166 aa, Homo sapiens; identical to SEQ ID NO: 837698

SEQ ID NO: 837719 - protein, 175 aa, Homo sapiens; identical to SEQ ID NO: 837700

SEQ ID NO: 837720 - protein, 183 aa, Homo sapiens
GRGAEPCGLERKNAGAERRSGSRLEEDPGRRQSLAPVGVGVETYFTVVLWTITMGIQGGSVLFGLLLVLAVFCHSGHSLQCYNCPNPTADCKTAVNCSSDFDACLITKAGLQVYNKCWKFEHCNFNDVTTRLRENELTYYCCKKDLCNFNEQLENDTFLKALKDEKLQGLKTKQPGKKSASLS

SEQ ID NO: 837721 - protein, 128 aa, Homo sapiens; identical to SEQ ID NO: 837696

SEQ ID NO: 837722 - protein, 154 aa, Homo sapiens
AFINFRDPVLPWRHAKCSICVLWTITMGIQGGSVLFGLLLVLAVFCHSGHSLQCYNCPNPTADCKTAVNCSSDFDACLITKAGLQVYNKCWKFEHCNFNDVTTRLRENELTYYCCKKDLCNFNEQLENGGTSLSEKTVLLLVTPFLAAAWSLHP

SEQ ID NO: 837723 - protein, 166 aa, Homo sapiens; identical to SEQ ID NO: 837698

SEQ ID NO: 837724 - protein, 166 aa, Homo sapiens; identical to SEQ ID NO: 837698

SEQ ID NO: 837725 - protein, 175 aa, Homo sapiens; identical to SEQ ID NO: 837700

SEQ ID NO: 837726 - protein, 146 aa, Homo sapiens; identical to SEQ ID NO: 837697

SEQ ID NO: 837727 - protein, 128 aa, Homo sapiens; identical to SEQ ID NO: 837696

SEQ ID NO: 837728 - protein, 128 aa, Homo sapiens; identical to SEQ ID NO: 837696

SEQ ID NO: 837729 - protein, 89 aa, Homo sapiens
SRPVSSMDFDACLITTAGLQVYNKCWKFEHCNFNDVTTRLRENELTYYCCKKDLCNFNEQLENGGTSLSEKTVLLLVTPFLAAAWSLHP

SEQ ID NO: 837730 - protein, 97 aa, Homo sapiens
WVDRGLWVDRGLWVDRGLWVDRGLWVDRGLWVDRGFEHCNFNDVTTRLRENELTYYCCKKDLCNFNEQLENGGTSLSEKTVLLLVTPFLAAAWSLHP

SEQ ID NO: 837731 - protein, 166 aa, Homo sapiens; identical to SEQ ID NO: 837698

SEQ ID NO: 837732 - protein, 96 aa, Homo sapiens
GHGNGLMQTAMGVGKSSGLGPGGDGEGGGERWATMTEGTLDMDGQDEVCVRGLEQCMGGRELEGRGTPGWGRGIRPKGYPEEFVGGDICIQPPANS

SEQ ID NO: 837733 - protein, 168 aa, Homo sapiens
GRGAEPCGLERKNAGAERRSGSRLEEDPGRRQVLWTITMGIQGGSVLFGLLLVLAVFCHSGHSLQCYNCPNPTADCKTAVNCSSDFDACLITKAGLQVYNKCWKFEHCNFNDVTTRLRENELTYYCCKKDLCNFNEQLENDTFLKALKDEKLQGLKTKQPGKKSASLS

SEQ ID NO: 837734 - protein, 254 aa, Homo sapiens
LFPAGTMEGVEEKKKEVPAVPETLKKKRRNFAELKIKRLRKKFAQKMLRKARRKLIYEKAKHYHKEYRQMYRTEIRMARMARKAGNFYVPAEPKLAFVIRIRGINGVSPKVRKVLQLLRLRQIFNGTFVKLNKASINMLRIVEPYIAWGYPNLKSVNELIYKRGYGKINKKRIALTDNALIARSLGKYGIICMEDLIHEIYTVGKRFKEANNFLWPFKLSSPRGGMKKKTTHFVEGGDAGNREDQINRLIRRMN

SEQ ID NO: 837735 - protein, 254 aa, Homo sapiens; identical to SEQ ID NO: 837734

SEQ ID NO: 837736 - protein, 254 aa, Homo sapiens; identical to SEQ ID NO: 837734

SEQ ID NO: 837737 - protein, 150 aa, Homo sapiens
LFPAGTMEGVEEKKKEVPAVPETLKKKRRNFAELKIKRLRKKFAQKMLRKARRKLIYEKAKHYHKEYRQMYRTEIRMARMARKAGNFYVPAEPKLAFVIRIRGINGVSPKVRKVLQLLRLRQIFNGTFVKLNRARRCGESIGSTLMHLHD

SEQ ID NO: 837738 - protein, 254 aa, Homo sapiens; identical to SEQ ID NO: 837734

SEQ ID NO: 837739 - protein, 192 aa, Homo sapiens
MEGVEEKKKEVPAVPETLKKKRRNFAELKIKRLRKKFAQKMLRKARRKLIYEKAKHYHKEYRQMYRTEIRMARMARKAGNFYVPAEPKLAFVIRIRGINGVSPKVRKVLQLLRLRQIFNGTFVKLNKASINMLRIVEPYIAWGYPNLKSVNELIYKRGYGKINKKRIALTDNALIARSLGKYGARVRPYVSG

SEQ ID NO: 837740 - protein, 104 aa, Homo sapiens
LFPAGTMEGVEEKKKEVPAVPETLKKKRRNFAELKIKRLRKKFAQKMLRKARRKLIYEKAKHYHKEYRQMYRTEIRMARMARKAGNFYVPAEPKLAFVIRIITL

SEQ ID NO: 837741 - protein, 117 aa, Homo sapiens [sequence omitted]

SEQ ID NO: 837742 - protein, 466 aa, Homo sapiens
MRLRTRKASQQSNQIQTQRTARAKRKYSEVDDSLPSGGEKPSKNETGLLSSIKKFIKGSTPKEERENPSKRSRIERDIDNNLITSTPRAGEKPNKQISRVRRKSQVNGEAGSYEMTNQHVKQNGKLEDNPSSGSPPRTTLLGTIFSPVFNFFSPANKNGTSGSDSPGQAVEAEEIVKQLDMEQVDEITTSTTTSTNGAAYSNQAVQVRPSLNNGLEEAEETVNRDIPPLTAPVTPDSGYSSAHAEATYEEDWEVFDPYYFIKHVPPLTEEQLNRKPALPLKTRSTPEFSLVLDLDETLVHCSLNELEDAALTFPVLFQDVIYQVYVRLRPFFREFLERMSQMYEIILFTASKKVYADKLLNILDPKKQLVRHRLFREHCVCVQGNYIKDLNILGRDLSKTIIIDNSPQAFAYQLSNGIPIESWFMDKNDNELLKLIPFLEKLVELNEDVRPHIRDRFRLHDLLPPD

SEQ ID NO: 837743 - protein, 466 aa, Homo sapiens; identical to SEQ ID NO: 837742

SEQ ID NO: 837744 - protein, 466 aa, Homo sapiens; identical to SEQ ID NO: 837742

SEQ ID NO: 837745 - protein, 466 aa, Homo sapiens; identical to SEQ ID NO: 837742

SEQ ID NO: 837746 - protein, 466 aa, Homo sapiens; identical to SEQ ID NO: 837742

SEQ ID NO: 837747 - protein, 311 aa, Homo sapiens
MISGTSGSDSPGQAVEAEEIVKQLDMEQVDEITTSTTTSTNGAAYSNQAVQVRPSLNNGLEEAEETVNRDIPPLTAPVTPDSGYSSAHAEATYEEDWEVFDPYYFIKHVPPLTEEQLNRKPALPLKTRSTPEFSLVLDLDETLVHCSLNELEDAALTFPVLFQDVIYQVYVRLRPFFREFLERMSQMYEIILFTASKKVYADKLLNILDPKKQLVRHRLFREHCVCVQGNYIKDLNILGRDLSKTIIIDNSPQAFAYQLSNGIPIESWFMDKNDNELLKLIPFLEKLVELNEDVRPHIRDRFRLHDLLPPD

SEQ ID NO: 837748 - protein, 466 aa, Homo sapiens; identical to SEQ ID NO: 837742

SEQ ID NO: 837749 - protein, 466 aa, Homo sapiens; identical to SEQ ID NO: 837742

SEQ ID NO: 837750 - protein, 466 aa, Homo sapiens; identical to SEQ ID NO: 837742

SEQ ID NO: 837751 - protein, 171 aa, Homo sapiens
VCIGSKHLNRYSLHAAGGLSPQREITTIHGSPPVDHHHSWITTCGSPPFMDHHHVQWMSPAMLIVTHHDVDIYQHSITYVMQQRDANLDSRWQWHIMPLLLDVMNARVHRQFYTEAGVTISALAMSSQLLSALLAFHHQCCVHSSLRPMLARMLHNRWSSGPRVHGWPELH

SEQ ID NO: 837752 - protein, 101 aa, Homo sapiens
ENAVWAWYQELVFHSSDRLTDELWEAGGRLSLRVPLLWRHSWAEQDLLQTTTRETESIWFNRCPSRQAPEELAANPAMLEASSAAQPISDIIAFFSLPMVM

SEQ ID NO: 837753 - protein, 101 aa, Homo sapiens; identical to SEQ ID NO: 837752

SEQ ID NO: 837754 - protein, 101 aa, Homo sapiens; identical to SEQ ID NO: 837752

SEQ ID NO: 837755 - protein, 62 aa, Homo sapiens
MEHGLAGSANFSSSSPPSISGILSMIIIRTLRKDIANYNKEDDIVRGLGWGGMKLDGEGRRT

SEQ ID NO: 837756 - protein, 642 aa, Homo sapiens
MATAMDWLPWSLLLFSLMCETSAFYVPGVAPINFHQNDPVEIKAVKLTSSRTQLPYEYYSLPFCQPSKITYKAENLGEVLRGDRIVNTPFQVLMNSEKKCEVLCSQSNKPVTLTVEQSRLVAERITEDYYVHLIADNLPVATRLELYSNRDSDDKKKEKDVQFEHGYRLGFTDVNKIYLHNHLSFILYYHREDMEEDQEHTYRVVRFEVIPQSIRLEDLKADEKSSCTLPEGTNSSPQEIDPTKENQLYFTYSVHWEESDIKWASRWDTYLTMSDVQIHWFSIINSVVVVFFLSGILSMIIIRTLRKDIANYNKEDDIEDTMEESGWKLVHGDVFRPPQYPMILSSLLGSGIQLFCMILIVIFVAMLGMLSPSSRGALMTTACFLFMFMGVFGGFSAGRLYRTLKGHRWKKGAFCTATLYPGVVFGICFVLNCFIWGKHSSGAVPFPTMVALLCMWFGISLPLVYLGYYFGFRKQPYDNPVRTNQIPRQIPEQRWYMNRFVGILMAGILPFGAMFIELFFIFSAIWENQFYYLFGFLFLVFIILVVSCSQISIVMVYFQLCAEDYRWWWRNFLVSGGSAFYVLVYAIFYFVNKLDIVEFIPSLLYFGYTALMVLSFWLLTGTIGFYAAYMFVRKIYAAVKID

SEQ ID NO: 837757 - protein, 120 aa, Homo sapiens
MAIWENQFYYLFGFLFLVFIILVVSCSQISIVMVYFQLCAEDYRWWWRNFLVSGGSAFYVLVYAIFYFVNKLDIVEFIPSLLYFGYTALMVLSFWLLTGTIGFYAAYMFVRKIYAAVKID

SEQ ID NO: 837758 - protein, 70 aa, Homo sapiens
PRLGTRPGVNRPRAIFYFVNKLDIVEFIPSLLYFGYTALMVLSFWLLTGTIGFYAAYMFVRKIYAAVKID

SEQ ID NO: 837759 - protein, 642 aa, Homo sapiens; identical to SEQ ID NO: 837756

SEQ ID NO: 837760 - protein, 207 aa, Homo sapiens
MATAMDWLPWSLLLFSLMCETSAFYVPGVAPINFHQNDPVEIKAVKLTSSRTQLPYEYYSLPFCQPSKITYKAENLGEVLRGDRIVNTPFQVLMNSEKKCEVLCSQSNKPVTLTVEQSRLVAERITEDYYVHLIADNLPVATRLELYSNRDSDDKKKEKDVQFEHGYRLGFTDVNKIYLHNHLSFILYYHREDMEEDHYLSYPVFSF

SEQ ID NO: 837761 - protein, 123 aa, Homo sapiens
IFFTSSPQSNPGLSSEQDWLPWSLLLFSLMCETSAFYVPGVAPINFHQNDPVEIKVSVFLDFWSLCARQCVWSTMVSCSCPSCGCREERIVPVTPELCLSLSLCLWFSVPSLFLVLSVSLSLC

SEQ ID NO: 837762 - protein, 110 aa, Homo sapiens
MVSSSGMLRCLLHWESRSGLGSASRDSGQEPCGGGRECASAAQVASPSVEPRRSPPPCAAPIPGIRASWGPHGAMSTGALSHHGGSAVHVVRDLPAPRLLGLLLRLPKAA

SEQ ID NO: 837763 - protein, 625 aa, Homo sapiens
MCETSAFYVPGVAPINFHQNDPVEIKAVKLTSSRTQLPYEYYSLPFCQPSKITYKAENLGEVLRGDRIVNTPFQVLMNSEKKCEVLCSQSNKPVTLTVEQSRLVAERITEDYYVHLIADNLPVATRLELYSNRDSDDKKKEKDVQFEHGYRLGFTDVNKIYLHNHLSFILYYHREDMEEDQEHTYRVVRFEVIPQSIRLEDLKADEKSSCTLPEGTNSSPQEIDPTKENQLYFTYSVHWEESDIKWASRWDTYLTMSDVQIHWFSIINSVVVVFFLSGILSMIIIRTLRKDIANYNKEDDIEDTMEESGWKLVHGDVFRPPQYPMILSSLLGSGIQLFCMILIVIFVAMLGMLSPSSRGALMTTACFLFMFMGVFGGFSAGRLYRTLKGHRWKKGAFCTATLYPGVVFGICFVLNCFIWGKHSSGAVPFPTMVALLCMWFGISLPLVYLGYYFGFRKQPYDNPVRTNQIPRQIPEQRWYMNRFVGILMAGILPFGAMFIELFFIFSAIWENQFYYLFGFLFLVFIILVVSCSQISIVMVYFQLCAEDYRWWWRNFLVSGGSAFYVLVYAIFYFVNKLDIVEFIPSLLYFGYTALMVLSFWLLTGTIGFYAAYMFVRKIYAAVKID

SEQ ID NO: 837764 - protein, 642 aa, Homo sapiens; identical to SEQ ID NO: 837756

SEQ ID NO: 837765 - protein, 614 aa, Homo sapiens
MATAMDWLPWSLLLFSLMCETSAFYVPGVAPINFHQNDPVEIKAVKLTSSRTQLPYEYYSLPFCQPSKITYKAENLGEVLRGDRIVNTPFQVLMNSEKKCEVLCSQSNKPVTLTVEQSRLVAERITEDYYVHLIADNLPVATRLELYSNRDSDDKKKEKDVQFEHGYRLGFTDVNKIYLHNHLSFILYYHREDMEEDQEHTYRVVRFEVIPQSIRLEDLKADEKSSCTLPEGTNSSPQEIDPTKENQLYFTYSVHWEESDIKWASRWDTYLTMSDVQIHWFSIINSVVVVFFLSGILSMIIIRTLRKDIANYNKEDDIEDTMEESGWKLVHGDVFRPPQYPMILSSLLGSGIQLFCMILIVIFVAMLGMLSPSSRGALMTTACFLFMFMGVFGGFSAGRLYRTLKGHRWKKGAFCVPFPTMVALLCMWFGISLPLVYLGYYFGFRKQPYDNPVRTNQIPRQIPEQRWYMNRFVGILMAGILPFGAMFIELFFIFSAIWENQFYYLFGFLFLVFIILVVSCSQISIVMVYFQLCAEDYRWWWRNFLVSGGSAFYVLVYAIFYFVNKLDIVEFIPSLLYFGYTALMVLSFWLLTGTIGFYAAYMFVRKIYAAVKID

SEQ ID NO: 837766 - protein, 549 aa, Homo sapiens
MNSEKKCEVLCSQSNKPVTLTVEQSRLVAERITEDYYVHLIADNLPVATRLELYSNRDSDDKKKEKDVQFEHGYRLGFTDVNKIYLHNHLSFILYYHREDMEEDQEHTYRVVRFEVIPQSIRLEDLKADEKSSCTLPEGTNSSPQEIDPTKENQLYFTYSVHWEESDIKWASRWDTYLTMSDVQIHWFSIINSVVVVFFLSGILSMIIIRTLRKDIANYNKEDDIEDTMEESGWKLVHGDVFRPPQYPMILSSLLGSGIQLFCMILIVIFVAMLGMLSPSSRGALMTTACFLFMFMGVFGGFSAGRLYRTLKGHRWKKGAFCTATLYPGVVFGICFVLNCFIWGKHSSGAVPFPTMVALLCMWFGISLPLVYLGYYFGFRKQPYDNPVRTNQIPRQIPEQRWYMNRFVGILMAGILPFGAMFIELFFIFSAIWENQFYYLFGFLFLVFIILVVSCSQISIVMVYFQLCAEDYRWWWRNFLVSGGSAFYVLVYAIFYFVNKLDIVEFIPSLLYFGYTALMVLSFWLLTGTIGFYAAYMFVRKIYAAVKID

SEQ ID NO: 837767 - protein, 103 aa, Homo sapiens
QATVKLVGRGLPQDNTDLPLFPPQDYRWWWRNFLVSGGSAFYVLVYAIFYFVNKLDIVEFIPSLLYFGYTALMVLSFWLLTGTIGFYAAYMFVRKIYAAVKID

SEQ ID NO: 837768 - protein, 558 aa, Homo sapiens
MATAMDWLPWSLLLFSLMCETSAFYVPGVAPINFHQNDPVEIKAVKLTSSRTQLPYEYYSLPFCQPSKITYKAENLGEVLRGDRIVNTPFQVLMNSEKKCEVLCSQSNKPVTLTVEQSRLVAERITEDYYVHLIADNLPVATRLELYSNRDSDDKKKEKDVQFEHGYRLGFTDVNKIYLHNHLSFILYYHREDMEEDQEHTYRVVRFEVIPQSIRLEDLKADEKSSCTLPEGTNSSPQEIDPTKENQLYFTYSVHWEESDIKWASRWDTYLTMSDVQIHWFSIINSVVVVFFLSGILSMIIIRTLRKDIANYNKEDDIEDTMEESGWKLVHGDVFRPPQYPMILSSLLGSGIQLFCMILIVIFVAMLGMLSPSSRGALMTTACFLFMFMGVFGGFSAGRLYRTLKGHRWKKGAFCTATLYPGVVFGICFVLNCFIWGKHSSGAVPFPTMVALLCMWFGISLPLVYLGYYFGFRKQPYDNPVRTNQIPRQIPEQRWYMNRFVGILMAGILPFGAMFIELFFIFSAIWENQFYYLFGFLFLVFIIKHLLLSYKRPHPPRD

SEQ ID NO: 837769 - protein, 615 aa, Homo sapiens
MATAMDWLPWSLLLFSLMCETSAFYVPGVAPINFHQNDPVEIKAVKLTSSRTQLPYEYYSLPFCQPSKITYKAENLGEVLRGDRIVNTPFQVLMNSEKKCEVLCSQSNKPVTLTVEQSRLVAERITEDYYVHLIADNLPVATRLELYSNRDSDDKKKEKDVQFEHGYRLGFTDVNKIYLHNHLSFILYYHREDMEEDQEHTYRVVRFEVIPQSIRLEDLKADEKSSCTLPEGTNSSPQEIDPTKENQLYFTYSVHWEESDIKWASRWDTYLTMSDVQIHWFSIINSVVVVFFLSGILSMIIIRTLRKDIANYNKEDDIEDTMEESGWKLVHGDVFRPPQYPMILSSLLGSGIQLFCMILIVIFVAMLGMLSPSSRGALMTTACFLFMFMGVFGGFSAGRLYRTLKGHRWKKGAFCTATLYPGVVFGICFVLNCFIWGKHSSGAVPFPTMVALLCMWFGISLPLVYLGYYFGFRKQPYDNPVRTNQIPRQIPEQRWYMNRFVGILMAGILPFGAMFIELFFIFSAIWENQFYYLFGFLFLVFIILVVSCSQISIVMVYFQLCAEDYRWWWRNFLVSGGSAFYVLVYAIFYFVNKLLPFAYKRGSERWMFFLTSLIS

SEQ ID NO: 837770 - protein, 116 aa, Homo sapiens
MCETSAFYVPGVAPINFHQNDPVEIKAVKLTSSRTQLPYEYYSLPFCQPSKITYKAENLGEVLRGDRIVNTPFQVLMNSEKKCEVLCSQSNKPVTLTVEQSRLVAERITEDYYVHL

SEQ ID NO: 837771 - protein, 935 aa, Homo sapiens
FVPILNKVREFFLLFSSFLKRTVLLCCSFELGSVGRSDILPRPSALGSLAKLSSKMKRLTCFFICFFLSEVSGFEIPINGLSEFVDYEDLVELAPGKFQLVAENRRYQRSLPGESEEMMEEVDQVTLYSYKVQSTITSRMATTMIQSKVVNNSPQPQNVVFDVQIPKGAFISNFSMTVDGKTFRSSIKEKTVGRALYAQARAKGKTAGLVRSSALDMENFRTEVNVLPGAKVQFELHYQEVKWRKLGSYEHRIYLQPGRLAKHLEVDVWVIEPQGLRFLHVPDTFEGHFDGVPVISKGQQKAHVSFKPTVAQQRICPSCRETAVDGELVVLYDVKREEKAGELEVFNGYFVHFFAPDNLDPIPKNILFVIDVSGSMWGVKMKQTVEAMKTILDDLRAEDHFSVIDFNQNIRTWRNDLISATKTQVADAKRYIEKIQPSGGTNINEALLRAIFILNEANNLGLLDPNSVSLIILVSDGDPTVGELKLSKIQKNVKENIQDNISLFSLGMGFDVDYDFLKRLSNENHGIAQRIYGNQDTSSQLKKFYNQVSTPLLRNVQFNYPHTSVTDVTQNNFHNYFGGSEIVVAGKFDPAKLDQIESVITATSANTQLVLETLAQMDDLQDFLSKDKHADPDFTRKLWAYLTINQLLAERSLAPTAAAKRRITRSILQMSLDHHIVTPLTSLVIENEAGDERMLADAPPQDPSCCSGALYYGSKVVPDSTPSWANPSPTPVISMLAQGSQVLESTPPPHVMRVENDPHFIIYLPKSQKNICFNIDSEPGKILNLVSDPESGIVVNGQLVGAKKPNNGKLSTYFGKLGFYFQSEDIKIEISTETITLSHGSSTFSLSWSDTAQVTNQRVQISVKKEKVVTITLDKEMSFSVLLHRVWKKHPVNVDFLGIYIPPTNKFSPKAHGLIGQFMQEPKIHIFNERPGKDP

SEQ ID NO: 837772 - protein, 916 aa, Homo sapiens
FVPILNKVREFFLLFSSFLKRTVLLCCSFELGSVGRSDILPRPSALGSLAKLSSFEIPINGLSEFVDYEDLVELAPGKFQLVAENRRYQRSLPGESEEMMEEVDQVTLYSYKVQSTITSRMATTMIQSKVVNNSPQPQNVVFDVQIPKGAFISNFSMTVDGKTFRSSIKEKTVGRALYAQARAKGKTAGLVRSSALDMENFRTEVNVLPGAKVQFELHYQEVKWRKLGSYEHRIYLQPGRLAKHLEVDVWVIEPQGLRFLHVPDTFEGHFDGVPVISKGQQKAHVSFKPTVAQQRICPSCRETAVDGELVVLYDVKREEKAGELEVFNGYFVHFFAPDNLDPIPKNILFVIDVSGSMWGVKMKQTVEAMKTILDDLRAEDHFSVIDFNQNIRTWRNDLISATKTQVADAKRYIEKIQPSGGTNINEALLRAIFILNEANNLGLLDPNSVSLIILVSDGDPTVGELKLSKIQKNVKENIQDNISLFSLGMGFDVDYDFLKRLSNENHGIAQRIYGNQDTSSQLKKFYNQVSTPLLRNVQFNYPHTSVTDVTQNNFHNYFGGSEIVVAGKFDPAKLDQIESVITATSANTQLVLETLAQMDDLQDFLSKDKHADPDFTRKLWAYLTINQLLAERSLAPTAAAKRRITRSILQMSLDHHIVTPLTSLVIENEAGDERMLADAPPQDPSCCSGALYYGSKVVPDSTPSWANPSPTPVISMLAQGSQVLESTPPPHVMRVENDPHFIIYLPKSQKNICFNIDSEPGKILNLVSDPESGIVVNGQLVGAKKPNNGKLSTYFGKLGFYFQSEDIKIEISTETITLSHGSSTFSLSWSDTAQVTNQRVQISVKKEKVVTITLDKEMSFSVLLHRVWKKHPVNVDFLGIYIPPTNKFSPKAHGLIGQFMQEPKIHIFNERPGKDP

SEQ ID NO: 837773 - protein, 910 aa, Homo sapiens
FVPILNKVREFFLLFSSFLKRTVLLCCSFELGSVGRSDILPRPSALGSLAKLSSKMKRLTCFFICFFLSEVSGFEIPINGLSERSLPGESEEMMEEVDQVTLYSYKVQSTITSRMATTMIQSKVVNNSPQPQNVVFDVQIPKGAFISNFSMTVDGKTFRSSIKEKTVGRALYAQARAKGKTAGLVRSSALDMENFRTEVNVLPGAKVQFELHYQEVKWRKLGSYEHRIYLQPGRLAKHLEVDVWVIEPQGLRFLHVPDTFEGHFDGVPVISKGQQKAHVSFKPTVAQQRICPSCRETAVDGELVVLYDVKREEKAGELEVFNGYFVHFFAPDNLDPIPKNILFVIDVSGSMWGVKMKQTVEAMKTILDDLRAEDHFSVIDFNQNIRTWRNDLISATKTQVADAKRYIEKIQPSGGTNINEALLRAIFILNEANNLGLLDPNSVSLIILVSDGDPTVGELKLSKIQKNVKENIQDNISLFSLGMGFDVDYDFLKRLSNENHGIAQRIYGNQDTSSQLKKFYNQVSTPLLRNVQFNYPHTSVTDVTQNNFHNYFGGSEIVVAGKFDPAKLDQIESVITATSANTQLVLETLAQMDDLQDFLSKDKHADPDFTRKLWAYLTINQLLAERSLAPTAAAKRRITRSILQMSLDHHIVTPLTSLVIENEAGDERMLADAPPQDPSCCSGALYYGSKVVPDSTPSWANPSPTPVISMLAQGSQVLESTPPPHVMRVENDPHFIIYLPKSQKNICFNIDSEPGKILNLVSDPESGIVVNGQLVGAKKPNNGKLSTYFGKLGFYFQSEDIKIEISTETITLSHGSSTFSLSWSDTAQVTNQRVQISVKKEKVVTITLDKEMSFSVLLHRVWKKHPVNVDFLGIYIPPTNKFSPKAHGLIGQFMQEPKIHIFNERPGKDP

SEQ ID NO: 837774 - protein, 935 aa, Homo sapiens; identical to SEQ ID NO: 837771

SEQ ID NO: 837775 - protein, 935 aa, Homo sapiens; identical to SEQ ID NO: 837771

SEQ ID NO: 837776 - protein, 896 aa, Homo sapiens
FVPILNKVREFFLLFSSFLKRTVLLCCSFELGSVGRSDILPRPSALGSLAKLSSKMKRLTCFFICFFLSEVSGFEIPINGLSEFVDYEDLVELAPGKFQLVAENRRYQRSLPGESEEMMEEVDQVTLYSYKVQSTITSRMATTMIQSKVVNNSPQPQNVVFDVQIPKGAFISNFSMTVDGKTFRSSIKEKTVGRALYAQARAKGKTAGLVRSSALDMENFRTEVNVLPGAKVQFELHYQEVKWRKLGSYEHRIYLQPGRLAKHLEVDVWVIEPQGLRFLHVPDTFEGHFDGVPVISKGQQKAHVSFKPTVAQQRICPSCRETAVDGELVVLYDVKREEKAGELEVFNGYFVHFFAPDNLDPIPKNILFVIDVSGSMWGVKMKQTVEAMKTILDDLRAEDHFSVIDFNQNIRTWRNDLISATKTQVADAKRYIEKIQPSGGTNINEALLRAIFILNEANNLGLLDPNSVSLIILVSDGDPTVGELKLSKIQKNVKENIQDNISLFSLGMGFDVDYDFLKRLSNENHGIAQRIYGNQDTSSQLKKFYNQVSTPLLRNVQFNYPHTSVTDVTQNNFHNYFGGSEIVVAGKFDPAKLDQIESVITATSANTQLVLETLAQMDDLQDFLSKDKHADPDFTRKLWAYLTINQLLAERSLAPTAAAKRRITRSILQMSLDHHIVTPLTSLVIENEAGDERMLADAPPQDPSCCSGALYYGSKVVPDSTPSWANPSPTPVISMLAQGSQVLESTPPPHVMRVENDPHFIIYLPKSQKNICFNIDSEPGKILNLVSDPESGIVVNGQLVGAKKPNNGKLSTYFGKLGFYFQSEDIKIEISTETITLSHGSSTFSLSWSDTAQVTNQRVQISVKKVIVFGRSIPSMLTFWESTYPLQTSSHLKPTD

SEQ ID NO: 837777 - protein, 935 aa, Homo sapiens; identical to SEQ ID NO: 837771

SEQ ID NO: 837778 - protein, 167 aa, Homo sapiens
FVPILNKVREFFLLFSSFLKRTVLLCCSFELGSVGRSDILPRPSALGSLAKLSSKMKRLTCFFICFFLSEVSGFEIPINGLSEFVDYEDLVELAPGKFQLVAENRRYQRSLPGESEEMMEEVDQVTLYSYKVQSTIIIVFGRSIPSMLTFWESTYPLQTSSHLKPTD

SEQ ID NO: 837779 - protein, 211 aa, Homo sapiens
FVPILNKVREFFLLFSSFLKRTVLLCCSFELGSVGRSDILPRPSALGSLAKLSSKMKRLTCFFICFFLSEVSGFEIPINGLSEFVDYEDLVELAPGKFQLVAENRRYQRSLPGESEEMMEEVDQVTLYSYKVQSTITSRMATTMIQSKVVNNSPQPQNVVFDVQIPKGAFISNFSMTVDGKTFRSSIKEKTVGRALYAQARAKGKTAGLVR

SEQ ID NO: 837780 - protein, 917 aa, Homo sapiens
FVPILNKVREFFLLFSSFLKRTVLLCCSFELGSVGRSDILPRPSALGSLAKLSSKMKRLTCFFICFFLSEVSGFEIPINGLSEFVDYEDLVELAPGKFQLVAENRRYQRSLPGESEEMMEEVDQVTLYSYKVQSTITSRMATTMIQSKVVNNSPQPQNVVFDVQIPKGAFISNFSMTVDGKTFRSSIKEKTVGRALYAQARAKGKTAGLVRSSALDMENFRTEVNVLPGAKVQFELHYQEVKWRKLGSYEHRIYLQPGRLAKHLEVDVWVIEPQGLRFLHVPDTFEGHFDGVPVISKGQQKAHVSFKPTVAQQRICPSCRETAVDGELVVLYDVKREEKAGELEVFNGYFVHFFAPDNLDPIPKNILFVIDVSGSMWGVKMKQTVEAMKTILDDLRAEDHFSVIDFNQNIRTWRNDLISATKTQVADAKRYIEKIQPSGGTNINEALLRAIFILNEANNLGLLDPNSVSLIILVSDGDPTVGELKLSKIQKNVKENIQDNISLFSLGMGFDVDYDFLKRLSNENHGIAQRIYGNQDTSSQLKKFYNQVSTPLLRNVQFNYPHTSVTDVTQNNFHNYFGGSEIVVAGANTQLVLETLAQMDDLQDFLSKDKHADPDFTRKLWAYLTINQLLAERSLAPTAAAKRRITRSILQMSLDHHIVTPLTSLVIENEAGDERMLADAPPQDPSCCSGALYYGSKVVPDSTPSWANPSPTPVISMLAQGSQVLESTPPPHVMRVENDPHFIIYLPKSQKNICFNIDSEPGKILNLVSDPESGIVVNGQLVGAKKPNNGKLSTYFGKLGFYFQSEDIKIEISTETITLSHGSSTFSLSWSDTAQVTNQRVQISVKKEKVVTITLDKEMSFSVLLHRVWKKHPVNVDFLGIYIPPTNKFSPKAHGLIGQFMQEPKIHIFNERPGKDP

SEQ ID NO: 837781 - protein, 860 aa, Homo sapiens
FVPILNKVREFFLLFSSFLKRTVLLCCSFELGSVGRSDILPRPSALGSLAKLSSKMKRLTCFFICFFLSEVSGFEIPINGLSEFVDYEDLVELAPGKFQLVAENRRYQRSLPGESEEMMEEVDQVTLYSYKVQSTITSRMATTMIQSKVVNNSPQPQNVVFDVQIPKGAFISNFSMTVDGKTFRSSIKEKTVGRALYAQARAKGKTAGLVRSSALDMENFRTEVNVLPGAKVQFELHYQEVKWRKLGSYEHRIYLQPGRLAKHLEVDVWVIEPQGLRFLHVPDTFEGHFDGVPVISKGQQKAHVSFKPTVAQQRICPSCRETAVDGELVVLYDVKREEKAGELEVFNGYFVHFFAPDNLDPIPKNILFVIDVSGSMWGVKMKQTVEAMKTILDDLRAEDHFSVIDFNQNIRTWRNDLISATKTQVADAKRYIEKIQPSGGTNINEALLRAIFILNEANNLGLLDPNSVSLIILVSDGDPTVGELKLSKIQKNVKENIQDNISLFSLGMGFDVDYDFLKRLSNENHGIAQRIYGNQDTSSQLKKFYNQVSTPLLRNVQFNYPHTSVTDVTQNNFHNYFGGSEIVVAGKFDPAKLDQIESVITATSANTQLVLETLAQMDDLQDFLSKDKHADPDFTRKLWAYLTINQLLAERSLAPTAAAKRRITRSILQMSLDHHIVTPLTSLVIENEAGDERMLADAPPQDPSCCSGALYYGSKVVPDSTPSWANPSPTPVISMLAQGSQVLESTPPPHVMRVENDPHFIIYLPKSQKNICFNIDSEPGKILNLVSDPESGIVVNGQLVGAKKPNNGKLSTYFGKLGFYFQSEDIKIEISTETITLSHGSSTFSLSWSDTAQVTNQRQV

SEQ ID NO: 837782 - protein, 802 aa, Homo sapiens
FVPILNKVREFFLLFSSFLKRTVLLCCSFELGSVGRSDILPRPSALGSLAKLSSKMKRLTCFFICFFLSEVSGFEIPINGLSEFVDYEDLVELAPGKFQLVAENRRYQRSLPGESEEMMEEVDQVTLYSYKVQSTITSRMATTMIQSKVVNNSPQPQNVVFDVQIPKGAFISNFSMTVDGKTFRSSIKEKTVGRALYAQARAKGKTAGLVRSSALDMENFRTEVNVLPGAKVQFELHYQEVKWRKLGSYEHRIYLQPGRLAKHLEVDVWVIEPQGLRFLHVPDTFEGHFDGVPVISKGQQKAHVSFKPTVAQQRICPSCRETAVDGELVVLYDVKREEKAGELEVFNGYFVHFFAPDNLDPIPKNILFVIDVSGSMWGVKMKQTVEAMKTILDDLRAEDHFSVIDFNQNIRTWRNDLISATKTQVADAKRYIEKIQPSGGTNINEALLRAIFILNEANNLGLLDPNSVSLIILVSDGDPTVGELKLSKIQKNVKENIQDNISLFSLGMGFDVDYDFLKRLSNENHGIAQRIYGNQDTSSQLKKFYNQVSTPLLRNVQFNYPHTSVTDVTQNNFHNYFGGSEIVVAGKFDPAKLDQIESVITATSANTQLVLETLAQMDDLQDFLSKDKHADPDFTRKLWAYLTINQLLAERSLAPTAAAKRRITRSILQMSLDHHIVTPLTSLVIENEAGDERMLADAPPQDPSCCSGALYYGSKVVPDSTPSWANPSPTPVISMLAQGSQVLESTPPPHVMRVENDPHFIIYLPKSQKNICFNIDSEPGKILNLVSDPESGKIKINYICTN

SEQ ID NO: 837783 - protein, 671 aa, Homo sapiens
FVPILNKVREFFLLFSSFLKRTVLLCCSFELGSVGRSDILPRPSALGSLAKLSSKMKRLTCFFICFFLSEVSGFEIPINGLSEFVDYEDLVELAPGKFQLVAENRRYQRSLPGESEEMMEEVDQVTLYSYKVQSTITSRMATTMIQSKVVNNSPQPQNVVFDVQIPKGAFISNFSMTVDGKTFRSSIKEKTVGRALYAQARAKGKTAGLVRSSALDMENFRTEVNVLPGAKVQFELHYQEVKWRKLGSYEHRIYLQPGRLAKHLEVDVWVIEPQGLRFLHVPDTFEGHFDGVPVISKGQQKAHVSFKPTVAQQRICPSCRETAVDGELVVLYDVKREEKAGELEVFNGYFVHFFAPDNLDPIPKNILFVIDVSGSMWGVKMKQTVEAMKTILDDLRAEDHFSVIDFNQNIRTWRNDLISATKTQVADAKRYIEKIQPSGGTNINEALLRAIFILNEANNLGLLDPNSVSLIILVSDGDPTVGELKLSKIQKNVKENIQDNISLFSLGMGFDVDYDFLKRLSNENHGIAQRIYGNQDTSSQLKKFYNQVSTPLLRNVQFNYPHTSVTDVTQNNFHNYFGGSEIVVAGKFDPAKLDQIESVITATSANTQLVLETLAQMDDLQDFLSKDKHADPDFTRKLWAYLTINQLLAERASVSLHFEKDADSSRIIAPM

SEQ ID NO: 837784 - protein, 161 aa, Homo sapiens
LHQGLKKDRKNLLETRLHITGRELRSKIAETFGLQENYIKIVINKKQLQLVAGITGAHHHRCTSPCPDNFFVFVVEMRFHYVAHASLKLLGSSDPPTTASQSAGITGVSHRTQPPFCIYCWNSEKFVFAHQLFYMWRYNLYRKVRIKYFVSFSLFSCFQNK

SEQ ID NO: 837785 - protein, 625 aa, Homo sapiens
MKTNGGRCRIRALCWSRREWRGAGMAQKKYLQAKLTQFLREDRIQLWKPPYTDENKKVGLALKDLAKQYSDRLECCENEVEKVIEEIRCKAIERGTGNDNYRTTGIATIEVFLPPRLKKDRKNLLETRLHITGRELRSKIAETFGLQENYIKIVINKKQLQLGKTLEEQGVAHNVKAMVLELKQSEEDARKNFQLEEEEQNEAKLKEKQIQRTKRGLEILAKRAAETVVDPEMTPYLDIANQTGRSIRIPPSERKALMLAMGYHEKGRAFLKRKEYGIALPCLLDADKYFCECCRELLDTVDNYAVLQLDIVWCYFRLEQLECLDDAEKKLNLAQKCFKNCYGENHQRLVHIKGNCGKEKVLFLRLYLLQGIRNYHSGNDVEAYEYLNKARQLFKELYIDPSKVDNLLQLGFTAQEARLGLRACDGNVDHAATHITNRREELAQIRKEEKEKKRRRLENIRFLKGMGYSTHAAQQILLSNPQMWWLNDSNPETDNRQESPSQENIDRLVYMGFDALVAEAALRVFRGNVQLAAQTLAHNGGSLPPELPLSPEDSLSPPATSPSDSAGTSSASTDEDMETEAVNEILEDIPEHEEDYLDSTLEDEEIIIAEYLSYVENRKSATKKN

SEQ ID NO: 837786 - protein, 639 aa, Homo sapiens
MKTNGGRCRIRALCWSRREWRGAGMAQKKYLQAKLTQFLREDRIQLWKPPYTDENKKVGLALKDLAKQYSDRLECCENEVEKVIEEIRCKAIERGTGNDNYRTTGIATIEVFLPPRLKKDRKNLLETRLHITGRELRSKIAETFGLQENYIKIVINKKQLQLGKTLEEQGVAHNVKAMVLELKQSEEDARKNFQLEEEEQNEAKLKEKQIQRTKRGLEILAKRAAETVVDPEMTPYLDIANQTGRSIRIPPSERKALMLAMGYHEKGRAFLKRKEYGIALPCLLDADKYFCECCRELLDTVDNYAVLQLDIVWCYFRLEQLECLDDAEKKLNLAQKCFKNCYGENHQRLVHIKGNCGKEKVLFLRLYLLQGIRNYHSGNDVEAYEYLNKARQLFKELYIDPSKVDNLLQLGFTAQEARLGLRACDGNVDHAATHITNRREELAQIRKEEKEKKRRRLENIRFLKGMGYSTHAAQQVLHAASGNLDEALKILLSNPQMWWLNDSNPETDNRQESPSQENIDRLVYMGFDALVAEAALRVFRGNVQLAAQTLAHNGGSLPPELPLSPEDSLSPPATSPSDSAGTSSASTDEDMETEAVNEILEDIPEHEEDYLDSTLEDEEIIIAEYLSYVENRKSATKKN

SEQ ID NO: 837787 - protein, 569 aa, Homo sapiens
MKTNGGRCRIRALCWSRREWRGAGMAQKKYLQAKLTQFLREDRIQLWKPPYTDENKKVGLALKDRKNLLETRLHITGRELRSKIAETFGLQENYIKIVINKKQLQLGKTLEEQGVAHNVKAMVLELKQSEEDARKNFQLEEEEQNEAKLKEKQIQRTKRGLEILAKRAAETVVDPEMTPYLDIANQTGRSIRIPPSERKALMLAMGYHEKGRAFLKRKEYGIALPCLLDADKYFCECCRELLDTVDNYAVLQLDIVWCYFRLEQLECLDDAEKKLNLAQKCFKNCYGENHQRLVHIKGNCGKEKVLFLRLYLLQGIRNYHSGNDVEAYEYLNKARQLFKELYIDPSKVDNLLQLGFTAQEARLGLRACDGNVDHAATHITNRREELAQIRKEEKEKKRRRLENIRFLKGMGYSTHAAQQILLSNPQMWWLNDSNPETDNRQESPSQENIDRLVYMGFDALVAEAALRVFRGNVQLAAQTLAHNGGSLPPELPLSPEDSLSPPATSPSDSAGTSSASTDEDMETEAVNEILEDIPEHEEDYLDSTLEDEEIIIAEYLSYVENRKSATKKN

SEQ ID NO: 837788 - protein, 448 aa, Homo sapiens
MVLELKQSEEDARKNFQLEEEEQNEAKLKEKQIQRTKRGLEILAKRAAETVVDPEMTPYLDIANQTGRSIRIPPSERKALMLAMGYHEKGRAFLKRKEYGIALPCLLDADKYFCECCRELLDTVDNYAVLQLDIVWCYFRLEQLECLDDAEKKLNLAQKCFKNCYGENHQRLVHIKGNCGKEKVLFLRLYLLQGIRNYHSGNDVEAYEYLNKARQLFKELYIDPSKVDNLLQLGFTAQEARLGLRACDGNVDHAATHITNRREELAQIRKEEKEKKRRRLENIRFLKGMGYSTHAAQQILLSNPQMWWLNDSNPETDNRQESPSQENIDRLVYMGFDALVAEAALRVFRGNVQLAAQTLAHNGGSLPPELPLSPEDSLSPPATSPSDSAGTSSASTDEDMETEAVNEILEDIPEHEEDYLDSTLEDEEIIIAEYLSYVENRKSATKKN

SEQ ID NO: 837789 - protein, 356 aa, Homo sapiens
QHDEPGVLADVVDGQDADKYFCECCRELLDTVDNYAVLQLDIVWCYFRLEQLECLDDAEKKLNLAQKCFKNCYGENHQRLVHIKGNCGKEKVLFLRLYLLQGIRNYHSGNDVEAYEYLNKARQLFKELYIDPSKVDNLLQLGFTAQEARLGLRACDGNVDHAATHITNRREELAQIRKEEKEKKRRRLENIRFLKGMGYSTHAAQQILLSNPQMWWLNDSNPETDNRQESPSQENIDRLVYMGFDALVAEAALRVFRGNVQLAAQTLAHNGGSLPPELPLSPEDSLSPPATSPSDSAGTSSASTDEDMETEAVNEILEDIPEHEEDYLDSTLEDEEIIIAEYLSYVENRKSATKKN

SEQ ID NO: 837790 - protein, 193 aa, Homo sapiens
RVSLWLPSPESRSHSQSPAQAEPELQPERGGALSPVLLSSSASILLSNPQMWWLNDSNPETDNRQESPSQENIDRLVYMGFDALVAEAALRVFRGNVQLAAQTLAHNGGSLPPELPLSPEDSLSPPATSPSDSAGTSSASTDEDMETEAVNEILEDIPEHEEDYLDSTLEDEEIIIAEYLSYVENRKSATKKN

SEQ ID NO: 837791 - protein, 548 aa, Homo sapiens
MKTNGGRCRIRALCWSRREWRGAGMAQKKYLQAKLTQFLREDRIQLWKPPYTDENKKVGLALKDLAKQYSDRLECCENEVEKVIEEIRCKAIERGTGNDNYRTTGIATIEVFLPPRLKKDRKNLLETRLHITGRELRSKIAETFGLQENYIKIVINKKQLQLGKTLEEQGVAHNVKAMVLELKQSEEDARKNFQLEEEEQNEAKLKEKQIQRTKRGLEILAKRAAETVVDPEMTPYLDIANQTGRSIRIPPSERKALMLAMGYHEKGRAFLKRKEYGIALPCLLDADKYFCECCRELLDTVDNYAVLQLDIVWCYFRLEQLECLDDAEKKLNLAQKCFKNCYGENHQRLVHIKGNCGKEKVLFLRLYLLQGIRNYHSGNDVEAYEYLNKARQLFKELYIDPSKVDNLLQLGFTAQEARLGLRACDGNVDHAATHITNRREELAQIRKEEKEKKRRRLENIRFLKGMGYSTHAAQQVLHAASGNLDEALKVAAPSGPLALSLSSGSCPELPPWLSSILPGSLLWAAPSSGSEGQVSPGLQPRHRLREAT

SEQ ID NO: 837792 - protein, 291 aa, Homo sapiens
MKTNGGRCRIRALCWSRREWRGAGMAQKKYLQAKLTQFLREDRIQLWKPPYTDENKKVGLALKDLAKQYSDRLECCENEVEKVIEEIRCKAIERGTGNDNYRTTGIATIEVFLPPRLKKDRKNLLETRLHITGRELRSKIAETFGLQENYIKIVINKKQLQLGKTLEEQGVAHNVKAMVLELKQSEEDARKNFQLEEEEQNEAKLKEKQIQRTKRGLEILAKRAAETVVDPEMTPYLDIANQTGRSIRIPPSERKALMLAMGYHEKGRAFLKRKEYGIALPCLLDADKYFW

SEQ ID NO: 837793 - protein, 499 aa, Homo sapiens
MKTNGGRCRIRALCWSRREWRGAGMAQKKYLQAKLTQFLREDRIQLWKPPYTDENKKVGLALKDLAKQYSDRLECCENEVEKVIEEIRCKAIERGTGNDNYRTTGIATIEVFLPPRLKKDRKNLLETRLHITGRELRSKIAETFGLQENYIKIVINKKQLQLGKTLEEQGVAHNVKAMVLELKQSEEDARKNFQLEEEEQNEAKLKEKQIQRTKRGLEILAKRAAETVVDPEMTPYLDIANQTGRSIRIPPSERKALMLAMGYHEKGRAFLKRKEYGIALPCLLDADKYFCECCRELLDTVDNYAVLQLDIVWCYFRLEQLECLDDAEKKLNLAQKCFKNCYGENHQRLVHIKGNCGKEKVLFLRLYLLQGIRNYHSGNDVEAYEYLNKARQLFKELYIDPSKVDNLLQLGFTAQEARLGLRACDGNVDHAATHITNRREVPTFTCPSSLGYERTKKDNPTGVLITRNSLLLQIGKEGETCPFFFLETESHFVIQAGVQ

SEQ ID NO: 837794 - protein, 291 aa, Homo sapiens; identical to SEQ ID NO: 837792

SEQ ID NO: 837795 - protein, 625 aa, Homo sapiens; identical to SEQ ID NO: 837785

SEQ ID NO: 837796 - protein, 625 aa, Homo sapiens; identical to SEQ ID NO: 837785

SEQ ID NO: 837797 - protein, 639 aa, Homo sapiens
HGGRVSSTPASAALLGAPVPGPTGHLSWPGVERPRGGGMAQKKYLQAKLTQFLREDRIQLWKPPYTDENKKVGLALKDLAKQYSDRLECCENEVEKVIEEIRCKAIERGTGNDNYRTTGIATIEVFLPPRLKKDRKNLLETRLHITGRELRSKIAETFGLQENYIKIVINKKQLQLGKTLEEQGVAHNVKAMVLELKQSEEDARKNFQLEEEEQNEAKLKEKQIQRTKRGLEILAKRAAETVVDPEMTPYLDIANQTGRSIRIPPSERKALMLAMGYHEKGRAFLKRKEYGIALPCLLDADKYFCECCRELLDTVDNYAVLQLDIVWCYFRLEQLECLDDAEKKLNLAQKCFKNCYGENHQRLVHIKGNCGKEKVLFLRLYLLQGIRNYHSGNDVEAYEYLNKARQLFKELYIDPSKVDNLLQLGFTAQEARLGLRACDGNVDHAATHITNRREELAQIRKEEKEKKRRRLENIRFLKGMGYSTHAAQQILLSNPQMWWLNDSNPETDNRQESPSQENIDRLVYMGFDALVAEAALRVFRGNVQLAAQTLAHNGGSLPPELPLSPEDSLSPPATSPSDSAGTSSASTDEDMETEAVNEILEDIPEHEEDYLDSTLEDEEIIIAEYLSYVENRKSATKKN

SEQ ID NO: 837798 - protein, 487 aa, Homo sapiens
MRTARRFTTMILGIDLETAKQIQLGKTLEEQGVAHNVKAMVLELKQSEEDARKNFQLEEEEQNEAKLKEKQIQRTKRGLEILAKRAAETVVDPEMTPYLDIANQTGRSIRIPPSERKALMLAMGYHEKGRAFLKRKEYGIALPCLLDADKYFCECCRELLDTVDNYAVLQLDIVWCYFRLEQLECLDDAEKKLNLAQKCFKNCYGENHQRLVHIKGNCGKEKVLFLRLYLLQGIRNYHSGNDVEAYEYLNKARQLFKELYIDPSKVDNLLQLGFTAQEARLGLRACDGNVDHAATHITNRREELAQIRKEEKEKKRRRLENIRFLKGMGYSTHAAQQILLSNPQMWWLNDSNPETDNRQESPSQENIDRLVYMGFDALVAEAALRVFRGNVQLAAQTLAHNGGSLPPELPLSPEDSLSPPATSPSDSAGTSSASTDEDMETEAVNEILEDIPEHEEDYLDSTLEDEEIIIAEYLSYVENRKSATKKN

SEQ ID NO: 837799 - protein, 174 aa, Homo sapiens
MGYSTHAAQQVLHAASGNLDEALKILLSNPQMWWLNDSNPETDNRQESPSQENIDRLVYMGFDALVAEAALRVFRGNVQLAAQTLAHNGGSLPPELPLSPEDSLSPPATSPSDSAGTSSASTDEDMETEAVNEILEDIPEHEEDYLDSTLEDEEIIIAEYLSYVENRKSATKKN

SEQ ID NO: 837800 - protein, 101 aa, Homo sapiens
RVQTVLRVQTVLRVQTVPMHGLGEEASSGLAQAVPSASQVCVPNPFPSLVFYPETGRNRGPVEQGSWGRCPGQGPGKGVPTASSPAVAPSAQLACLLHPLP

SEQ ID NO: 837801 - protein, 291 aa, Homo sapiens; identical to SEQ ID NO: 837792

SEQ ID NO: 837802 - protein, 428 aa, Homo sapiens
MKTNGGRCRIRALCWSRREWRGAGMAQKKYLQAKLTQFLREDRIQLWKPPYTDENKKVGLALKDLAKQYSDRLECCENEVEKVIEEIRCKAIERGTGNDNYRTTGIATIEVFLPPRLKKDRKNLLETRLHITGRELRSKIAETFGLQENYIKIVINKKQLQLGKTLEEQGVAHNVKAMVLELKQSEEDARKNFQLEEEEQNEAKLKEKQIQRTKRGLEILAKRAAETVVDPEMTPYLDIANQTGRSIRIPPSERKALMLAMGYHEKGRAFLKRKEYGIALPCLLDADKYFCECCRELLDTVDNYAVLQLDIVWCYFRLEQLECLDDAEKKLNLAQKCFKNCYGENHQRLVHIKGNCGKEKVLFLRLYLLQGIRNYHSGNDVEAYEYLNKARQLFKELYIDPSKVDNLLQLGFTAQEASTVFGVLYSAA

SEQ ID NO: 837803 - protein, 239 aa, Homo sapiens
MKTNGGRCRIRALCWSRREWRGAGMAQKKYLQAKLTQFLREDRIQLWKPPYTDENKKVGLALKDLAKQYSDRLECCENEVEKVIEEIRCKAIERGTGNDNYRTTGIATIEVFLPPRLKKDRKNLLETRLHITGRELRSKIAETFGLQENYIKIVINKKQLQLGKTLEEQGVAHNVKAMVLELKQSEEDARKNFQLEEEEQNEAKLKEKQIQRTKRGLEILAKRAEETVGELSSGADVGR

SEQ ID NO: 837804 - protein, 563 aa, Homo sapiens
MLEEAGEVLENMLKASCLPLGFIVFLPAVLLLVAPPLPAADAAHEFTVYRMQQYDLQGQPYGTRNAVLNTEARTMAAEVLSRRCVLMRLLDFSYEQYQKALRQSAGAVVIILPRAMAAVPQDVVRQFMEIEPEMLAMETAVPVYFAVEDEALLSIYKQTQAASASQGSASAAEVLLRTATANGFQMVTSGVQSKAVSDWLIASVEGRLTGLGGEDLPTIVIVAHYDAFGVAPWLSLGADSNGSGVSVLLELARLFSRLYTYKRTHAAYNLLFFASGGGKFNYQGTKRWLEDNLDHTDSSLLQDNVAFVLCLDTVGRGSSLHLHVSKPPREGTLQHAFLRELETVAAHQFPEVRFSMVHKRINLAEDVLAWEHERFAIRRLPAFTLSHLESHRDGQRSSIMDVRSRVDSKTLTRNTRIIAEALTRVIYNLTEKGTPPDMPVFTEQMQIQQEQLDSVMDWLTNQPRAAQLVDKDSTFLSTLEHHLSRYLKDVKQHHVKADKRDPEFVFYDQLKQVMNAYRVKPAVFDLLLAVGIAAYLGMAYVAVQHFSLLYKTVQRLLVKAKTQ

SEQ ID NO: 837805 - protein, 75 aa, Homo sapiens
ALSLSLVLLRTATANGFQMVTSGVQSKAVSDWLIASVEEAVTGLGGEANMKCPQIVIAFYEERLTWHSCPEDEAQ

SEQ ID NO: 837806 - protein, 563 aa, Homo sapiens; identical to SEQ ID NO: 837804

SEQ ID NO: 837807 - protein, 570 aa, Homo sapiens
MLEEAGEVLENMLKASCLPLGFIVFLPAVLLLVAPPLPAADAAHEFTVYRMQQYDLQGQPYGTRNAVLNTEARTMAAEVLSRRCVLMRLLDFSYEQYQKALRQSAGAVVIILPRAMAAVPQDVVRQFMEIEPEMLAMETAVPVYFAVEDEALLSIYKQTQAASASQGSASAAEVLLRTATANGFQMVTSGVQSKAVSDWLIASVEGRLTGLGGEDLPTIVIVAHYDAFGVAPWLSLGADSNGSGVSVLLELARLFSRLYTYKRTHAAYNLLFFASGGGKFNYQGTKRWLEDNLDHTDSSLLQDNVAFVLCLDTVGRGSSLHLHVSKPPREGTLQHAFLRELETVAAHQFPEVRFSMVHKRINLAEDVLAWEHERFAIRRLPAFTLSHLESHRDGQRSSIMDVRSRVDSKTLTRNTRIIAEALTRVIYNLTEKGTPPDMPVFTEQMQIQQEQLDSVMDWLTNQPRAAQLVDKDSTFLSTLEHHLSRYLKDVKQHHVKADKRDPEFVFYDQLKQVMNAYRVKPAVFDLLLAVGIAAYLGMAYVAVQVSSAQAQHFSLLYKTVQRLLVKAKTQ

SEQ ID NO: 837808 - protein, 563 aa, Homo sapiens; identical to SEQ ID NO: 837804

SEQ ID NO: 837809 - protein, 563 aa, Homo sapiens; identical to SEQ ID NO: 837804

SEQ ID NO: 837810 - protein, 619 aa, Homo sapiens
MLEEAGEVLENMLKASCLPLGFIVFLPAVLLLVAPPLPAADAAHEFTVYRMQQYDLQGQPYGTRNAVLNTEARTMAAEVLSRRCVLMRLLDFSYEQYQKALRQSAGAVVIILPRAMAAVPQDVVRQFMEIEPEMLAMETAVPVYFAVEDEALLSIYKQTQAASASQGSASAAEVLLRTATANGFQMVTSGVQSKAVSDWLIASVEGRLTGLGGEDLPTIVIVAHYDAFGVAPWLSLGADSNGSGVSVLLELARLFSRLYTYKRTHAAYNLLFFASGGGKFNYQGTKRWLEDNLDHTDSSLLQDNVAFVLCLDTVGRGSSLHLHVSKPPREGTLQHAFLRELETVAAHQFPEVRFSMVHKRINLAEDVLAWEHERFAIRRLPAFTLSHLESHRDGQRSSIMDVRSRVDSKTLTRNTRIIAEALTRVIYNLTEKGTPPDMPVFTEQMQIQQEQLDSVMDWLTNQPRAAQLVDKDSTFLSTLEHHLSRYLKDVKQHHVKADKRDPEFVFYDQLKQVMNAYRVKPAVFDLLLAVGIAAYLGMAYVAVQHFSLLYKTVQRLAQGPITTGLWALVLRLWDPGSCHLVTMREFGECLHASQQAPVWVPRGQHFGGSFLPSFLDRSS

SEQ ID NO: 837811 - protein, 563 aa, Homo sapiens; identical to SEQ ID NO: 837804

SEQ ID NO: 837812 - protein, 563 aa, Homo sapiens; identical to SEQ ID NO: 837804

SEQ ID NO: 837813 - protein, 563 aa, Homo sapiens; identical to SEQ ID NO: 837804

SEQ ID NO: 837814 - protein, 563 aa, Homo sapiens; identical to SEQ ID NO: 837804

SEQ ID NO: 837815 - protein, 767 aa, Homo sapiens
SSQRLGSQSAPRPCGARPCSRVEPPPPPPPPQLQPPRQARPRRAMSDYSTGGPPPGPPPPAGGGGGAGGAGGGPPPGPPGAGDRGGGGPCGGGPGGGSAGGPSQPPGGGGPGIRKDAFADAVQRARQIAAKIGGDAATTVNNSTPDFGFGGQKRQLEDGDQPESKKLASQGDSISSQLGPIHPPPRTSMTEEYRVPDGMVGLIIGRGGEQINKIQQDSGCKVQISPDSGGLPERSVSLTGAPESVQKAKMMLDDIVSRGRGGPPGQFHDNANGGQNGTVQEIMIPAGKAGLVIGKGGETIKQLQERAGVKMILIQDGSQNTNVDKPLRIIGDPYKVQQACEMVMDILRERDQGGFGDRNEYGSRIGGGIDVPVPRHSVGVVIGRSGEMIKKIQNDAGVRIQFKQDDGTGPEKIAHIMGPPDRCEHAARIINDLLQSLRSGPPGPPGGPGMPPGGRGRGRGQGNWGPPGGEMTFSIPTHKCGLVIGRGGENVKAINQQTGAFVEISRQLPPNGDPNFKLFIIRGSPQQIDHAKQLIEEKIEGPLCPVGPGPGGPGPAGPMGPFNPGPFNQGPPGAPPHAGGPPPHQYPPQGWGNTYPQWQPPAPHDPSKAAAAAADPNAAWAAYYSHYYQQPPGPVPGPAPAPAAPPAQGEPPQPPPTGQSDYTKAWEEYYKKIGQQPQQPGAPPQQDYTKAWEEYYKKQAQVATGGGPGAPPGSQPDYSAAWAEYYRQQAAYYGQTPGPGGPQPPPTQQGQQQRRLNESNECELLHL

SEQ ID NO: 837816 - protein, 169 aa, Homo sapiens
SSQRLGSQSAPRPCGARPCSRVEPPPPPPPPQLQPPRQARPRRAMSDYSTGGPPPGPPPPAGGGGGAGGAGGKKKKKKKKKKRGWAACGPLEKVFKTISVGGGGGPPVEVYGAHRLVPKTRGAPKREKSRGGQGHHGGAGDFLSPPIKKTRRGGGPPRRGVSRQPNPPR

SEQ ID NO: 837817 - protein, 589 aa, Homo sapiens
NTARYEAWVKAKMMLDDIVSRGRGGPPGQFHDNANGGQNGTVQEIMIPAGKAGLVIGKGGETIKQLQERAGVKMILIQDGSQNTNVDKPLRIIGDPYKVQQACEMVMDILRERDQGGFGDRNEYGSRIGGGIDVPVPRHSVGVVIGRSGEMIKKIQNDAGVRIQFKQDDGTGPEKIAHIMGPPDRCEHAARIINDLLQSLRVGGPGLLKGLAGPPGECKTRPASRVHHPPPPLVLQSGPPGPPGGPGMPPGGRGRGRGQGNWGPPGGEMTFSIPTHKCGLVIGRGGENVKAINQQTGAFVEISRQLPPNGDPNFKLFIIRGSPQQIDHAKQLIEEKIEGPLCPVGPGPGGPGPAGPMGPFNPGPFNQGPPGAPPHAGGPPPHQYPPQGWGNTYPQWQPPAPHDPSKAAAAAADPNAAWAAYYSHYYQQPPGPVPGPAPAPAAPPAQGEPPQPPPTGQSDYTKAWEEYYKKIGQQPQQPGAPPQQDYTKAWEEYYKKQAQVATGGGPGAPPGSQPDYSAAWAEYYRQQAAYYGQTPGPGGPQPPPTQQGQQQASGNCHPPPPPFSFQPPATVHPALVGSAGNPFPCGVCP

SEQ ID NO: 837818 - protein, 589 aa, Homo sapiens; identical to SEQ ID NO: 837817

SEQ ID NO: 837819 - protein, 589 aa, Homo sapiens; identical to SEQ ID NO: 837817

SEQ ID NO: 837820 - protein, 775 aa, Homo sapiens
NTARYEAWVKAKMMLDDIVSRGRGGPPGQFHDNANGGQNGTVQEIMIPAGKAGLVIGKGGETIKQLQERAGVKMILIQDGSQNTNVDKPLRIIGDPYKVQQACEMVMDILRERDQGGFGDRNEYGSRIGGGIDVPVPRHSVGVVIGRSGEMIKKIQNDAGVRIQFKQDDGTGPEKIAHIMGPPDRCEHAARIINDLLQSLRVGGPGLLKGLAGPPGECKTRPASRVHHPPPPLVLQSGPPGPPGGPGMPPGGRGRGRGQGNWGPPGGEMTFSIPTHKCGLVIGRGGENVKAINQQTGAFVEISRQLPPNGDPNFKLFIIRGSPQQIDHAKQLIEEKIEVGWGGLWGFGLTARIPAHLPWLLSFLLGSSLPSWTRPRWPRPCWPNGALQSWALQPGATRGSPTVSILCLLGFEAGGFTELARRIADPISLSLEVQAGGLIQPIFVDTINRPSPVYLVEHVPFSIPLCTCKFRGFFHVLKLTLRVLQSCFLSRPFPGAPLSLVVWVSGASPLKNIPTPGGPARPPPHHCSSIPFFSPAVPGGPLLTSTHPRAGAIPTPSGSRLLLMTQVSDGPPGGGQALFCPPVSPEVSPAGKAAAAAADPNAAWAAYYSHYYQQPPGPVPGPAPAPAAPPAQGEPPQPPPTGQSDYTKAWEEYYKKIGQQPQQPGAPPQQDYTKAWEEYYKKQAQVATGGGPGAPPGSQPDYSAAWAEYYRQQAAYYGQTPGPGGPQPPPTQQGQQQASGNCHPPPPPFSFQPPATVHPALVGSAGNPFPCGVCP

SEQ ID NO: 837821 - protein, 589 aa, Homo sapiens; identical to SEQ ID NO: 837817

SEQ ID NO: 837822 - protein, 589 aa, Homo sapiens; identical to SEQ ID NO: 837817

SEQ ID NO: 837823 - protein, 589 aa, Homo sapiens; identical to SEQ ID NO: 837817

SEQ ID NO: 837824 - protein, 589 aa, Homo sapiens; identical to SEQ ID NO: 837817

SEQ ID NO: 837825 - protein, 589 aa, Homo sapiens; identical to SEQ ID NO: 837817

SEQ ID NO: 837826 - protein, 589 aa, Homo sapiens; identical to SEQ ID NO: 837817

SEQ ID NO: 837827 - protein, 589 aa, Homo sapiens; identical to SEQ ID NO: 837817

SEQ ID NO: 837828 - protein, 589 aa, Homo sapiens; identical to SEQ ID NO: 837817

SEQ ID NO: 837829 - protein, 479 aa, Homo sapiens
NTARYEAWVKAKMMLDDIVSRGRGGPPGQFHDNANGGQNGTVQEIMIPAGKAGLVIGKGGETIKQLQERAGVKMILIQDGSQNTNVDKPLRIIGDPYKVQQACEMVMDILRERDQGGFGDRNEYGSRIGGGIDVPVPRHSVGVVIGRSGEMIKKIQNDAGVRIQFKQDDGTGPEKIAHIMGPPDRCEHAARIINDLLQSLRVGGPGLLKGLAGPPGECKTRPASRVHHPPPPLVLQSGPPGPPGGPGMPPGGRGRGRGQGNWGPPGGEMTFSIPTHKCGLVIGRGGENVKAINQQTGAFVEISRQLPPNGDPNFKLFIIRGSPQQIDHAKQLIEEKIEGPLCPVGPGPGGPGPAGPMGPFNPGPFNQGPPGAPPHAGGPPPHQYPPQGWGNTYPQWQPPAPHDPSKAAAAAADPNAAWAAYYSHYYQQPPGPVPGPAPAPAAPPAQGEPPQPPPTGQSDYTKAWEEYYKKIVCQKKKKT

SEQ ID NO: 837830 - protein, 107 aa, Homo sapiens
MPGGRGPPSRAEGLYSPLHIRAKGSVCPQPSPISVPSLGERDIVGVGGTVLPLQSGKWMGTCLGLSTWAKWGRRAWGLALGCFGGLKAWSVSLGERREGLPPPCIEA

SEQ ID NO: 837831 - protein, 396 aa, Homo sapiens
DCIKLSKGDVEGFNLRVRVLINLQLISNRDSDRQTDITTLRAQSGPPGPPGGPGMPPGGRGRGRGQGNWGPPGGEMTFSIPTHKCGLVIGRGGENVKAINQQTGAFVEISRQLPPNGDPNFKLFIIRGSPQQIDHAKQLIEEKIEGPLCPVGPGPGGPGPAGPMGPFNPGPFNQGPPGAPPHAGGPPPHQYPPQGWGNTYPQWQPPAPHDPSKAAAAAADPNAAWAAYYSHYYQQPPGPVPGPAPAPAAPPAQGEPPQPPPTGQSDYTKAWEEYYKKIGQQPQQPGAPPQQDYTKAWEEYYKKQAQVATGGGPGAPPGSQPDYSAAWAEYYRQQAAYYGQTPGPGGPQPPPTQQGQQQASGNCHPPPPPFSFQPPATVHPALVGSAGNPFPCGVCP

SEQ ID NO: 837832 - protein, 589 aa, Homo sapiens; identical to SEQ ID NO: 837817

SEQ ID NO: 837833 - protein, 472 aa, Homo sapiens
NTARYEAWVKAKMMLDDIVSRGRGGPPGQFHDNANGGQNGTVQEIMIPAGKAGLVIGKGGETIKQLQERAGVKMILIQDGSQNTNVDKPLRIIGDPYKVQQACEMVMDILRERDQGGFGDRNEYGSRIGGGIDVPVPRHSVGVVIGRSGEMIKKIQNDAGVRIQFKQDDGTGPEKIAHIMGPPDRCEHAARIINDLLQSLRVGGPGLLKGLAGPPGECKTRPASRVHHPPPPLVLQSGPPGPPGGPGMPPGGRGRGRGQGNWGPPGGEMTFSIPTHKCGLVIGRGGENVKAINQQTGAFVEISRQLPPNGDPNFKLFIIRGSPQQIDHAKQLIEEKIEGPLCPVGPGPGGPGPAGPMGPFNPGPFNQGPPGAPPHAGGPPPHQYPPQGWGNTYPQWQPPAPHDPSKAAAAAADPNAAWAAYYSHYYQQPPGPVPGPAPAPAAPPAQGEPPQPLPRRAQPPMRSRLPVSRACL

SEQ ID NO: 837834 - protein, 589 aa, Homo sapiens; identical to SEQ ID NO: 837817

SEQ ID NO: 837835 - protein, 589 aa, Homo sapiens; identical to SEQ ID NO: 837817

SEQ ID NO: 837836 - protein, 589 aa, Homo sapiens; identical to SEQ ID NO: 837817

SEQ ID NO: 837837 - protein, 565 aa, Homo sapiens
NTARYEAWVKAKMMLDDIVSRGRGGPPGQFHDNANGGQNGTVQEIMIPAGKAGLVIGKGGETIKQLQERAGVKMILIQDGSQNTNVDKPLRIIGDPYKVQQACEMVMDILRERDQGGFGDRNEYGSRIGGGIDVPVPRHSVGVVIGRSGEMIKKIQNDAGVRIQFKQDDGTGPEKIAHIMGPPDRCEHAARIINDLLQSLRVGGPGLLKGLAGPPGECKTRPASRVHHPPPPLVLQSGPPGPPGGPGMPPGGRGRGRGQGNWGPPGGEMTFSIPTHKCGLVIGRGGENVKAINQQTGAFVEISRQLPPNGDPNFKLFIIRGSPQQIDHAKQLIEEKIEGPLCPVGPGPGGPGPAGPMGPFNPGPFNQGPPGAPPHAGGPPPHQYPPQGWGNTYPQWQPPAPHDPSKAAAAAADPNAAWAAYYSHYYQQPPGPVPGPAPAPAAPPAQGEPPQPPPTGQSDYTKAWEEYYKKIGQQPQQPGAPPQQDYTKAWEEYYKKQAQVATGGGPGAPPGSQPDYSAAWAEYYRQQAAYYGQTPGPGGPQPPPTQQGQQQRRLNESNECELLHL

SEQ ID NO: 837838 - protein, 526 aa, Homo sapiens
NTARYEAWVKAKMMLDDIVSRGRGGPPGQFHDNANGGQNGTVQEIMIPAGKAGLVIGKGGETIKQLQERAGVKMILIQDGSQNTNVDKPLRIIGDPYKVQQACEMVMDILRERDQGGFGDRNEYGSRIGGGIDVPVPRHSVGVVIGRSGEMIKKIQNDAGVRIQFKQDDGTGPEKIAHIMGPPDRCEHAARIINDLLQSLRVGGPGLLKGLAGPPGECKTRPASRVHHPPPPLVLQSGPPGPPGGPGMPPGGRGRGRGQGNWGPPGGEMTFSIPTHKCGLVIGRGGENVKAINQQTGAFVEISRQLPPNGDPNFKLFIIRGSPQQIDHAKQLIEEKIEGPLCPVGPGPGGPGPAGPMGPFNPGPFNQGPPGAPPHAGGPPPHQYPPQGWGNTYPQWQPPAPHDPSKAAAAAADPNAAWAAYYSHYYQQPPGPVPGPAPAPAAPPAQGEPPQPPPTGQSDYTKAWEEYYKKIGSQPDYSAAWAEYYRQQAAYYGQTPGPGGPQPPPTQQGQQQRRLNESNECELLHL

SEQ ID NO: 837839 - protein, 589 aa, Homo sapiens; identical to SEQ ID NO: 837817

SEQ ID NO: 837840 - protein, 589 aa, Homo sapiens; identical to SEQ ID NO: 837817

SEQ ID NO: 837841 - protein, 535 aa, Homo sapiens
NTARYEAWVKAKMMLDDIVSRGRGGPPGQFHDNANGGQNGTVQEIMIPAGKAGLVIGKGGETIKQLQERAGVKMILIQDGSQNTNVDKPLRIIGDPYKVQQACEMVMDILRERDQGGFGDRNEYGSRIGGGIDVPVPRHSVGVVIGRSGEMIKKIQNDAGVRIQFKQDDGTGPEKIAHIMGPPDRCEHAARIINDLLQSLRVGGPGLLKGLAGPPGECKTRPASRVHHPPPPLVLQSGPPGPPGGPGMPPGGRGRGRGQGNWGPPGGEMTFSIPTHKCGLVIGRGGENVKAINQQTGAFVEISRQLPPNGDPNFKLFIIRGSPQQIDHAKQLIEEKIEGPLCPVGPGPGGPGPAGPMGPFNPGPFNQGPPGAPPHAGGPPPHQYPPQGWGNTYPQWQPPAPHDPSKAAAAAADPNAAWAAYYSHYYQQPPGPVPGPAPAPAAPPAQGEPPQPPPTGQSDYTKAWEEYYKKIALPPAAKPPLLSLPPWLSSRGPARPPSQDWSVVFSSVQEEIETENKMRTTKKIVWQFLLFIARF

SEQ ID NO: 837842 - protein, 81 aa, Homo sapiens
RPSCRPPARLSPRRRCVLGALQVLLTLPLLFLGLSLLWTVLLDPGAVSAWLWSLTSETTLRRLRYTLSPLLELRANGLLPT

SEQ ID NO: 837843 - protein, 417 aa, Homo sapiens
PIVTPASRRLGPRGGRHLGSVSTAMAATQELLLQLQKDNRDGRQRKQELEKLMRGLEAESESLNQRLQDLSERERSLLRRRSQAAQPLQGEAREAARERAERVRRRLEEAERHKEDLVRKSPGMGLDPGWGGAGRAEGGPGWGEVGPAERSAPPQDPVRRSSTAGSCRSSGRSCRVRYVQEMGGPVSWFLSEVLPLSSPLLPPVPVSPDTRSSRSPVNPALTSPAPELFYYGGELQSQKSTEQQLAAQLVTLQNELELAETKCALQEEKLQQDALQTAEAWAIFQEQTVVLQVRPHSDAKVPPASPPPDLGRCDGQLRGVQYSTESLMEEMARADRETRLFGGPRALAIRRCVLGALQVLLTLPLLFLGLSLLWTVLLDPGAVSAWLWSLTSETTLRRLRYTLSPLLELRANGLLPT

SEQ ID NO: 837844 - protein, 486 aa, Homo sapiens
PIVTPASRRLGPRGGRHLGSVSTAMAATQELLLQLQKDNRDGRQRKQELEKLMRGLEAESESLNQRLQDLSERERSLLRRRSQAAQPLQGEAREAARERAERVRRRLEEAERHKEDLVRKSPGMGLDPGWGGAGRAEGGRGGVSRTGGEVGTAPGPRPQEQHSRQLQEQWEELSSQLFYYGGELQSQKSTEQQLAAQLVTLQNELELAETKCALQEEKLQQDALQTAEAWAIFQEQTVVLQVRPHSDAKVPPASPPPDLGRYSLPTHRQDASPRPQSALSPAPGGAGEGDGGCGGAGRLAEWPGTVRELGLRARRGTVGPGLGSHLHACPRRCDGQLRGVQYSTESLMEEMARADRVSACAGPGGVGWSGTTLPVPPAVPPPPPPGNRAGAAGAEVAGCGPLSPQETRLFGGPRALAIRRCVLGALQVLLTLPLLFLGLSLLWTVLLDPGAVSAWLWSLTSETTLRRLRYTLSPLLELRANGLLPT

SEQ ID NO: 837845 - protein, 415 aa, Homo sapiens
PIVTPASRRLGPRGGRHLGSVSTAMAATQELLLQLQKDNRDGRQRKQELEKLMRGLEAESESLNQRLQDLSERERSLLRRRSQAAQPLQGEAREAARERAERVRRRLEEAERHKEDLVRKSPGMGLDPGWGGAGRAEGGRGGVSRTGGEVGTAPGPRPQEQHSRQLQEQWEELSSQLFYYGGELQSQKSTEQQLAAQLVTLQNELELAETKCALQEEKLQQDALQTAEAWAIFQEQTVVLQVRPHSDAKVPPASPPPDLGRCDGQLRGVQYSTESLMEEMARADRVSACAGPGGVGWSGTTLPVPPAVPPPPPPGNRAGAAGAEVAGCGPLSPQETRLFGGPRALAIRRCVLGALQVLLTLPLLFLGLSLLWTVLLDPGAVSAWLWSLTSETTLRRLRYTLSPLLELRANGLLPT

SEQ ID NO: 837846 - protein, 208 aa, Homo sapiens
PIVTPASRRLGPRGGRHLGSVSTAMAATQELLLQLQKDNRDGRQRKQELEKLMRGLEAESESLNQRLQDLSERERSLLRRRSQAAQPLQGEAREAARERAERVRRRLEEAERHKEDLVRKSPGMGLDPGWGGAGRAEGGPGWGEVGPAERSAPPQDPVRRSSTAGSCRSSGRSCRVRYVQEMGGPVSWFLSEVLPLSSPLLPPRPCLP

SEQ ID NO: 837847 - protein, 388 aa, Homo sapiens
PIVTPASRRLGPRGGRHLGSVSTAMAATQELLLQLQKDNRDGRQRKQELEKLMRGLEAESESLNQRLQDLSERERSLLRRRSQAAQPLQGEAREAARERAERVRRRLEEAERHKEDLEQHSRQLQEQWEELSSQKPGKPRPYKPRPKLFYYGGELQSQKSTEQQLAAQLVTLQNELELAETKCALQEEKLQQDALQTAEAWAIFQEQTVVLQEVQVKVMEAAEELDAWQSGRELCDGQLRGVQYSTESLMEEMARADRVSACAGPGGVGWSGTTLPVPPAVPPPPPPGNRAGAAGAEVAGCGPLSPQETRLFGGPRALAIRRCVLGALQVLLTLPLLFLGLSLLWTVLLDPGAVSAWLWSLTSETTLRRLRYTLSPLLELRANGLLPT

SEQ ID NO: 837848 - protein, 208 aa, Homo sapiens; identical to SEQ ID NO: 837846

SEQ ID NO: 837849 - protein, 168 aa, Homo sapiens
VLLKNELELAETKCALQEEKLQQDALQTAEAWAIFQEQTVVLQVRPHSDAKVPPASPPPDLGRCDGQLRGVQYSTESLMEEMARADRETRLFGGPRALAIRRCVLGALQVLLTLPLLFLGLSLLWTVLLDPGAVSAWLWSLTSETTLRRLRYTLSPLLELRANGLLPT

SEQ ID NO: 837850 - protein, 366 aa, Homo sapiens
PIVTPASRRLGPRGGRHLGSVSTAMAATQELLLQLQKDNRDGRQRKQELEKLMRGLEAESESLNQRLQDLSERERSLLRRRSQAAQPLQGEAREAARERAERVRRRLEEAERHKEDLVRKSPGMGLDPGWGGAGRAEGGRGGVSRTGGEVGTAPGPRPQEQHSRQLQEQWEELSSQLFYYGGELQSQKSTEQQLAAQLVTLQNELELAETKCALQEEKLQQDALQTAEAWAIFQEQTVVLQVRPHSDAKVPPASPPPDLGRCDGQLRGVQYSTESLMEEMARADRETRLFGGPRALAIRRCVLGALQVLLTLPLLFLGLSLLWTVLLDPGAVSAWLWSLTSETTLRRLRYTLSPLLELRANGLLPT

SEQ ID NO: 837851 - protein, 346 aa, Homo sapiens
PIVTPASRRLGPRGGRHLGSVSTAMAATQELLLQLQKDNRDGRQRKQELEKLMRGLEAESESLNQRLQDLSERERSLLRRRSQAAQPLQGEAREAARERAERVRRRLEEAERHKEDLVRKSPGMGLDPGWGGAGRAEGGRGGVSRTGGEVGTAPGPRPQEQHSRQLQEQWEELSSQLFYYGGELQSQKSTEQQLAAQLVTLQNELELAETKCALQEEKLQQDALQTAEAWAIFQEQTVVLQVRPHSDAKVPPASPPPDLGRCDGQLRGVQYSTESLMEEMARADRAVRAGRAAGAADAAAPLPGAVAALDGAVGPRRRLRVALEPHLGDDAAPPALHAVPAAGAAR

SEQ ID NO: 837852 - protein, 368 aa, Homo sapiens
PIVTPASRRLGPRGGRHLGSVSTAMAATQELLLQLQKDNRDGRQRKQELEKLMRGLEAESESLNQRLQDLSERERSLLRRRSQAAQPLQGEAREAARERAERVRRRLEEAERHKEDLVRKSPGMGLDPGWGGAGRAEGGRGGVSRTGGEVGTAPGPRPQEQHSRQLQEQWEELSSQLFYYGGELQSQKSTEQQLAAQLVTLQNELELAETKCALQEEKLQQDALQTAEAWAIFQEQTVVLQEVQVKVMEAAEELDAWQSGRELCDGQLRGVQYSTESLMEEMARADRETRLFGGPRALAIRRCVLGALQVLLTLPLLFLGLSLLWTVLLDPGAVSAWLWSLTSETTLRRLRYTLSPLLELRANGLLPT

SEQ ID NO: 837853 - protein, 476 aa, Homo sapiens
PIVTPASRRLGPRGGRHLGSVSTAMAATQELLLQLQKDNRDGRQRKQELEKLMRGLEAESESLNQRLQDLSERERSLLRRRSQAAQPLQGEAREAARERAERVRRRLEEAERHKEDLVRKSPGMGLDPGWGGAGRAEGGPGWGEVGPAERSAPPQDPVRRSSTAGSCRSSGRSCRVRYVQEMGGPVSWFLSEVLPLSSPLLPPVPVSPDTRSSRSPVNPALTSPAPELFYYGGELQSQKSTEQQLAAQLVTLQNELELAETKCALQEEKLQQDALQTAEAWAIFQEQTVVLQVRPHSDAKEVQVKVMEAAEELDAWQSGRELCDGQLRGVQYSTESLMEEMARADRVSACAGPGGVGWSGTTLPVPPAVPPPPPPGNRAGAAGAEVAGCGPLSPQETRLFGGPRALAIRRCVLGALQVLLTLPLLFLGLSLLWTVLLDPGAVSAWLWSLTSETTLRRLRYTLSPLLELRANGLLPT

SEQ ID NO: 837854 - protein, 208 aa, Homo sapiens; identical to SEQ ID NO: 837846

SEQ ID NO: 837855 - protein, 107 aa, Homo sapiens
LFLHLLPCHLGHSPRLYIPLQGRHLHHQQHNFPNKCSLHFLLHLLLTSPSSSPLSELGELHYLRGELHDACVSGLSFFFSSPAAQCGCLSPARQISPVERLHAARNE

SEQ ID NO: 837856 - protein, 352 aa, Homo sapiens
LTGAPVGLGNPSSLGVGQQSAPNLSTVSQIDPSSIERAYAALGLPYQVNQMPTQPQVQAKNQQNQQPGQSPQGMRPMSNMSASPMGVNGGVGVQTPSLLSDSMLHSAINSQNPMMSENASVPSLGPMPTAAQPSTTGIRKQWHEDITQDLRNHLVHKLVQAIFPTPDPAALKDRRMENLVAYARKVEGDMYESANNRAEYYHLLAEKIYKIQKELEEKRRTRLQKQNMLPNAAGMVPVSMNPGPNMGQPQPGMTSNGPLPDPSMIRGSVPNQMMPRITPQSGLNQFGQMSMAQPPIVPRQTPPLQHHGQLAQPGALNPVSLTSLVISLAFTWYFENPVCSYFINSHSHLNRP

SEQ ID NO: 837857 - protein, 391 aa, Homo sapiens
LTGAPVGLGNPSSLGVGQQSAPNLSTVSQIDPSSIERAYAALGLPYQVNQMPTQPQVQAKNQQNQQPGQSPQGMRPMSNMSASPMGVNGGVGVQTPSLLSDSMLHSAINSQNPMMSENASVPSLGPMPTAAQPSTTGIRKQWHEDITQDLRNHLVHKLVQAIFPTPDPAALKDRRMENLVAYARKVEGDMYESANNRAEYYHLLAEKIYKIQKELEEKRRTRLQKQNMLPNAAGMVPVSMNPGPNMGQPQPGMTSSLNQFGQMSMAQPPIVPRQTPPLQHHGQLAQPGALNPPMGYGPRMQQPSNQGQFLPQTQFPSQGMNVTNIPLAPSSGQAPVSQAQMSSSSCPVNSPIMPPGSQGSHIHCPQLPQPALHQNSPSPVPSRTPTPHHTP

SEQ ID NO: 837858 - protein, 101 aa, Homo sapiens
MSSSSCPVNSPIMPPGSQGSHIHCPQLPQPALHQNSPSPVPSRTPTPHHTPPSIGAQQPPATTIPAPVPTPPAMPPGPQSQALHPPPRQTPTPPTTQLPQQ

SEQ ID NO: 837859 - protein, 417 aa, Homo sapiens
LTGAPVGLGNPSSLGVGQQSAPNLSTVSQIDPSSIERAYAALGLPYQVNQMPTQPQVQAKNQQNQQPGQSPQGMRPMSNMSASPMGVNGGVGVQTPSLLSDSMLHSAINSQNPMMSENASVPSLGPMPTAAQPSTTGIRKQWHEDITQDLRNHLVHKLVQAIFPTPDPAALKDRRMENLVAYARKVEGDMYESANNRAEYYHLLAEKIYKIQKELEEKRRTRLQKQNMLPNAAGMVPVSMNPGPNMGQPQPGMTSNGPLPDPSMIRGSVPNQMMPRITPQSGLNQFGQMSMAQPPIVPRQTPPLQHHGQLAQPGALNPPMGYGPRMQQPSNQGQFLPQTQFPSQGMNVTNIPLAPSSGQAPVSQAQMSSSSCPVNSPIMPPGSQGSHIHCPQLPQPALHQNSPSPVPSRTPTPHHTP

SEQ ID NO: 837860 - protein, 226 aa, Homo sapiens
MREMGQVERSTRRGGKIYKIQKELEEKRRTRLQKQNMLPNAAGMVPVSMNPGPNMGQPQPGMTSNGPLPDPSMIRGSVPNQMMPRITPQSGLNQFGQMSMAQPPIVPRQTPPLQHHGQLAQPGALNPPMGYGPRMQQPSNQGQFLPQTQFPSQGMNVTNIPLAPSSGQAPVSQAQMSSSSCPVNSPIMPPGSQGSHIHCPQLPQPALHQNSPSPVPSRTPTPHHTP

SEQ ID NO: 837861 - protein, 819 aa, Homo sapiens
LPFSFSSRTPRSKPRIETKLGSMEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKAIETQSSSSEEIVPSPPSPPPLPRIYKPCFVCQDKSSGYHYGVSACEGCKGFFRRSIQKNMVYTCHRDKNCIINKVTRNRCQYCRLQKCFEVGMSKESVRNDRNKKKKEVPKPECSESYTLTPEVGELIEKVRKAHQETFPALCQLGKYTTNNSSEQRVSLDIDLWDKFSELSTKCIIKTVEFAKQLPGFTTLTIADQITLLKAACLDILILRICTRYTPEQDTMTFSDGLTLNRTQMHNAGFGPLTDLVFAFANQLLPLEMDDAETGLLSAICLICGDRQDLEQPDRVDMLQEPLLEALKVYVRKRRPSRPHMFPKMLMKITDLRSISAKGAERVITLKMEIPGSMPPLIQEMLENSEGLDTLSGQPGGGGRDGGGLAPPPGSCSPSLSPSSNRSSPATHSP

SEQ ID NO: 837862 - protein, 182 aa, Homo sapiens
SPAAPGLAGAEPRGIPTPTRNPRHGESLEKPRIPGWEEEVLVDPQPRADPAPGLRTWGAAVLCLGRHETLDGSPLEVKPLSSRAPPGFPGRADGPPLPAHTTSLLFTGTGGAAGGLRRGDFRAGGAPCPGHQSGRGDVSSPPAALLGWRRRLSDGGGAQDFPARTSCVPASQSAVVGGGSGR

SEQ ID NO: 837863 - protein, 462 aa, Homo sapiens
MASNSSSCPTPGGGHLNGYPVPPYAFFFPPMLGGLSPPGALTTLQHQLPVSGYSTPSPATIETQSSSSEEIVPSPPSPPPLPRIYKPCFVCQDKSSGYHYGVSACEGCKGFFRRSIQKNMVYTCHRDKNCIINKVTRNRCQYCRLQKCFEVGMSKESVRNDRNKKKKEVPKPECSESYTLTPEVGELIEKVRKAHQETFPALCQLGKYTTNNSSEQRVSLDIDLWDKFSELSTKCIIKTVEFAKQLPGFTTLTIADQITLLKAACLDILILRICTRYTPEQDTMTFSDGLTLNRTQMHNAGFGPLTDLVFAFANQLLPLEMDDAETGLLSAICLICGDRQDLEQPDRVDMLQEPLLEALKVYVRKRRPSRPHMFPKMLMKITDLRSISAKGAERVITLKMEIPGSMPPLIQEMLENSEGLDTLSGQPGGGGRDGGGLAPPPGSCSPSLSPSSNRSSPATHSP

SEQ ID NO: 837864 - protein, 462 aa, Homo sapiens; identical to SEQ ID NO: 837863

SEQ ID NO: 837865 - protein, 537 aa, Homo sapiens
IPSWSPHPSWGPGGLGDVSRAGPLVKQFCELALFLGRSRAGLQGTKKDATPRWAPARWLRGPCPVMLAAGEATLRGASEHSSCPTPGGGHLNGYPVPPYAFFFPPMLGGLSPPGALTTLQHQLPVSGYSTPSPATIETQSSSSEEIVPSPPSPPPLPRIYKPCFVCQDKSSGYHYGVSACEGCKGFFRRSIQKNMVYTCHRDKNCIINKVTRNRCQYCRLQKCFEVGMSKESVRNDRNKKKKEVPKPECSESYTLTPEVGELIEKVRKAHQETFPALCQLGKYTTNNSSEQRVSLDIDLWDKFSELSTKCIIKTVEFAKQLPGFTTLTIADQITLLKAACLDILILRICTRYTPEQDTMTFSDGLTLNRTQMHNAGFGPLTDLVFAFANQLLPLEMDDAETGLLSAICLICGDRQDLEQPDRVDMLQEPLLEALKVYVRKRRPSRPHMFPKMLMKITDLRSISAKGAERVITLKMEIPGSMPPLIQEMLENSEGLDTLSGQPGGGGRDGGGLAPPPGSCSPSLSPSSNRSSPATHSP

SEQ ID NO: 837866 - protein, 547 aa, Homo sapiens
VLRGCSLEQRSFISVRLLSYLSACRHPMEDSMDMDMSPLRPQNYLFGCELKADKDYHFKVDNDENEHQLSLRTVSLGAGAKDELHIVEAEAMNYEGSPIKVTLATLKMSVQPTVSLGGFEITPPVVLRLKCGSGPVHISGQHLVAIETQSSSSEEIVPSPPSPPPLPRIYKPCFVCQDKSSGYHYGVSACEGCKGFFRRSIQKNMVYTCHRDKNCIINKVTRNRCQYCRLQKCFEVGMSKESVRNDRNKKKKEVPKPECSESYTLTPEVGELIEKVRKAHQETFPALCQLGKYTTNNSSEQRVSLDIDLWDKFSELSTKCIIKTVEFAKQLPGFTTLTIADQITLLKAACLDILILRICTRYTPEQDTMTFSDGLTLNRTQMHNAGFGPLTDLVFAFANQLLPLEMDDAETGLLSAICLICGDRQDLEQPDRVDMLQEPLLEALKVYVRKRRPSRPHMFPKMLMKITDLRSISAKGAERVITLKMEIPGSMPPLIQEMLENSEGLDTLSGQPGGGGRDGGGLAPPPGSCSPSLSPSSNRSSPATHSP

SEQ ID NO: 837867 - protein, 416 aa, Homo sapiens
PNSNHVASGAGEAAIETQSSSSEEIVPSPPSPPPLPRIYKPCFVCQDKSSGYHYGVSACEGCKGFFRRSIQKNMVYTCHRDKNCIINKVTRNRCQYCRLQKCFEVGMSKESVRNDRNKKKKEVPKPECSESYTLTPEVGELIEKVRKAHQETFPALCQLGKYTTNNSSEQRVSLDIDLWDKFSELSTKCIIKTVEFAKQLPGFTTLTIADQITLLKAACLDILILRICTRYTPEQDTMTFSDGLTLNRTQMHNAGFGPLTDLVFAFANQLLPLEMDDAETGLLSAICLICGDRQDLEQPDRVDMLQEPLLEALKVYVRKRRPSRPHMFPKMLMKITDLRSISAKGAERVITLKMEIPGSMPPLIQEMLENSEGLDTLSGQPGGGGRDGGGLAPPPGSCSPSLSPSSNRSSPATHSP

SEQ ID NO: 837868 - protein, 466 aa, Homo sapiens
FYSTRSAPASQASLRATSSTQSLARLGSPDYGNSALLSLPGYRPTTRSSARRSQAGVSSGAPPAIETQSSSSEEIVPSPPSPPPLPRIYKPCFVCQDKSSGYHYGVSACEGCKGFFRRSIQKNMVYTCHRDKNCIINKVTRNRCQYCRLQKCFEVGMSKESVRNDRNKKKKEVPKPECSESYTLTPEVGELIEKVRKAHQETFPALCQLGKYTTNNSSEQRVSLDIDLWDKFSELSTKCIIKTVEFAKQLPGFTTLTIADQITLLKAACLDILILRICTRYTPEQDTMTFSDGLTLNRTQMHNAGFGPLTDLVFAFANQLLPLEMDDAETGLLSAICLICGDRQDLEQPDRVDMLQEPLLEALKVYVRKRRPSRPHMFPKMLMKITDLRSISAKGAERVITLKMEIPGSMPPLIQEMLENSEGLDTLSGQPGGGGRDGGGLAPPPGSCSPSLSPSSNRSSPATHSP

SEQ ID NO: 837869 - protein, 414 aa, Homo sapiens
MSRAAVGGSLGAIETQSSSSEEIVPSPPSPPPLPRIYKPCFVCQDKSSGYHYGVSACEGCKGFFRRSIQKNMVYTCHRDKNCIINKVTRNRCQYCRLQKCFEVGMSKESVRNDRNKKKKEVPKPECSESYTLTPEVGELIEKVRKAHQETFPALCQLGKYTTNNSSEQRVSLDIDLWDKFSELSTKCIIKTVEFAKQLPGFTTLTIADQITLLKAACLDILILRICTRYTPEQDTMTFSDGLTLNRTQMHNAGFGPLTDLVFAFANQLLPLEMDDAETGLLSAICLICGDRQDLEQPDRVDMLQEPLLEALKVYVRKRRPSRPHMFPKMLMKITDLRSISAKGAERVITLKMEIPGSMPPLIQEMLENSEGLDTLSGQPGGGGRDGGGLAPPPGSCSPSLSPSSNRSSPATHSP

SEQ ID NO: 837870 - protein, 356 aa, Homo sapiens
MPCLPVNACCVRVLTSLGDLLSSWQLSVRLGVDEALSSLQLPSEPPLPSTAVRNDRNKKKKEVPKPECSESYTLTPEVGELIEKVRKAHQETFPALCQLGKYTTNNSSEQRVSLDIDLWDKFSELSTKCIIKTVEFAKQLPGFTTLTIADQITLLKAACLDILILRICTRYTPEQDTMTFSDGLTLNRTQMHNAGFGPLTDLVFAFANQLLPLEMDDAETGLLSAICLICGDRQDLEQPDRVDMLQEPLLEALKVYVRKRRPSRPHMFPKMLMKITDLRSISAKGAERVITLKMEIPGSMPPLIQEMLENSEGLDTLSGQPGGGGRDGGGLAPPPGSCSPSLSPSSNRSSPATHSP

SEQ ID NO: 837871 - protein, 414 aa, Homo sapiens; identical to SEQ ID NO: 837869

SEQ ID NO: 837872 - protein, 303 aa, Homo sapiens
MSRAAVGGSLGAIETQSSSSEEIVPSPPSPPPLPRIYKPCFVCQDKSSGYHYGVSACEGCKGFFRRSIQKNMVYTCHRDKNCIINKVTRNRCQYCRLQKCFEVGMSKESVRNDRNKKKKEVPKPECSESYTLTPEVGELIEKVRKAHQETFPALCQLGKYTTNNSSEQRVSLDIDLWDKFSELSTKCIIKTVEFAKQLPGFTTLTIADQITLLKAACLDILILRICTRYTPEQDTMTFSDGLTLNRTQMQSGRASRRSASQQCARECAEGGRHATGTQAGREGDGNGRKTGGARQAKGKRNQG

SEQ ID NO: 837873 - protein, 462 aa, Homo sapiens; identical to SEQ ID NO: 837863

SEQ ID NO: 837874 - protein, 462 aa, Homo sapiens; identical to SEQ ID NO: 837863

SEQ ID NO: 837875 - protein, 414 aa, Homo sapiens; identical to SEQ ID NO: 837869

SEQ ID NO: 837876 - protein, 590 aa, Homo sapiens
VLRGCSLEQRSFISVRLLSYLSACRHPMEDSMDMDMSPLRPQNYLFGCELKADKDYHFKVDNDENEHQLSLRTVSLGAGAKDELHIVEAEAMNYEGSPIKVTLATLKMSVQPTVSLGGFEITPPVVLRLKCGSGPVHISGQHLVAVEEDAESEDEEEEDVNRVLFMKPKGRGLKHMFGDLVCSWKLAAIETQSSSSEEIVPSPPSPPPLPRIYKPCFVCQDKSSGYHYGVSACEGCKGFFRRSIQKNMVYTCHRDKNCIINKVTRNRCQYCRLQKCFEVGMSKESVRNDRNKKKKEVPKPECSESYTLTPEVGELIEKVRKAHQETFPALCQLGKYTTNNSSEQRVSLDIDLWDKFSELSTKCIIKTVEFAKQLPGFTTLTIADQITLLKAACLDILILRICTRYTPEQDTMTFSDGLTLNRTQMHNAGFGPLTDLVFAFANQLLPLEMDDAETGLLSAICLICGDRQDLEQPDRVDMLQEPLLEALKVYVRKRRPSRPHMFPKMLMKITDLRSISAKGAERVITLKMEIPGSMPPLIQEMLENSEGLDTLSGQPGGGGRDGGGLAPPPGSCSPSLSPSSNRSSPATHSP

SEQ ID NO: 837877 - protein, 457 aa, Homo sapiens
MYESVEVGGPTPNPFLVVDFYNQNRACLLPEKGLPAPGPYSTPLRTPLWNGSNHSIETQSSSSEEIVPSPPSPPPLPRIYKPCFVCQDKSSGYHYGVSACEGCKGFFRRSIQKNMVYTCHRDKNCIINKVTRNRCQYCRLQKCFEVGMSKESVRNDRNKKKKEVPKPECSESYTLTPEVGELIEKVRKAHQETFPALCQLGKYTTNNSSEQRVSLDIDLWDKFSELSTKCIIKTVEFAKQLPGFTTLTIADQITLLKAACLDILILRICTRYTPEQDTMTFSDGLTLNRTQMHNAGFGPLTDLVFAFANQLLPLEMDDAETGLLSAICLICGDRQDLEQPDRVDMLQEPLLEALKVYVRKRRPSRPHMFPKMLMKITDLRSISAKGAERVITLKMEIPGSMPPLIQEMLENSEGLDTLSGQPGGGGRDGGGLAPPPGSCSPSLSPSSNRSSPATHSP

SEQ ID NO: 837878 - protein, 428 aa, Homo sapiens
WARGLLPLPRYTQSYPRLSPGGEKDAIETQSSSSEEIVPSPPSPPPLPRIYKPCFVCQDKSSGYHYGVSACEGCKGFFRRSIQKNMVYTCHRDKNCIINKVTRNRCQYCRLQKCFEVGMSKESVRNDRNKKKKEVPKPECSESYTLTPEVGELIEKVRKAHQETFPALCQLGKYTTNNSSEQRVSLDIDLWDKFSELSTKCIIKTVEFAKQLPGFTTLTIADQITLLKAACLDILILRICTRYTPEQDTMTFSDGLTLNRTQMHNAGFGPLTDLVFAFANQLLPLEMDDAETGLLSAICLICGDRQDLEQPDRVDMLQEPLLEALKVYVRKRRPSRPHMFPKMLMKITDLRSISAKGAERVITLKMEIPGSMPPLIQEMLENSEGLDTLSGQPGGGGRDGGGLAPPPGSCSPSLSPSSNRSSPATHSP

SEQ ID NO: 837879 - protein, 379 aa, Homo sapiens
SGGGVGAENMAGGKAGKDSGKAKAKAVSRSQRAGLQFPVGRIQQTLEDSHHKPWKGGCHCCRVQCFEVGMSKESVRNDRNKKKKEVPKPECSESYTLTPEVGELIEKVRKAHQETFPALCQLGKYTTNNSSEQRVSLDIDLWDKFSELSTKCIIKTVEFAKQLPGFTTLTIADQITLLKAACLDILILRICTRYTPEQDTMTFSDGLTLNRTQMHNAGFGPLTDLVFAFANQLLPLEMDDAETGLLSAICLICGDRQDLEQPDRVDMLQEPLLEALKVYVRKRRPSRPHMFPKMLMKITDLRSISAKGAERVITLKMEIPGSMPPLIQEMLENSEGLDTLSGQPGGGGRDGGGLAPPPGSCSPSLSPSSNRSSPATHSP

SEQ ID NO: 837880 - protein, 149 aa, Homo sapiens
TSQVLLTSCPEMVMRDGLLSASHLDRQDLEQPDRVDMLQEPLLEALKVYVRKRRPSRPHMFPKMLMKITDLRSISAKGAERVITLKMEIPGSMPPLIQEMLENSEGLDTLSGQPGGGGRDGGGLAPPPGSCSPSLSPSSNRSSPATHSP

SEQ ID NO: 837881 - protein, 266 aa, Homo sapiens
MSRAAVGGSLGAIETQSSSSEEIVPSPPSPPPLPRIYKPCFVCQDKSSGYHYGVSACEGCKGFFRRSIQKNMVYTCHRDKNCIINKVTRNRCQYCRLQKCFEVGMSKESVRNDRNKKKKEVPKPECSESYTLTPEVGELIEKVRKAHQETFPALCQLGKYTTNNSSEQRVSLDIDLWDKFSELSTKCIIKTVEFAKQLPGFTTLTIPNLSHPRAPSLPRRTGLQGGLPSPLHPQLGELALPRPPSPGVGAPSPGARGCTCYCWAFH

SEQ ID NO: 837882 - protein, 727 aa, Homo sapiens
SRLERIWSSARKALLLPGRPSRWLIQVAFAALLRPNQSAGHLAAQLTPRPRSQAPGFLKCFLGALKMEMTEMTGVSLKRGALVVEDNDSGVPVEETKKQKLSECSLTKGQDGLQNDFLSISEDVPRPPDTVSTGKGGKNSEAQLEDEEEEEEDGLSEECEEEESESFADMMKHGLTEADVGITKFVSSHQGFSGILKERYSDFVVHEIGKDGRISHLNDLSIPVDEEDPSEDIFTVLTAEEKQRLEELQLFKNKETSVAIEVIEDTKEKRTIIHQAIKSLFPGLETKTEDREGKKYIVAYHAAGKKALANPRKHSWPKSRGSYCHFVLYKENKDTMDAINVLSKYLRVKPNIFSYMGTKDKRAITVQEIAVLKITAQRLAHLNKCLMNFKLGNFSYQKNPLKLGELQGNHFTVVLRNITGTDDQVQQAMNSLKEIGFINYYGMQRFGTTAVPTYQVGRAILQNSWTEVMDLILKPRSGAEKGYLVKCREEWAKTKDPTAALRKLPVKRCVEGQLLRGLSKYGMKNIVSAFGIIPRNNRLMYIHSYQSYVWNNMVSKRIEDYGLKPVPGDLVLKGATATYIEEDDVNNYSIHDVVMPLPGFDVIYPKHKIQEAYREMLTADNLDIDNMRHKIRDYSLSGAYRKIIIRPQNVSWEVVAYDDPKIPLFNTDVDNLEGKTPPVFASEGKYRALKMDFSLPPSTYATMAIREVLKMDTSIKNQTQLNTTWLR

SEQ ID NO: 837883 - protein, 732 aa, Homo sapiens
SRLERIWSSARKALLLPGRPSRWLIQVAFAALLRPNQSAGHLAAQLTPRPRSQAPGFLKCFLGALKMEMTEMTGVSLKRGALVVEDNDSGVPVEETKKQKLSECSLTKGQDGLQNDFLSISEDVPRPPDTVSTGKGGKNSEAQLEDEEEEEEDGLSEECEEEESESFADMMKHGLTEADVGITKFVSSHQGFSGILKERYSDFVVHEIGKDGRISHLNDLSIPVDEEDPSEDIFTVLTAEEKQRLEELQLFKNKETSVAIEVIEDTKEKRTIIHQAIKSLFPGLETKTEDREGKKYIVAYHAAGKKALAKVSGADPRKHSWPKSRGSYCHFVLYKENKDTMDAINVLSKYLRVKPNIFSYMGTKDKRAITVQEIAVLKITAQRLAHLNKCLMNFKLGNFSYQKNPLKLGELQGNHFTVVLRNITGTDDQVQQAMNSLKEIGFINYYGMQRFGTTAVPTYQVGRAILQNSWTEVMDLILKPRSGAEKGYLVKCREEWAKTKDPTAALRKLPVKRCVEGQLLRGLSKYGMKNIVSAFGIIPRNNRLMYIHSYQSYVWNNMVSKRIEDYGLKPVPGDLVLKGATATYIEEDDVNNYSIHDVVMPLPGFDVIYPKHKIQEAYREMLTADNLDIDNMRHKIRDYSLSGAYRKIIIRPQNVSWEVVAYDDPKIPLFNTDVDNLEGKTPPVFASEGKYRALKMDFSLPPSTYATMAIREVLKMDTSIKNQTQLNTTWLR

SEQ ID NO: 837884 - protein, 392 aa, Homo sapiens
MDAINVLSKYLRVKPNIFSYMGTKDKRAITVQEIAVLKITAQRLAHLNKCLMNFKLGNFSYQKNPLKLGELQGNHFTVVLRNITGTDDQVQQAMNSLKEIGFINYYGMQRFGTTAVPTYQVGRAILQNSWTEVMDLILKPRSGAEKGYLVKCREEWAKTKDPTAALRKLPVKRCVEGQLLRGLSKYGMKNIVSAFGIIPRNNRLMYIHSYQSYVWNNMVSKRIEDYGLKPVPGDLVLKGATATYIEEDDVNNYSIHDVVMPLPGFDVIYPKHKIQEAYREMLTADNLDIDNMRHKIRDYSLSGAYRKIIIRPQNVSWEVVAYDDPKIPLFNTDVDNLEGKTPPVFASEGKYRALKMDFSLPPSTYATMAIREVLKMDTSIKNQTQLNTTWLR

SEQ ID NO: 837885 - protein, 727 aa, Homo sapiens; identical to SEQ ID NO: 837882

SEQ ID NO: 837886 - protein, 727 aa, Homo sapiens; identical to SEQ ID NO: 837882

SEQ ID NO: 837887 - protein, 743 aa, Homo sapiens
SRLERIWSSARKALLLPGRPSRWLIQVAFAALLRPNQSAGHLAAQLTPRPRSQAPGFLKCFLGALKMEMTEMTGVSLKRGALVVEDNDSGVPVEETKKQKLSECSLTKGQDGLQNDFLSISEDVPRPPDTVSTGKGGKNSEAQLEDEEEEEEDGLSEECEEEESESFADMMKHGLTEADVGITKFVSSHQGFSGILKERYSDFVVHEIGKDGRISHLNDLSIPVDEEDPSEDIFTVLTAEEKQRLEELQLFKNKETSVAIEVIEDTKEKRTIIHQAIKSLFPGLETKTEDREGKKYIVAYHAAGKKALANPRKHSWPKSRGSYCHFVLYKENKDTMDAINVLSKYLRVKPNIFSYMGTKDKRAITVQEIAVLKITAQRLAHLKFPSLKFIKQLIQVGKSKCLMNFKLGNFSYQKNPLKLGELQGNHFTVVLRNITGTDDQVQQAMNSLKEIGFINYYGMQRFGTTAVPTYQVGRAILQNSWTEVMDLILKPRSGAEKGYLVKCREEWAKTKDPTAALRKLPVKRCVEGQLLRGLSKYGMKNIVSAFGIIPRNNRLMYIHSYQSYVWNNMVSKRIEDYGLKPVPGDLVLKGATATYIEEDDVNNYSIHDVVMPLPGFDVIYPKHKIQEAYREMLTADNLDIDNMRHKIRDYSLSGAYRKIIIRPQNVSWEVVAYDDPKIPLFNTDVDNLEGKTPPVFASEGKYRALKMDFSLPPSTYATMAIREVLKMDTSIKNQTQLNTTWLR

SEQ ID NO: 837888 - protein, 732 aa, Homo sapiens; identical to SEQ ID NO: 837883

SEQ ID NO: 837889 - protein, 860 aa, Homo sapiens
MEQVAEGARVTAVPVSAADSTEELAEVEEGVGVVGEDNDAAARGAEAFGDSEEDGEDVFEVEKILDMKTEGGKVLYKVRWKGYTSDDDTWEPEIHLEDCKEVLLEFRKKIAENKAKAVRKDIQRLSLNNDIFEANSDSDQQSETKEDTSPKKKKKKLRQREEKSPDDLKKKKAKAGKLKDKSKPDLESSLESLVFDLRTKKRISEAKEELKESKKPKKDEVKETKELKKVKKGEIRDLKTKTREDPKENRKTKKEKFVESQVESESSVLNDSPFPEDDSEGLHSDSREEKQNTKSARERAGQDMGLEHGFEKPLDSAMSAEEDTDVRGRRKKKTPRKAEDTRENRKLENKNAFLEKKTVPKKQRNQDRSKSAAELEKLMPVSAQTPKGRRLSGEERGLWSTDSAEEDKETKRNESKEKYQKRHDSDKEEKGRKEPKGLKTLKEIRNAFDLFKLTPEEKNDVSENNRKREEIPLDFKTIDDHKTKENKQSLKERRNTRDETDTWAYIAAEGDQEVLDSVCQADENSDGRQQILSLGMDLQLEWMKLEDFQKHLDGKDENFAATDAIPSNVLRDAVKNGDYITVKVALNSNEEYNLDQEDSSGMTLVMLAAAGGQDDLLRLLITKGAKVNGRQKNGTTALIHAAEKNFLTTVAILLEAGAFVNVQQSNGETALMKACKRGNSDIVRLVIECGADCNILSKHQNSALHFAKQSNNVLVYDLLKNHLETLSRVAEETIKDYFEARLALLEPVFPIACHRLCEGPDFSTDFNYKPPQNIPEGSGILLFIFHANFLGKEVIARLCGPCSVQAVVLNDKFQLPVFLDSHFVYSFSPVAGPNKLFIRLTEAPSAKVKLLIGAYRVQLQ

SEQ ID NO: 837890 - protein, 293 aa, Homo sapiens
MEQVAEGARVTAVPVSAADSTEELAEVEEGVGVVGEDNDAAARGAEAFGDSEEDGEDVFEVEKILDMKTEGGKVLYKVRWKGYTSDDDTWEPEIHLEDCKEVLLEFRKKIAENKAKAVRKDIQRLSLNNDIFEANSDSDQQSETKEDTSPKKKKKKLRQREEKSPDDLKKKKAKAGKLKDKSKPDLESSLEATDKSKPDLGAPGKGVALESKDQGKNLGSHRRTKGSKSPKDEEEQRIRTSRGIAPRRTGAPARSEKLGPGRRYGPQDGARKTQRAAGSNQTGRNGKRHGGEK

SEQ ID NO: 837891 - protein, 135 aa, Homo sapiens
MEQVAEGARVTAVPVSAADSTEELAEVEEGVGVVGEDNDAAARGAEAFGDSEEDGEDVFEVEKILDMKTEGGKVLYKVRWKGYTSDDDTWEPEIHLEDCKEVLLEFRKKIAENKAKAVRKDIQVLCFVSYLFLHT

SEQ ID NO: 837892 - protein, 216 aa, Homo sapiens
MVLSSHGFEKPLDSAMSAEEDTDVRGRRKKKTPRKAEDTRENRKLENKNAFLEKKTVPKKQRNQDRSKSAAELEKLMPVSAQTPKGRRLSGEERGLWSTDSAEEPSLPWTAKQLLSCFKLAHKYRPETKQEKKQRLLARAEKKAAGKGDVPTKRPPVLRAGVNTVTTLVENKKAQLVVIAHDVDPIELVVLLLACVENGVLTDIMEEQMDVVKETA

SEQ ID NO: 837893 - protein, 860 aa, Homo sapiens; identical to SEQ ID NO: 837889

SEQ ID NO: 837894 - protein, 879 aa, Homo sapiens
MEQVAEGARVTAVPVSAADSTEELAEVEEGVGVVGEDNDAAARGAEAFGDSEEDGEDVFEVEKILDMKTEGGKVLYKVRWKGYTSDDDTWEPEIHLEDCKEVLLEFRKKIAENKAKAVRKDIQRLSLNNDIFEANSDSDQQSETKEDTSPKKKKKKLRQREEKSPDDLKKKKAKAGKLKDKSKPDLESSLESLVFDLRTKKRISEAKEELKESKKPKKDEVKETKELKKVKKGEIRDLKTKTREDPKENRKTKKEKFVESQVESESSVLNDSPFPEDDSEGLHSDSREEKQNTKSARERAGQDMGLEHGFEKPLDSAMSAEEDTDVRGRRKKKTPRKAEDTRENRKLENKNAFLEKKTVPKKQRNQDRSKSAAELEKLMPVSAQTPKGRRLSGEERGLWSTDSAEEDKETKRNESKEKYQKRHDSDKEEKGRKEPKGLKTLKEIRNAFDLFKLTPEEKNDVSENNRKREEIPLDFKTIDDHKTKENKQSLKERRNTRDETDTWAYIAAEGDQEVLDSVCQADENSDGRQQILSLGMDLQLEWMKLEDFQKHLDGKDENFAATDAIPSNVLRDAVKNGDYITVKVALNSNEEYNLDQEDSSGMTLVMLAAAGGQDDLLRLLITKGAKVNGRQKNGTTALIHAAEKNFLTTVAILLEAGAFVNVQQSNGETALMKACKRGNSDIVRLVIECGADCNILSKHQNSALHFAKQSNNVLVYDLLKNHLETLSRVAEETIKDYFEARLALLEPVFPIACHRLCEGPDFSTDFNYKPPQNIPEGSGILLFIFHANFLGKEVIARLCGPCSVQAVVLNDKFQLPVFLTGSRSVVQAGVQWRGLQLTGVLTSQAQAILPPQPPNYLGLKMTVILFTHSALLQVPINSS

SEQ ID NO: 837895 - protein, 434 aa, Homo sapiens
MEQVAEGARVTAVPVSAADSTEELAEVEEGVGVVGEDNDAAARGAEAFGDSEEDGEDVFEVEKILDMKTEGGKVLYKVRWKGYTSDDDTWEPEIHLEDCKEVLLEFRKKIAENKAKAVRKDIQRLSLNNDIFEANSDSDQQSETKEDTSPKKKKKKLRQREEKSPDDLKKKKAKAGKLKDKSKPDLESSLESLVFDLRTKKRISEAKEELKESKKPKKDEVKETKELKKVKKGEIRDLKTKTREDPKENRKTKKEKFVESQVESESSVLNDSPFPEDDSEGLHSDSREEKQNTKSARERAGQDMGLEHGFEKPLDSAMSAEEDTDVRGRRKKKTPRKAEDTRENRKLENKNAFLEKKTVPKKQRNQDRSKSAAELEKLMPVSAQTPKGRRLSGEERGLWSTDSAEEGKGHGRQQKTHVEWSRHFTSKERETVKL

SEQ ID NO: 837896 - protein, 520 aa, Homo sapiens
MEQVAEGARVTAVPVSAADSTEELAEVEEGVGVVGEDNDAAARGAEAFGDSEEDGEDVFEVEKILDMKTEGGKVLYKVRWKGYTSDDDTWEPEIHLEDCKEVLLEFRKKIAENKAKAVRKDIQRLSLNNDIFEANSDSDQQSETKEDTSPKKKKKKLRQREEKSPDDLKKKKAKAGKLKDKSKPDLESSLESLVFDLRTKKRISEAKEELKESKKPKKDEVKETKELKKVKKGEIRDLKTKTREDPKENRKTKKEKFVESQVESESSVLNDSPFPEDDSEGLHSDSREEKQNTKSARERAGQDMGLEHGFEKPLDSAMSAEEDTDVRGRRKKKTPRKAEDTRENRKLENKNAFLEKKTVPKKQRNQDRSKSAAELEKLMPVSAQTPKGRRLSGEERGLWSTDSAEEDKETKRNESKEKYQKRHDSDKEEKGRKEPKGLKTLKEIRNAFDLFKLTPEEKNDVSENNRKREEIPLDFKTIDDHKTKENKQSLKERRNTRDETDTWAYIAAEGDQETPAWVTE

SEQ ID NO: 837897 - protein, 537 aa, Homo sapiens
MEQVAEGARVTAVPVSAADSTEELAEVEEGVGVVGEDNDAAARGAEAFGDSEEDGEDVFEVEKILDMKTEGGKVLYKVRWKGYTSDDDTWEPEIHLEDCKEVLLEFRKKIAENKAKAVRKDIQRLSLNNDIFEANSDSDQQSETKEDTSPKKKKKKLRQREEKSPDDLKKKKAKAGKLKDKSKPDLESSLESLVFDLRTKKRISEAKEELKESKKPKKDEVKETKELKKVKKGEIRDLKTKTREDPKENRKTKKEKFVESQVESESSVLNDSPFPEDDSEGLHSDSREEKQNTKSARERAGQDMGLEHGFEKPLDSAMSAEEDTDVRGRRKKKTPRKAEDTRENRKLENKNAFLEKKTVPKKQRNQDRSKSAAELEKLMPVSAQTPKGRRLSGEERGLWSTDSAEEDKETKRNESKEKYQKRHDSDKEEKGRKEPKGLKTLKEIRNAFDLFKLTPEEKNDVSENNRKREEIPLDFKTIDDHKTKENKQSLKERRNTRDETDTWAYIAAEGDQEVLDSVCQADENSGEFGIILQNFSR

SEQ ID NO: 837898 - protein, 827 aa, Homo sapiens [sequence omitted]

SEQ ID NO: 837899 - protein, 623 aa, Homo sapiens
MEQVAEGARVTAVPVSAADSTEELAEVEEGVGVVGEDNDAAARGAEAFGDSEEDGEDVFEVEKILDMKTEGGKVLYKVRWKGYTSDDDTWEPEIHLEDCKEVLLEFRKKIAENKAKAVRKDIQRLSLNNDIFEANSDSDQQSETKEDTSPKKKKKKLRQREEKSPDDLKKKKAKAGKLKDKSKPDLESSLESLVFDLRTKKRISEAKEELKESKKPKKDEVKETKELKKVKKGEIRDLKTKTREDPKENRKTKKEKFVESQVESESSVLNDSPFPEDDSEGLHSDSREEKQNTKSARERAGQDMGLEHGFEKPLDSAMSAEEDTDVRGRRKKKTPRKAEDTRENRKLENKNAFLEKKTVPKKQRNQDRSKSAAELEKLMPVSAQTPKGRRLSGEERGLWSTDSAEEDKETKRNESKEKYQKRHDSDKEEKGRKEPKGLKTLKEIRNAFDLFKLTPEEKNDVSENNRKREEIPLDFKTIDDHKTKENKQSLKERRNTRDETDTWAYIAAEGDQEVLDSVCQADENSDGRQQILSLGMDLQLEWMKLEDFQKHLDGKDENFAATDAIPSNVLRDAVKNGDYITVKVALNSNEEYNLDQEDLIHKTKRRYKNESWAWWHAPVIPST

SEQ ID NO: 837900 - protein, 596 aa, Homo sapiens
MEQVAEGARVTAVPVSAADSTEELAEVEEGVGVVGEDNDAAARGAEAFGDSEEDGEDVFEVEKILDMKTEGGKVLYKVRWKGYTSDDDTWEPEIHLEDCKEVLLEFRKKIAENKAKAVRKDIQRLSLNNDIFEANSDSDQQSETKEDTSPKKKKKKLRQREEKSPDDLKKKKAKAGKLKDKSKPDLESSLESLVFDLRTKKRISEAKEELKESKKPKKDEVKETKELKKVKKGEIRDLKTKTREDPKENRKTKKEKFVESQVESESSVLNDSPFPEDDSEGLHSDSREEKQNTKSARERAGQDMGLEHGFEKPLDSAMSAEEDTDVRGRRKKKTPRKAEDTRENRKLENKNAFLEKKTVPKKQRNQDRSKSAAELEKLMPVSAQTPKGRRLSGEERGLWSTDSAEEDKETKRNESKEKYQKRHDSDKEEKGRKEPKGLKTLKEIRNAFDLFKLTPEEKNDVSENNRKREEIPLDFKTIDDHKTKENKQSLKERRNTRDETDTWAYIAAEGDQEVLDSVCQADENSGKVLYKVRWKGYTSDDDTWEPEIHLEDCKEVLLEFKEENAENKAKAVRKDIQRLSLNNDIFEANSDSDQAK

SEQ ID NO: 837901 - protein, 658 aa, Homo sapiens
ANSFALIGCTGVVCRSAVLRSGRRITAGVVGDWRDLKTKTREDPKENRKTKKEKFVESQVESESSVLNDSPFPEDDSEGLHSDSREEKQNTKSARERAGQDMGLEHGFEKPLDSAMSAEEDTDVRGRRKKKTPRKAEDTRENRKLENKNAFLEKKTVPKKQRNQDRSKSAAELEKLMPVSAQTPKGRRLSGEERGLWSTDSAEEDKETKRNESKEKYQKRHDSDKEEKGRKEPKGLKTLKEIRNAFDLFKLTPEEKNDVSENNRKREEIPLDFKTIDDHKTKENKQSLKERRNTRDETDTWAYIAAEGDQEVLDSVCQADENSDGRQQILSLGMDLQLEWMKLEDFQKHLDGKDENFAATDAIPSNVLRDAVKNGDYITVKVALNSNEEYNLDQEDSSGMTLVMLAAAGGQDDLLRLLITKGAKVNGRQKNGTTALIHAAEKNFLTTVAILLEAGAFVNVQQSNGETALMKACKRGNSDIVRLVIECGADCNILSKHQNSALHFAKQSNNVLVYDLLKNHLETLSRVAEETIKDYFEARLALLEPVFPIACHRLCEGPDFSTDFNYKPPQNIPEGSGILLFIFHANFLGKEVIARLCGPCSVQAVVLNDKFQLPVFLDSHFVYSFSPVAGPNKLFIRLTEAPSAKVKLLIGAYRVQLQ

SEQ ID NO: 837902 - protein, 479 aa, Homo sapiens
MEQVAEGARVTAVPVSAADSTEELAEVEEGVGVVGEDNDAAARGAEAFGDSEEDGEDVFEVEKILDMKTEGGKVLYKVRWKGYTSDDDTWEPEIHLEDCKEVLLEFRKKIAENKAKAVRKDIQRLSLNNDIFEANSDSDQQSETKEDTSPKKKKKKLRQREEKSPDDLKKKKAKAGKLKDKSKPDLESSLESLVFDLRTKKRISEAKEELKESKKPKKDEVKETKELKKVKKGEIRDLKTKTREDPKENRKTKKEKFVESQVESESSVLNDSPFPEDDSEGLHSDSREEKQNTKSARERAGQDMGLEHGFEKPLDSAMSAEEDTDVRGRRKKKTPRKAEDTRENRKLENKNAFLEKKTVPKKQRNQDRSKSAAELEKLMPVSAQTPKGRRLSGEERGLWSTDSAEEDKETKRNESKEKYQKRHDSDKEEKGRKEPKGLKTLKRISADPLKIFIFFFQVVIFHCTYFLSEYSNICLQNAI

SEQ ID NO: 837903 - protein, 563 aa, Homo sapiens
LGTPTMVLSSHGFEKPLDSAMSAEEDTDVRGRRKKKTPRKAEDTRENRKLENKNAFLEKKTVPKKQRNQDRSKSAAELEKLMPVSAQTPKGRRLSGEERGLWSTDSAEEDKETKRNESKEKYQKRHDSDKEEKGRKEPKGLKTLKEIRNAFDLFKLTPEEKNDVSENNRKREEIPLDFKTIDDHKTKENKQSLKERRNTRDETDTWAYIAAEGDQEVLDSVCQADENSDGRQQILSLGMDLQLEWMKLEDFQKHLDGKDENFAATDAIPSNVLRDAVKNGDYITVKVALNSNEEYNLDQEDSSGMTLVMLAAAGGQDDLLRLLITKGAKVNGRQKNGTTALIHAAEKNFLTTVAILLEAGAFVNVQQSNGETALMKACKRGNSDIVRLVIECGADCNILSKHQNSALHFAKQSNNVLVYDLLKNHLETLSRVAEETIKDYFEARLALLEPVFPIACHRLCEGPDFSTDFNYKPPQNIPEGSGILLFIFHANFLGKEVIARLCGPCSVQAVVLNDKFQLPVFLDSHFVYSFSPVAGPNKLFIRLTEAPSAKVKLLIGAYRVQLQ

SEQ ID NO: 837904 - protein, 558 aa, Homo sapiens
MVLSSHGFEKPLDSAMSAEEDTDVRGRRKKKTPRKAEDTRENRKLENKNAFLEKKTVPKKQRNQDRSKSAAELEKLMPVSAQTPKGRRLSGEERGLWSTDSAEEDKETKRNESKEKYQKRHDSDKEEKGRKEPKGLKTLKEIRNAFDLFKLTPEEKNDVSENNRKREEIPLDFKTIDDHKTKENKQSLKERRNTRDETDTWAYIAAEGDQEVLDSVCQADENSDGRQQILSLGMDLQLEWMKLEDFQKHLDGKDENFAATDAIPSNVLRDAVKNGDYITVKVALNSNEEYNLDQEDSSGMTLVMLAAAGGQDDLLRLLITKGAKVNGRQKNGTTALIHAAEKNFLTTVAILLEAGAFVNVQQSNGETALMKACKRGNSDIVRLVIECGADCNILSKHQNSALHFAKQSNNVLVYDLLKNHLETLSRVAEETIKDYFEARLALLEPVFPIACHRLCEGPDFSTDFNYKPPQNIPEGSGILLFIFHANFLGKEVIARLCGPCSVQAVVLNDKFQLPVFLDSHFVYSFSPVAGPNKLFIRLTEAPSAKVKLLIGAYRVQLQ

SEQ ID NO: 837905 - protein, 131 aa, Homo sapiens
METCHSEELRDLSEVTWLISDRDKETVCQLCHSSIVHLQVQIRICAWVVSFKAAAGDISRVFVVLRGVFEIPETKLSTVKARLTYLCASLRGWLTGDSVAWTEGSSRGLLSKAWCLFCLGTEASFLKLPIS

SEQ ID NO: 837906 - protein, 190 aa, Homo sapiens
MVLSYHSPRVNDCDLLGTILSDQSHLGGPIFFSHHRHLGWDVISLVLHLRKVSFRVLLVGLSTMVLSSHGFEKPLDSAMSAEEDTDVRGRRKKKTPRKAEDTRENRKLENKNAFLEKKTVPKKQRNQDRSKSAAELEKLMPVSAQTPKGRRLSGEERGLWSTDSAEEPSLQRWSSAFDMCSSLSLITSGF

SEQ ID NO: 837907 - protein, 187 aa, Homo sapiens
MVLSYHSPRVNDCDLLGTILSDQSHLGGPIFFSHHRHLGWDVISLVLHLRKVSFRVLLVGLSTMVLSSHGFEKPLDSAMSAEEDTDVRGRRKKKTPRKAEDTRENRKLENKNAFLEKKTVPKKQRNQDRSKSAAELEKLMPVSAQTPKGRRLSGEERGLWSTDSAEEPSLQRWSSAQTRDTLQMVVL

SEQ ID NO: 837908 - protein, 131 aa, Homo sapiens; identical to SEQ ID NO: 837905

SEQ ID NO: 837909 - protein, 104 aa, Homo sapiens
MVLSSHGFEKPLDSAMSAEEDTDVRGRRKKKTPRKAEDTRENRKLENKNAFLEKKTVPKKQRNQDRSKSAAELEKLMPVSAQTPKGRRLSGEERGLWSTDSAEE

SEQ ID NO: 837910 - protein, 879 aa, Homo sapiens; identical to SEQ ID NO: 837894

SEQ ID NO: 837911 - protein, 860 aa, Homo sapiens; identical to SEQ ID NO: 837889

SEQ ID NO: 837912 - protein, 797 aa, Homo sapiens [sequence omitted]

SEQ ID NO: 837913 - protein, 867 aa, Homo sapiens
MEQVAEGARVTAVPVSAADSTEELAEVEEGVGVVGEDNDAAARGAEAFGDSEEDGEDVFEVEKILDMKTEGGKVLYKVRWKGYTSDDDTWEPEIHLEDCKEVLLEFRKKIAENKAKAVRKDIQRLSLNNDIFEANSDSDQQSETKEDTSPKKKKKKLRQREEKSPDDLKKKKAKAGKLKDKSKPDLESSLESLVFDLRTKKRISEAKEELKESKKPKKDEVKETKELKKVKKGEIRDLKTKTREDPKENRKTKKEKFVESQVESESSVLNDSPFPEDDSEGLHSDSREEKQNTKSARERAGQDMGLEHGFEKPLDSAMSAEEDTDVRGRRKKKTPRKAEDTRENRKLENKNAFLEKKTVPKKQRNQDRSKSAAELEKLMPVSAQTPKGRRLSGEERGLWSTDSAEEDKETKRNESKEKYQKRHDSDKEEKGRKEPKGLKTLKEIRNAFDLFKLTPEEKNDVSENNRKREEIPLDFKTIDDHKTKENKQSLKERRNTRDETDTWAYIAAEGDQEVLDSVCQADENSDGRQQILSLGMDLQLEWMKLEDFQKHLDGKDENFAATDAIPSNVLRDAVKNGDYITVKVALNSNEEYNLDQEDSSGMTLVMLAAAGGQDDLLRLLITKGAKVNGRQKNGTTALIHAAEKNFLTTVAILLEAGAFVNVQQSNGETALMKACKRGNSDIVRLVIECGADCNILSKHQNSALHFAKQSNNVLVYDLLKNHLETLSRVAEETIKDYFEARLALLEPVFPIACHRLCEGPDFSTDFNYKPPQNIPEGSGILLFIFHANFLGKEVIARLCGPCSVQAVVLNDKFQLPVFLTGSRSVVQAGVQWRGLQLTGVLTSQAQAILPPQPPNYLGLKMHATTSG

SEQ ID NO: 837914 - protein, 434 aa, Homo sapiens; identical to SEQ ID NO: 837895

SEQ ID NO: 837915 - protein, 708 aa, Homo sapiens
EKKTVPKKQRNQDRSKSAAELEKLMPVSAQTPKGRRLSGEERGLWSTDSPEEDKETKRNESKKPKKDEVKETKELKKVKKGEIRDLKTKTREDPKENRKTKKEKFVESQVESESSVLNDSPFPEDDSEGLHSDSREEKQNTKSARERAGQDMGLEHGFEKPLDSAMSAEEDTDVRGRRKKKTPRKAEDTRENRKLENKNAFLEKKTVPKKQRNQDRSKSAAELEKLMPVSAQTPKGRRLSGEERGLWSTDSAEEDKETKRNESKEKYQKRHDSDKEEKGRKEPKGLKTLKEIRNAFDLFKLTPEEKNDVSENNRKREEIPLDFKTIDDHKTKENKQSLKERRNTRDETDTWAYIAAEGDQEVLDSVCQADENSDGRQQILSLGMDLQLEWMKLEDFQKHLDGKDENFAATDAIPSNVLRDAVKNGDYITVKVALNSNEEYNLDQEDSSGMTLVMLAAAGGQDDLLRLLITKGAKVNGRQKNGTTALIHAAEKNFLTTVAILLEAGAFVNVQQSNGETALMKACKRGNSDIVRLVIECGADCNILSKHQNSALHFAKQSNNVLVYDLLKNHLETLSRVAEETIKDYFEARLALLEPVFPIACHRLCEGPDFSTDFNYKPPQNIPEGSGILLFIFHANFLGKEVIARLCGPCSVQAVVLNDKFQLPVFLDSHFVYSFSPVAGPNKLFIRLTEAPSAKVKLLIGAYRVQLQ

SEQ ID NO: 837916 - protein, 590 aa, Homo sapiens
GDAAGTLPDLMHHSDSREEKQNTKSARERAGQDMGLEHGFEKPLDSAMSAEEDTDVRGRRKKKTPRKAEDTRENRKLENKNAFLEKKTVPKKQRNQDRSKSAAELEKLMPVSAQTPKGRRLSGEERGLWSTDSAEEDKETKRNESKEKYQKRHDSDKEEKGRKEPKGLKTLKEIRNAFDLFKLTPEEKNDVSENNRKREEIPLDFKTIDDHKTKENKQSLKERRNTRDETDTWAYIAAEGDQEVLDSVCQADENSDGRQQILSLGMDLQLEWMKLEDFQKHLDGKDENFAATDAIPSNVLRDAVKNGDYITVKVALNSNEEYNLDQEDSSGMTLVMLAAAGGQDDLLRLLITKGAKVNGRQKNGTTALIHAAEKNFLTTVAILLEAGAFVNVQQSNGETALMKACKRGNSDIVRLVIECGADCNILSKHQNSALHFAKQSNNVLVYDLLKNHLETLSRVAEETIKDYFEARLALLEPVFPIACHRLCEGPDFSTDFNYKPPQNIPEGSGILLFIFHANFLGKEVIARLCGPCSVQAVVLNDKFQLPVFLDSHFVYSFSPVAGPNKLFIRLTEAPSAKVKLLIGAYRVQLQ

SEQ ID NO: 837917 - protein, 429 aa, Homo sapiens
MEQVAEGARVTAVPVSAADSTEELAEVEEGVGVVGEDNDAAARGAEAFGDSEEDGEDVFEVEKILDMKTEGGKVLYKVRWKGYTSDDDTWEPEIHLEDCKEVLLEFRKKIAENKAKAVRKDIQRLSLNNDIFEANSDSDQQSETKEDTSPKKKKKKLRQREEKSPDDLKKKKAKAGKLKDKSKPDLESSLESLVFDLRTKKRISEAKEELKESKKPKKDEVKETKELKKVKKGEIRDLKTKTREDPKENRKTKKEKFVESQVESESSVLNDSPFPEDDSEGLHSDSREEKQNTKSARERAGQDMGLEHGFEKPLDSAMSAEEDTDVRGRRKKKTPRKAEDTRENRKLENKNAFLEKKTVPKKQRNQDRSKSAAELEKLMPVSAQTPKGRRLSGEERGLWSTDSAEEPSLQRWSSAFDMCSSLSLITSGF

SEQ ID NO: 837918 - protein, 687 aa, Homo sapiens
MVLSYHSPRVNDCDLLGTILSDQSHLGGPIFFSHHRHLGWDVISLVLHLRKVSYPGSFGRTLNDGPQLYDGPQLNDGPQLNDGPQLNDAPQLNDGPQLNDGPQLIDGPQLNDGPQLNDGPQLNDGPQLNDGPQSHGFEKPLDSAMSAEEDTDVRGRRKKKTPRKAEDTRENRKLENKNAFLEKKTVPKKQRNQDRSKSAAELEKLMPVSAQTPKGRRLSGEERGLWSTDSAEEDKETKRNESKEKYQKRHDSDKEEKGRKEPKGLKTLKEIRNAFDLFKLTPEEKNDVSENNRKREEIPLDFKTIDDHKTKENKQSLKERRNTRDETDTWAYIAAEGDQEVLDSVCQADENSDGRQQILSLGMDLQLEWMKLEDFQKHLDGKDENFAATDAIPSNVLRDAVKNGDYITVKVALNSNEEYNLDQEDSSGMTLVMLAAAGGQDDLLRLLITKGAKVNGRQKNGTTALIHAAEKNFLTTVAILLEAGAFVNVQQSNGETALMKACKRGNSDIVRLVIECGADCNILSKHQNSALHFAKQSNNVLVYDLLKNHLETLSRVAEETIKDYFEARLALLEPVFPIACHRLCEGPDFSTDFNYKPPQNIPEGSGILLFIFHANFLGKEVIARLCGPCSVQAVVLNDKFQLPVFLDSHFVYSFSPVAGPNKLFIRLTEAPSAKVKLLIGAYRVQLQ

SEQ ID NO: 837919 - protein, 70 aa, Homo sapiens
IWCLSSFGRPLRGFFPWALVQCFRVFSPGVARIWGTSWAALPGVVMLGAPSLSLQCVRHNNAAGKELGCS

SEQ ID NO: 837920 - protein, 266 aa, Homo sapiens
MVLSYHSPRVNDCDLLGTILSDQSHLGGPIFFSHHRHLGWDVISLVLHLRKVSYPGSFGRTLNDGPQLYDGPQLNDGPQLNDGPQLNDAPQLNDGPQLNDGPQLIDGPQLNDGPQLNDGPQLNDGPQLNDGPQSHGFEKPLDSAMSAEEDTDVRGRRKKKTPRKAEDTRENRKLENKNAFLEKKTVPKKQRNQDRSKSAAELEKLMPVSAQTPKGRRLSGEERGLWSTDSAEEPSLELRTIVELRTIVELRTIVELRTIVELRTIV

SEQ ID NO: 837921 - protein, 156 aa, Homo sapiens
AHFLKLKVSIDKGPQNRAGAIVPWFAKMSFPKYKPSSLRTLPETLDPAEYNISPETRRAQAERLAIRAQLKREYLLQYNDPNRRGLIENPALLRWAYARTINVYPNFRPTPKNSLMGALCGFGPLIFIYYIIKTERDRKEKLIQEGKLDRTFHLSY

SEQ ID NO: 837922 - protein, 156 aa, Homo sapiens; identical to SEQ ID NO: 837921

SEQ ID NO: 837923 - protein, 156 aa, Homo sapiens; identical to SEQ ID NO: 837921

SEQ ID NO: 837924 - protein, 156 aa, Homo sapiens; identical to SEQ ID NO: 837921

SEQ ID NO: 837925 - protein, 147 aa, Homo sapiens
AHFLKLKVSIDKGPQNRAGAIVPWFAKMSFPKYKPSSLRTLPETLDPAEYNISPETRRAQAERLAIRAQLKREYLLQYNDPNRRGLIENPALLRWAYARTINVYPNFRPTPKNSLMGALCGFGPLIFIYYIIKTERVSIQTRCLVFE

SEQ ID NO: 837926 - protein, 96 aa, Homo sapiens
AHFLKLKVSIDKGPQNRAGAIVPWFAKMSFPKYKPSSLRTLPETLDPAEYNISPETRRAQAERLAIRAQLKREYLLQYNDPNRRGLIVSVGPPRRE

SEQ ID NO: 837927 - protein, 96 aa, Homo sapiens; identical to SEQ ID NO: 837926

SEQ ID NO: 837928 - protein, 143 aa, Homo sapiens
GRLLLLNSRPRRPKMSFPKYKPSSLRTLPETLDPAEYNISPETRRAQAERLAIRAQLKREYLLQYNDPNRRGLIENPALLRWAYARTINVYPNFRPTPKNSLMGALCGFGPLIFIYYIIKTERDRKEKLIQEGKLDRTFHLSY

SEQ ID NO: 837929 - protein, 156 aa, Homo sapiens; identical to SEQ ID NO: 837921

SEQ ID NO: 837930 - protein, 156 aa, Homo sapiens; identical to SEQ ID NO: 837921

SEQ ID NO: 837931 - protein, 147 aa, Homo sapiens; identical to SEQ ID NO: 837925

SEQ ID NO: 837932 - protein, 139 aa, Homo sapiens
MRPEGESGPHTRRARAPDRPPTGAGRTGGERGSEKRGRRSRESGEEKRGDTTNGLGERRRQGATPRSDEGERTEQERDTYHALRFDVIGGGVREERRRGAEVTGERAEVKKAREDTNANRKEGAGAQRTEGVEERGGGR

SEQ ID NO: 837933 - protein, 160 aa, Homo sapiens
LSPVANGRGWGAARPAGRGSPRPGTRGEEEAGSQSGSIRFSHRPRCGSQQLGRREEWQRQGSPVSRRLSARRGPQAPGTRLPRRHPARAFPAATMPKRKVSSAEGAAKEEPKRRSARLSAKPPAKVEAKPKKAAAKDKSSDKKVQTKGNKGSKGKTGRSG

SEQ ID NO: 837934 - protein, 162 aa, Homo sapiens
LSPVANGRGWGAARPAGRGSPRPGTRGEEEAGSQSGSIRFSHRPRCGSQQLGRREEWQRQGSPVSRRLSARRGPQAPGTRLPRRHPARAFPAATMPKRKVSSAEGAAKEEPKRRSARLSAKPPAKVEAKPKKAAAKVSLETRIGMQRGLRLHCFLMRGFHFN

SEQ ID NO: 837935 - protein, 176 aa, Homo sapiens
LSPVANGRGWGAARPAGRGSPRPGTRGEEEAGSQSGSIRFSHRPRCGSQQLGRREEWQRQGSPVSRRLSARRGPQAPGTRLPRRHPARAFPAATMPKRKVSSAEGAAKEEPKRRSARLSAVSKASPVTVRFPRVVPGEDAQCCFCLSETSCKSGSEAEKGSSEGKPRNAHWDAAGP

SEQ ID NO: 837936 - protein, 162 aa, Homo sapiens; identical to SEQ ID NO: 837934

SEQ ID NO: 837937 - protein, 138 aa, Homo sapiens
LSPVANGRGWGAARPAGRGSPRPGTRGEEEAGSQSGSIRFSHRPRCGSQQLGRREEWQRQGSPVSRRLSARRGPQAPGTRLPRRHPARAFPAATMPKRKVSSAEGAAKEEPKRRSARLSAKPPAKVEAKPKKAAAKCR

SEQ ID NO: 837938 - protein, 123 aa, Homo sapiens
LSPVANGRGWGAARPAGRGSPRPGTRGEEEAGSQSGSIRFSHRPRCGSQQLGRREEWQRQGSPVSRRLSARRGPQAPGTRLPRRHPARAFPAATMPKRKVSSAEGAAKEEVSAGLLRGVVGFP

SEQ ID NO: 837939 - protein, 160 aa, Homo sapiens; identical to SEQ ID NO: 837933

SEQ ID NO: 837940 - protein, 130 aa, Homo sapiens
ECPLLLEAQPLCPCDLQILGDPQLRRRDSLATQKWSAPPKAPPRKSPRGDRRGCQLNLLQKWKRSRKRQQRRINLQTKKCKQKGTRGAKGKQAEVANQETKEDLPAENGETKTEESPASDEAGEKEAKSD

SEQ ID NO: 837941 - protein, 162 aa, Homo sapiens; identical to SEQ ID NO: 837934

SEQ ID NO: 837942 - protein, 160 aa, Homo sapiens; identical to SEQ ID NO: 837933

SEQ ID NO: 837943 - protein, 115 aa, Homo sapiens
MKQERKKPSLINNHIPCLISGPCLPSCTIQRNIFINYFVNASFLVALETFLRRRESHLIPFFKCKCFFLRGEIICWLFIFWYNQKIVWDIELWEALTVSGVSLTFHRWGVSFYIL

SEQ ID NO: 837944 - protein, 80 aa, Homo sapiens
AAAGAGVLERLAAGGAEGAIRTGRREAVTSRGRALFSGPGGPASPGTAARLYSCVSVSAGQLRRRRRQGRAQEEIGAVVS

SEQ ID NO: 837945 - protein, 138 aa, Homo sapiens; identical to SEQ ID NO: 837937

SEQ ID NO: 837946 - protein, 80 aa, Homo sapiens; identical to SEQ ID NO: 837944

SEQ ID NO: 837947 - protein, 175 aa, Homo sapiens
GHRVWPAHRHPFRVNPFQNAANKREQGEQRENRPKWLTKKLKKTYLRKTGKRRLRRVQPLMKQERKKPSLINNHIPCLISGPCLPSCTIQRNIFINYFVNASFLVALETFLRRRESHLIPFFKCKCFFLRGEIICWLFIFWYNQKIVWDIELWEALTVSGVSLTFHRWGVSFYIL

SEQ ID NO: 837948 - protein, 122 aa, Homo sapiens
KGDSMAAPSVELTFFLGILAAGKVGARCLGRCAYSLREAGLPGRCHSSRHRSCSRYVGQAGLELQTLDEPPASASQSAGITGVSHCARNPEEYFYQLFCKCKFFSSSRNIFKKEGIPPHPIF

SEQ ID NO: 837949 - protein, 160 aa, Homo sapiens; identical to SEQ ID NO: 837933

SEQ ID NO: 837950 - protein, 162 aa, Homo sapiens; identical to SEQ ID NO: 837934

SEQ ID NO: 837951 - protein, 162 aa, Homo sapiens; identical to SEQ ID NO: 837934

SEQ ID NO: 837952 - protein, 80 aa, Homo sapiens; identical to SEQ ID NO: 837944

SEQ ID NO: 837953 - protein, 109 aa, Homo sapiens
MGGGGGRPGRRGGGARGRGRGGRRRRAPNPVPSGSPTAPAVGLSSSGGGRSGSGKAAQFREGCRRAAARRHPARAFPAATMPKRKVSSAEGAAKEEVSAGLLRGVVGFP

SEQ ID NO: 837954 - protein, 186 aa, Homo sapiens
AESRSQWAGVGGGPAGGEGEPAAGDAGGGGGGLPIRFHPVLPPPPLWVSAARAAGGVAAARQPSFAKAVGAPRPAGTRHAPSPPPRCPRGRSAPPKAPPRKSPRGDRRGCQLNLLQKWKRSRKRQQRRINLQTKKCKQKGTRGAKGKQAEVANQETKEDLPAENGETKTEESPASDEAGEKEAKSD

SEQ ID NO: 837955 - protein, 115 aa, Homo sapiens; identical to SEQ ID NO: 837943

SEQ ID NO: 837956 - protein, 164 aa, Homo sapiens
LSPVANGRGWGAARPAGRGSPRPGTRGEEEAGSQSGSIRFSHRPRCGSQQLGRREEWQRQGSPVSRRLSARRGPQAPGTRLPRRHPARAFPAATMPKRKVSSAEGAAKEEPKRRSARLSAVSKASPVTVRFPRVVPGEDAQCCFCLSETSCKSGSEAEKGSSEG

SEQ ID NO: 837957 - protein, 160 aa, Homo sapiens; identical to SEQ ID NO: 837933

SEQ ID NO: 837958 - protein, 138 aa, Homo sapiens; identical to SEQ ID NO: 837937

SEQ ID NO: 837959 - protein, 80 aa, Homo sapiens; identical to SEQ ID NO: 837944

SEQ ID NO: 837960 - protein, 162 aa, Homo sapiens; identical to SEQ ID NO: 837934

SEQ ID NO: 837961 - protein, 769 aa, Homo sapiens
MSAAQVSSSRRQSCYLCDLPRMPWAMIWDFSEPVCRGCVNYEGADRIEFVIETARQLKRAHGCFQDGRSPGPPPPAQQQQQQQQQQQQQQQQQQQQQQQQLNHVDGSSKPAVLAAPSGLERYGLSAAAAAAAAAAAAVEQRSRFEYPPPPVSLGSSSHTARLPNGLGGPNGFPKPTPEEGPPELNRQSPNSSSAAASVASRRGTHGGLVTGLPNPGGGGGPQLTVPPNLLPQTLLNGPASAAVLPPPPPHALGSRGPPTPAPPGAPGGPACLGGTPGVSATSSSASSSTSSSVAEVGVGAGGKRPGSVSSTDQERELKEKQRNAEALAELSESLRNRAEEWASKPKMVRDTLLTLAGCTPYEVRFKKDHSLLGRVFAFDAVSKPGMDYELKLFIEYPTGSGNVYSSASGVAKQMYQDCMKDFGRGLSSGFKYLEYEKKHGSGDWRLLGDLLPEAVRFFKEGVPGADMLPQPYLDASCPMLPTALVSLSRAPSAPPGTGALPPAAPSGRGAAASLRKRKASPEPPDSAEGALKLGEEQQRQQWMANQSEALKLTMSAGGFAAPGHAAGGPPPPPPPLGPHSNRTTPPESAPQNGPSPMAALMSVADTLGTAHSPKDGSSVHSTTASARRNSSSPVSPASVPGQRRLASRNGDLNLQVAPPPPSAHPGMDQVHPQNIPDSPMANSGPLCCTICHERLEDTHFVQCPSVPSHKFCFPCSRESIKAQGATGEVYCPSGEKCPLVGSNVPWAFMQGEIATILAGDVKVKKERDP

SEQ ID NO: 837962 - protein, 497 aa, Homo sapiens
SGPESGGGVVWYHACIQHFGSLEVGVGAGGKRPGSVSSTDQERELKEKQRNAEALAELSESLRNRAEEWASKPKMVRDTLLTLAGCTPYEVRFKKDHSLLGRVFAFDAVSKPGMDYELKLFIEYPTGSGNVYSSASGVAKQMYQDCMKDFGRGLSSGFKYLEYEKKHGSGDWRLLGDLLPEAVRFFKEGVPGADMLPQPYLDASCPMLPTALVSLSRAPSAPPGTGALPPAAPSGRGAAASLRKRKASPEPPDSAEGALKLGEEQQRQQWMANQSEALKLTMSAGGFAAPGHAAGGPPPPPPPLGPHSNRTTPPESAPQNGPSPMAALMSVADTLGTAHSPKDGSSVHSTTASARRNSSSPVSPASVPGQRRLASRNGDLNLQVAPPPPSAHPGMDQVHPQNIPDSPMANSGPLCCTICHERLEDTHFVQCPSVPSHKFCFPCSRESIKAQGATGEVYCPSGEKCPLVGSNVPWAFMQGEIATILAGDVKVKKERDP

SEQ ID NO: 837963 - protein, 281 aa, Homo sapiens
MSAAQVSSSRRQSCYLCDLPRMPWAMIWDFSEPVCRGCVNYEGADRIEFVIETARQLKRAHGCFQDGRSPGPPPPAQQQQQQQQQQQQQQQQQQQQQQQQLNHVDGSSKPAVLAAPSGLERYGLSAAAAAAAAAAAAVEQRSRFEYPPASVPGQRRLASRNGDLNLQVAPPPPSAHPGMDQVHPQNIPDSPMANSGPLCCTICHERLEDTHFVQCPSVPSHKFCFPCSRESIKAQGATGEVYCPSGEKCPLVGSNVPWAFMQGEIATILAGDVKVKKERDP

SEQ ID NO: 837964 - protein, 769 aa, Homo sapiens; identical to SEQ ID NO: 837961

SEQ ID NO: 837965 - protein, 769 aa, Homo sapiens; identical to SEQ ID NO: 837961

SEQ ID NO: 837966 - protein, 769 aa, Homo sapiens; identical to SEQ ID NO: 837961

SEQ ID NO: 837967 - protein, 91 aa, Homo sapiens
MSAAQVSSSRRQSCYLCDLPRMPWAMIWDFSEPVCRGCVNYEGADRIEFVIETARQLKRAHGCFQDGRSPGPPPPVGVKTVALSAKEAAAA

SEQ ID NO: 837968 - protein, 404 aa, Homo sapiens
PSSLSPSLWRLQPTFASRQQPLAEECPASSALQRRWLWRWRWWLRRRRRQRRSSGSCQGQPAGPLGGPPANRGAAPQGSMAMNYNAKDEVDGGPPCAPGGTAKTRRPDNTAFKQQRLPAWQPILTAGTVLPIFFIIGLIFIPIGIGIFVTSNNIREIEGNVFMYYGLSNFYQNHRRYVKSRDDSQLNGDSSALLNPSKECEPYRRNEDKPIAPCGAIANSMFNDTLELFLIGNDSYPIPIALKKKGIAWWTDKNVKFRNPPGGDNLEERFKGTTKPVNWLKPVYMLDSDPDNNGFINEDFIVWMRTAALPTFRKLYRLIERKSDLHPTLPAGRYSLNVTYNYPVHYFDGRKRMILSTISWMGGKNPFLGIAYIAVGSISFLLGVVLLVINHKYRNSSNTADITI

SEQ ID NO: 837969 - protein, 440 aa, Homo sapiens
PSSLSPSLWRLQPTFASRQQPLAEECPASSALQRRWLWRWRWWLRRRRRQRRSSGSCQGQPAGPLGGPPANRGAAPQGSMAMNYNAKDEVDGGPPCAPGGTAKTRRPDNTAFKQQRLPAWQPILTAGTVLPIFFIIGLIFIPIGIGIFVTSNNIREIEIDYTGTEPSSPCNKCLSPDVTPCFCTINFTLEKSFEGNVFMYYGLSNFYQNHRRYVKSRDDSQLNGDSSALLNPSKECEPYRRNEDKPIAPCGAIANSMFNDTLELFLIGNDSYPIPIALKKKGIAWWTDKNVKFRNPPGGDNLEERFKGTTKPVNWLKPVYMLDSDPDNNGFINEDFIVWMRTAALPTFRKLYRLIERKSDLHPTLPAGRYSLNVTYNYPVHYFDGRKRMILSTISWMGGKNPFLGIAYIAVGSISFLLGVVLLVINHKYRNSSNTADITI

SEQ ID NO: 837970 - protein, 404 aa, Homo sapiens; identical to SEQ ID NO: 837968

SEQ ID NO: 837971 - protein, 407 aa, Homo sapiens
PSSLSPSLWRLQPTFASRQQPLAEECPASSALQRRWLWRWRWWLRRRRRQRRSSGSCQGQPAGPLGGPPANRGAAPQGSMAMNYNAKDEVDGGPPCAPGGTAKTRRPDNTAFKQQRLPAWQPILTAGTVLPIFFIIGLIFIPIGIGIFVTSNNIREIEIDYTGTEPSSPCNKCLSPDVTPCFCTINFTLEKSFEGNVFMYYGLSNFYQNHRRYVKSRDDSQLNGDSSALLNPSKECEPYRRNEDKPIAPCGAIANSMFNDTLELFLIGNDSYPIPIALKKKGIAWWTDKNVKFRNPPGGDNLEERFKGTTKPVNWLKPVYMLDSDPDNNGFINEDFIVWMRTAALPTFRKLYRLIERKSDLHPTLPAGRYSLNVTYSSSISPYYRPEYRNIEHLSNLADFTQVIIKS

SEQ ID NO: 837972 - protein, 407 aa, Homo sapiens; identical to SEQ ID NO: 837971

SEQ ID NO: 837973 - protein, 407 aa, Homo sapiens; identical to SEQ ID NO: 837971

SEQ ID NO: 837974 - protein, 407 aa, Homo sapiens; identical to SEQ ID NO: 837971

SEQ ID NO: 837975 - protein, 440 aa, Homo sapiens; identical to SEQ ID NO: 837969

SEQ ID NO: 837976 - protein, 242 aa, Homo sapiens
MYYGLSNFYQNHRRYVKSRDDSQLNGDSSALLNPSKECEPYRRNEDKPIAPCGAIANSMFNDTLELFLIGNDSYPIPIALKKKGIAWWTDKNVKFRNPPGGDNLEERFKGTTKPVNWLKPVYMLDSDPDNNGFINEDFIVWMRTAALPTFRKLYRLIERKSDLHPTLPAGRYSLNVTYNYPVHYFDGRKRMILSTISWMGGKNPFLGIAYIAVGSISFLLGVVLLVINHKYRNSSNTADITI

SEQ ID NO: 837977 - protein, 440 aa, Homo sapiens; identical to SEQ ID NO: 837969

SEQ ID NO: 837978 - protein, 407 aa, Homo sapiens; identical to SEQ ID NO: 837971

SEQ ID NO: 837979 - protein, 407 aa, Homo sapiens; identical to SEQ ID NO: 837971

SEQ ID NO: 837980 - protein, 79 aa, Homo sapiens
MTRSWGPEQKSTRGSPGKRITQMAVVRSQGVREGDPWAQAGCVTWVQGEAGAQEKMGGPGTGLLPMGAGEGCVNSPGPT

SEQ ID NO: 837981 - protein, 189 aa, Homo sapiens
MPHRKKKPFIEKKKAVSFHLVHRSQRDPLAADESAPQRVLLPTQKIDNEERRAEQRKYGVFFDDDYDYLQHLKEPSGPSELIPSSTFSAHNRREEKEETLVIPSTGIKLPSSVFASEFEEDVGLLNKAAPVSGPRLDFDPDIVAALDDDFDFDDPDNLLEDDFILQANKATGEEEGMDIQYVWFVSKQR

SEQ ID NO: 837982 - protein, 176 aa, Homo sapiens
FTFKNSSKSCVKLNTLEPLEDQDLPMNELDESEEEEMITVVLEEAKEKWDCESICSTYSNLYNHPQLIKYQPKPKQIRISSKTGIPLNVLPKKGLTAKQTERIQMINGSDLPKVSTQPRSKNESKEDKRARKQAIKEERKERRVEKKANKLAFKLEKRRQEKELLNLKKNVEGLKL

SEQ ID NO: 837983 - protein, 475 aa, Homo sapiens
MPHRKKKPFIEKKKAVSFHLVHRSQRDPLAADESAPQRVLLPTQKIDNEERRAEQRKYGVFFDDDYDYLQHLKEPSGPSELIPSSTFSAHNRREEKEETLVIPSTGIKLPSSVFASEFEEDVGLLNKAAPVSGPRLDFDPDIVAALDDDFDFDDPDNLLEDDFILQANKATGEEEGMDIQKSENEDDSEWEDVDDEKGDSNDDYDSAGLLSDEDCMSVPGKTHRAIADHLFWSEETKSRFTEYSMTSSVMRRNEQLTLHDERFEKFYEQYDDDEIGALDNAELEGSIQVDSNRLQEVLNDYYKEKAENCVKLNTLEPLEDQDLPMNELDESEEEEMITVVLEEAKEKWDCESICSTYSNLYNHPQLIKYQPKPKQIRISSKTGIPLNVLPKKGLTAKQTERIQMINGSDLPKVSTQPRSKNESKEDKRARKQAIKEERKERRVEKKANKLAFKLEKRRQEKELLNLKKNVEGLKL

SEQ ID NO: 837984 - protein, 260 aa, Homo sapiens [sequence omitted]

SEQ ID NO: 837985 - protein, 55 aa, Homo sapiens
MVAGPEPPVVTSTNSAVGETELVTGNKSNTNGNSLPMSIRSWTSLPCSNGHPPYV

SEQ ID NO: 837986 - protein, 215 aa, Homo sapiens
AGEGAGRSASRVPLPAPAPWAREEAGGSLCTRDAAALFARWGVDPPSGAGKGVLSARAPRTLPRAEVPSGPPPAAPWVRGPRGWRQRGARVLHPPLAACLRRSRAPRSPRWPRAAVVRSRRADPGAPLPSGAQLLLVPRPASGMGGGGSALRVCADHRGGINWLSLSPDGQRLLTGSEDGTARLWSTADGQCCALLQGALWPLCGQLCSSAGISC

SEQ ID NO: 837987 - protein, 470 aa, Homo sapiens
AGEGAGRSASRVPLPAPAPWAREEAGGSLCTRDAAALFARWGVDPPSGAGKGVLSARAPRTLPRAEVPSGPPPAAPWVRGPRGWRQRGARVLHPPLAACLRRSRAPRSPRWPRAAVVRSRRADPGAPLPSGAQLLLVPRPASGMGGGGSALRVCADHRGGINWLSLSPDGQRLLTGSEDGTARLWSTADGQCCALLQGHESYVTFCQLEDEAAFTCSADCTIRRWDVLTGQCLQVYRGHTSIVNRILVANNQLFSSSYDRTARVWSVDKGQMSREFRGHRNCVLTLAYSAPWDLPSTPCAEEAAAGGLLVTGSTDGTAKVWQVASGCCHQTLRGHTGAVLCLVLDTPGHTAFTGSTDATIRAWDILSGEQLRVFREHRGSVICLELVNRLVYSGSADRTVKCWLADTGECVRTFTAHRRNVSALKYHAGTCRRISEAGGLGWNGWLHKVIRHPAFFCHSSSSSLAQTFYL

SEQ ID NO: 837988 - protein, 455 aa, Homo sapiens
AGEGAGRSASRVPLPAPAPWAREEAGGSLCTRDAAALFARWGVDPPSGAGKGVLSARAPRTLPRAEVPSGPPPAAPWVRGPRGWRQRGARVLHPPLAACLRRSRAPRSPRWPRAAVVRSRRADPGAPLPSGAQLLLVPRPASGMGGGGSALRVCADHRGGINWLSLSPDGQRLLTGSEDGTARLWSTADGQCCALLQGHESYVTFCQLEDEAAFTCSADCTIRRWDVLTGQCLQVYRGHTSIVNRILVANNQLFSSSYDRTARVWSVDKGQMSREFRGHRNCVLTLAYSAPWDLPSTPCAEEAAAGGLLVTGSTDGTAKVWQVASGCCHQTLRGHTGAVLCLVLDTPGHTAFTGSTDATIRAWDILSGEQLRVFREHRGSVICLELVNRLVYSGSADRTVKCWLADTGECVRTFTAHRRNVSALKYHAGTLFTGSGDACARAFDAQSGELRRVFR

SEQ ID NO: 837989 - protein, 342 aa, Homo sapiens
GTRQPPPQSWACAGKDEMGKMVSVINTVDTSHEDMIHDAQMDYYGTRLATCSSDRSVKIFDVRNGGQILIADLRGHEGPVWQVAWAHPMYGNILASCSYDRKVIIWREENGTWEKSHEHAGHDSSVNSVCWAPHDYGLILACGSSDGAISLLTYTGEGQWEVKKINNAHTIGCNAVSWAPAVVPGSLIDHPSGQKPNYIKRFASGGCDNLIKLWKEEEDGQWKEEQKLEAHSDWVRDVAWAPSIGLPTSTIASCSQDGRVFIWTCDDASSNTWSPKLLHKFNDVVWHVSWSITANILAVSGGDNKVTLWKESVDGQWVCISDVNKGQGSVSASVTEGQQNEQ

SEQ ID NO: 837990 - protein, 332 aa, Homo sapiens
PRPGAATAAIMVSVINTVDTSHEDMIHDAQMDYYGTRLATCSSDRSVKIFDVRNGGQILIADLRGHEGPVWQVAWAHPMYGNILASCSYDRKVIIWREENGTWEKSHEHAGHDSSVNSVCWAPHDYGLILACGSSDGAISLLTYTGEGQWEVKKINNAHTIGCNAVSWAPAVVPGSLIDHPSGQKPNYIKRFASGGCDNLIKLWKEEEDGQWKEEQKLEAHSDWVRDVAWAPSIGLPTSTIASCSQDGRVFIWTCDDASSNTWSPKLLHKFNDVVWHVSWSITANILAVSGGDNKVTLWKESVDGQWVCISDVNKGQGSVSASVTEGQQNEQ

SEQ ID NO: 837991 - protein, 322 aa, Homo sapiens
MVSVINTVDTSHEDMIHDAQMDYYGTRLATCSSDRSVKIFDVRNGGQILIADLRGHEGPVWQVAWAHPMYGNILASCSYDRKVIIWREENGTWEKSHEHAGHDSSVNSVCWAPHDYGLILACGSSDGAISLLTYTGEGQWEVKKINNAHTIGCNAVSWAPAVVPGSLIDHPSGQKPNYIKRFASGGCDNLIKLWKEEEDGQWKEEQKLEAHSDWVRDVAWAPSIGLPTSTIASCSQDGRVFIWTCDDASSNTWSPKLLHKFNDVVWHVSWSITANILAVSGGDNKVTLWKESVDGQWVCISDVNKGQGSVSASVTEGQQNEQ

SEQ ID NO: 837992 - protein, 308 aa, Homo sapiens
MIHDAQMDYYGTRLATCSSDRSVKIFDVRNGGQILIADLRGHEGPVWQVAWAHPMYGNILASCSYDRKVIIWREENGTWEKSHEHAGHDSSVNSVCWAPHDYGLILACGSSDGAISLLTYTGEGQWEVKKINNAHTIGCNAVSWAPAVVPGSLIDHPSGQKPNYIKRFASGGCDNLIKLWKEEEDGQWKEEQKLEAHSDWVRDVAWAPSIGLPTSTIASCSQDGRVFIWTCDDASSNTWSPKLLHKFNDVVWHVSWSITANILAVSGGDNKVTLWKESVDGQWVCISDVNKGQGSVSASVTEGQQNEQ

SEQ ID NO: 837993 - protein, 368 aa, Homo sapiens
MREPVLTWCVPLELLCSHPLPLSAFLKSQVKLYTYRACAGKDEMGKMVSVINTVDTSHEDMIHDAQMDYYGTRLATCSSDRSVKIFDVRNGGQILIADLRGHEGPVWQVAWAHPMYGNILASCSYDRKVIIWREENGTWEKSHEHAGHDSSVNSVCWAPHDYGLILACGSSDGAISLLTYTGEGQWEVKKINNAHTIGCNAVSWAPAVVPGSLIDHPSGQKPNYIKRFASGGCDNLIKLWKEEEDGQWKEEQKLEAHSDWVRDVAWAPSIGLPTSTIASCSQDGRVFIWTCDDASSNTWSPKLLHKFNDVVWHVSWSITANILAVSGGDNKVTLWKESVDGQWVCISDVNKGQGSVSASVTEGQQNEQ

SEQ ID NO: 837994 - protein, 327 aa, Homo sapiens
PRPGAATAAIMVSVINTVDTSHEDMIHDAQMDYYGTRLATCSSDRSVKIFDVRNGGQILIADLRGHEGPVWQVAWAHPMYGNILASCSYDRKVIIWREENGTWEKSHEHAGHDSSVNSVCWAPHDYGLILACGSSDGAISLLTYTGEGQWEVKKINNAHTIGCNAVSWAPAVVPGSLIDHPSGQKPNYIKRFASGGCDNLIKLWKEEEDGQWKEEQKLEAHSDWVRDVAWAPSIGLPTSTIASCSQDGRVFIWTCDDASSNTWSPKLLHKFNDVVWHVSWSITANILAVSGGDNKCPFLGQLTKQLGRAPNSNRIIFPGGVTDAATD

SEQ ID NO: 837995 - protein, 308 aa, Homo sapiens
PRPGAATAAIMVSVINTVDTSHEDMIHDAQMDYYGTRLATCSSDRSVKIFDVRNGGQILIADLRGHEGPVWQVAWAHPMYGNILASCSYDRKVIIWREENGTWEKSHEHAGHDSSVNSVCWAPHDYGLILACGSSDGAISLLTYTGEGQWEVKKINNAHTIGCNAVSWAPAVVPGSLIDHPSGQKPNYIKRFASGGCDNLIKLWKEEEDGQWKEEQKLEAHSDWVRDVAWAPSIGLPTSTIASCSQDGRVFIWTCDDASSNTWSPKLLHKFNDVVWHVSWSITANILAVSGGDNKEELQMQPQIDHLP

SEQ ID NO: 837996 - protein, 285 aa, Homo sapiens
PRPGAATAAIMVSVINTVDTSHEDMIHDAQMDYYGTRLATCSSDRSVKIFDVRNGGQILIADLRGHEGPVWQVAWAHPMYGNILASCSYDRKVIIWREENGTWEKSHEHAGHDSSVNSVCWAPHDYGLILACGSSDGAISLLTYTGEGQWEVKKINNAHTIGCNAVSWAPAVVPGSLIDHPSGQKPNYIKRFASGGCDNLIKLWKEEEDGQWKEEQKLEAHSDWVRDVAWAPSIGLPTSTIASCSQDGRVFIWTCDDASSNTWSPKLLHKFNDVVWHVSWSITAN

SEQ ID NO: 837997 - protein, 324 aa, Homo sapiens
PRPGAATAAIMVSVINTVDTSHEDMIHDAQMDYYGTRLATCSSDRSVKIFDVRNGGQILIADLRGHEGPVWQVAWAHPMYGNILASCSYDRKVIIWREENGTWEKSHEHAGHDSSVNSVCWAPHDYGLILACGSSDGAISLLTYTGEGQWEVKKINNAHTIGRGPKFGGRRLVIGRGEKRSREDDMSQTGGRAYVGKGVSEGGGREGEEEGEGGGHGGGVGEEGERQRKNQHHGSCSQDGRVFIWTCDDASSNTWSPKLLHKFNDVVWHVSWSITANILAVSGGDNKVTLWKESVDGQWVCISDVNKGQGSVSASVTEGQQNEQ

SEQ ID NO: 837998 - protein, 300 aa, Homo sapiens
PRPGAATAAIMVSVINTVDTSHEDMIHDAQMDYYGTRLATCSSDRSVKIFDVRNGGQILIADLRGHEGPVWQVAWAHPMYGNILASCSYDRKVIIWREENGTWEKSHEHAGHDSSVNSVCWAPHDYGLILACGSSDGAISLLTYTGEGQWEVKKINNAHTIGRGPKFGGRRLVIGRGEKRSREDDMSQTGGRAYVGKGVSEGGGREGEEEGEGGGHGGGVGEEGERQRKNQHHGSCSQDGRVFIWTCDDASSNTWSPKLLHKFNDVVWHVSWSITANILAVSGGDNKEELQMQPQIDHLP

SEQ ID NO: 837999 - protein, 204 aa, Homo sapiens
PRPGAATAAIMVSVINTVDTSHEDMIHDAQMDYYGTRLATCSSDRSVKIFDVRNGGQILIADLRGHEGPVWQVAWAHPMYGNILASCSYDRKVIIWREENGTWEKSHEHAGHDSSVNSVCWAPHDYGLILACGSSDGAISLLTYTGEGQWEVKKINNAHTVSPSPAFHAVRAPALPRVCCSLPRGWHGRVPAGQWAGEWSADQT

SEQ ID NO: 838000 - protein, 332 aa, Homo sapiens; identical to SEQ ID NO: 837990

SEQ ID NO: 838001 - protein, 179 aa, Homo sapiens
YDSSLPFELVTSLGHQVMIKIDTEKINNAHTIGCNAVSWAPAVVPGSLIDHPSGQKPNYIKRFASGGCDNLIKLWKEEEDGQWKEEQKLEAHSDWVRDVAWAPSIGLPTSTIASCSQDGRVFIWTCDDASSNTWSPKLLHKFNDVVWHVSWSITANILAVSGGDNKEELQMQPQIDHLP

SEQ ID NO: 838002 - protein, 308 aa, Homo sapiens; identical to SEQ ID NO: 837992

SEQ ID NO: 838003 - protein, 325 aa, Homo sapiens
MGKMVSVINTVDTSHEDMIHDAQMDYYGTRLATCSSDRSVKIFDVRNGGQILIADLRGHEGPVWQVAWAHPMYGNILASCSYDRKVIIWREENGTWEKSHEHAGHDSSVNSVCWAPHDYGLILACGSSDGAISLLTYTGEGQWEVKKINNAHTIGCNAVSWAPAVVPGSLIDHPSGQKPNYIKRFASGGCDNLIKLWKEEEDGQWKEEQKLEAHSDWVRDVAWAPSIGLPTSTIASCSQDGRVFIWTCDDASSNTWSPKLLHKFNDVVWHVSWSITANILAVSGGDNKVTLWKESVDGQWVCISDVNKGQGSVSASVTEGQQNEQ

SEQ ID NO: 838004 - protein, 308 aa, Homo sapiens; identical to SEQ ID NO: 837992

SEQ ID NO: 838005 - protein, 308 aa, Homo sapiens; identical to SEQ ID NO: 837992

SEQ ID NO: 838006 - protein, 332 aa, Homo sapiens; identical to SEQ ID NO: 837990

SEQ ID NO: 838007 - protein, 382 aa, Homo sapiens
PRPGAATAAIMVSVINTVDTSHEDMIHDAQMDYYGTRLATCSSDRSVKIFDVRNGGQILIADLRGHEGPVWQVAWAHPMYGNILASCSYDRKVIIWREENGTWEKSHEHAGHDSSVNSVCWAPHDYGLILACGSSDGAISLLTYTGEGQWEVKKINNAHTIGCNAVSWAPAVVPGSLIDHPSGQKPNYIKRFASGGCDNLIKLWKEEEDGQWKEEQKLEAHSDWVRDVAWAPSIGLPTSTIASCSQDGRVFIWTCDDASSNTWSPKLLHKFNDVVWHVSWSITANILAVSGGDNKAGPQETRNRKESHRLERTCFLSPTKFQKGEWGFVLTLKELPNWAWLLFTLEKNEEGQPVPSRSLGLPPSSSWFKFAVSSSRHLSSVP

SEQ ID NO: 838008 - protein, 329 aa, Homo sapiens
PRPGAATAAIMVSVINTVDTSHEDMIHDAQMDYYGTRLATCSSDRSVKIFDVRNGGQILIADLRGHEGPVWQVAWAHPMYGNILASCSYDRKVIIWREENGTWEKSHEHAGHDSSVNSVCWAPHDYGLILACGSSDGAISLLTYTGEGQWEVKKINNAHTIGCNAVSWAPAVVPGSLIDHPSGQKPNYIKRFASGGCDNLIKLWKEEEDGQWKEEQKLEAHSDWVRDVAWAPSIGLPTSTIASCSQDGRVFIWTCDDASSNTWSPKLLHKFNDVVWHVSWSITATWRPWGHLVPSGALGAGARYGGLSKGQGKGVPLVFGKGPPLGPCL

SEQ ID NO: 838009 - protein, 231 aa, Homo sapiens
PRPGAATAAIMVSVINTVDTSHEDMIHDAQMDYYGTRLATCSSDRSVKIFDVRNGGQILIADLRGHEGPVWQVAWAHPMYGNILASCSYDRKVIIWREENGTWEKSHEHAGHDSSVNSVCWAPHDYGLILACGSSDGAISLLTYTGEGQWEVKKINNAHTIGCNAVSWAPAVVPGSLIDHPSGQKPNYIKRFASGGCDNLIKLWKEEEDGQWKEEQKLEAHIAYGSRARIY

SEQ ID NO: 838010 - protein, 185 aa, Homo sapiens
PRPGAATAAIMVSVINTVDTSHEDMIHDAQMDYYGTRLATCSSDRSVKIFDVRNGGQILIADLRGHEGPVWQVAWAHPMYGNILASCSYDRKVIIWREENGTWEKSHEHAGHDSSVNSVCWAPHDYGLILACGSSDGAISLLTYTGEGQWEVKKINNAHTTGCMPSAGPLLLHLRAITPGSHHTW

SEQ ID NO: 838011 - protein, 386 aa, Homo sapiens
MIPDRNLEMQKEFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERHELGKVEVTVFDPDSLDPDRCESCYGAEAEDIKCCNTCEDVREAYRRRGWAFKNPDTIEQCRREGFSQKMQEQKNEGCQVYGFLEVNKVAGNFHFAPGKSFQQSHVHVHDLQSFGLDNINMTHYIQHLSFGEDYPGIVNPLDHTNVTAPQASMMFQYFVKVVPTVYMKVDGEVLRTNQFSVTRHEKVANGLLGDQGLPGVFVLYELSPMMVKLTEKHRSFTHFLTGVCAIIGGMFTVAGLIDSLIYHSARAIQKKIDLGKTT

SEQ ID NO: 838012 - protein, 346 aa, Homo sapiens
FAAASTRRARRQKGTEVHPELYVDKSRGDKLKINIDVLFPHMPCAYLSIDAMDVAGEQQLDVEHNLFKQRLDKDGIPVSSEAERHELGKVEVTVFDPDSLDPDRCESCYGAEAEDIKCCNTCEDVREAYRRRGWAFKNPDTIEQCRREGFSQKMQEQKNEGCQVYGFLEVNKVAGNFHFAPGKSFQQSHVHVHDLQSFGLDNINMTHYIQHLSFGEDYPGIVNPLDHTNVTAPQASMMFQYFVKVVPTVYMKVDGEVLRTNQFSVTRHEKVANGLLGDQGLPGVFVLYELSPMMVKLTEKHRSFTHFLTGVCAIIGGMFTVAGLIDSLIYHSARAIQKKIDLGKTT

SEQ ID NO: 838013 - protein, 305 aa, Homo sapiens [sequence omitted]

SEQ ID NO: 838014 - protein, 386 aa, Homo sapiens; identical to SEQ ID NO: 838011

SEQ ID NO: 838015 - protein, 386 aa, Homo sapiens; identical to SEQ ID NO: 838011

SEQ ID NO: 838016 - protein, 386 aa, Homo sapiens; identical to SEQ ID NO: 838011

SEQ ID NO: 838017 - protein, 386 aa, Homo sapiens; identical to SEQ ID NO: 838011

SEQ ID NO: 838018 - protein, 417 aa, Homo sapiens
RKRESVGAGRLASPFRPVPMEALGKLKQFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERHELGKVEVTVFDPDSLDPDRCESCYGAEAEDIKCCNTCEDVREAYRRRGWAFKNPDTIEQCRREGFSQKMQEQKNEGCQVYGFLEVNKVAGNFHFAPGKSFQQSHVHGCVCRLKMIARSLACVHDLQSFGLDNINMTHYIQHLSFGEDYPGIVNPLDHTNVTAPQASMMFQYFVKVVPTVYMKVDGEVLRTNQFSVTRHEKVANGLLGDQGLPGVFVLYELSPMMVKLTEKHRSFTHFLTGVCAIIGGMFTVAGLIDSLIYHSARAIQKKIDLGKTT

SEQ ID NO: 838019 - protein, 386 aa, Homo sapiens
MIPDRNLEMQKEFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERHELGKVEVTVFDPDSLDPDRCESCYGAEAEDIKCCNTCEDVREAYRRRGWAFKNPDTIEQCRREGFSQKMQEQKNEGCQVYGFLEVNKVAGNFHFAPGKSFQQSHVHVHDLQSFGLDNINMTHYIQHLSFGEDYPGIVNPLDHTNVTAPQASMMFQYFVKVVPTVYMKVDGEVLRTNQFSVTRHEKVANGLLGDQGLPGVFVLYELSPMMVKLTEKHRSFTHFLTGVCAIIGGMFTVAGLIDSLIYHCDSTHWSPCDPCHGQ

SEQ ID NO: 838020 - protein, 418 aa, Homo sapiens
MIPDRNLEMQKEFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERHELGKVEVTVFDPDSLDPDRCESCYGAEAEDIKCCNTCEDVREAYRRRGWAFKNPDTIEQCRREGFSQKMQEQKNEGCQVYGFLEVNKVAGNFHFAPGKSFQQSHVHVHDLQSFGLDNINMTHYIQHLSFGEDYPGIVNPLDHTNVTAPQASMMFQYFVKVVPTVYMKVDGEAQQERGRSRGGADGGWSQVLALALAQAPLPPQVLRTNQFSVTRHEKVANGLLGDQGLPGVFVLYELSPMMVKLTEKHRSFTHFLTGVCAIIGGMFTVAGLIDSLIYHSARAIQKKIDLGKTT

SEQ ID NO: 838021 - protein, 392 aa, Homo sapiens
MIPDRNLEMQKEFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERHELGKVEVTVFDPDSLDPDRCESCYGAEAEDIKCCNTCEDVREAYRRRGWAFKNPDTIEQCRREGFSQKMQEQKNEGCQVYGFLEVNKVAGNFHFAPGKSFQQSHVHVHDLQSFGLDNINMTHYIQHLSFGEDYPGIVNPLDHTNVTAPQASMMFQYFVKVVPTVYMKVDGEAPLPPQVLRTNQFSVTRHEKVANGLLGDQGLPGVFVLYELSPMMVKLTEKHRSFTHFLTGVCAIIGGMFTVAGLIDSLIYHSARAIQKKIDLGKTT

SEQ ID NO: 838022 - protein, 336 aa, Homo sapiens
MIPDRNLEMQKEFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERHELGKVEVTVFDPDSLDPDRCESCYGAEAEDIKCCNTCEDVREAYRRRGWAFKNPDTIEQCRREGFSQKMQEQKNEGCQVYGFLEVNKVAGNFHFAPGKSFQQSHVHVHDLQSFGLDNINMTHYIQHLSFGEDYPGIVNPLDHTNVTAPQASMMFQYFVKVVPTVYMKVDGEVLRTNQFSVTRHEKVANGLLGDQGLPGVFVQHEPSRRKLI

SEQ ID NO: 838023 - protein, 298 aa, Homo sapiens
MIPDRNLEMQKEFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERHELGKVEVTVFDPDSLDPDRCESCYGAEAEDIKCCNTCEDVREAYRRRGWAFKNPDTIEQCRREGFSQKMQEQKNEGCQVYGFLEVNKVAGNFHFAPGKSFQQSHVHVHDLQSFGLDNINMTHYIQHLSFGEDYPGIVNPLDHTNVTAPQASMMFQYFVKVVPTVYMKVDGEPL

SEQ ID NO: 838024 - protein, 252 aa, Homo sapiens
RKRESVGAGRLASPFRPVPMEALGKLKQFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERHELGKVEVTVFDPDSLDPDRCESCYGAEAEDIKCCNTCEDVREAYRRRGWAFKNPDTIEQCRREGFSQKMQEQKNEGCQVYGFLEVNKVAGNFHFAPGKSFQQSHVHVSDLH

SEQ ID NO: 838025 - protein, 296 aa, Homo sapiens
MIPDRNLEMQKEFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERHELGKVEVTVFDPDSLDPDRCESCYGAEAEDIKCCNTCEDVREAYRRRGWAFKNPDTIEQCRREGFSQKMQEQKNEGCQVYGFLEVNKVAGNFHFAPGKSFQQSHVHVHDLQSFGLDNINMTHYIQHLSFGEDYPGIVNPLDHTNVTAPQASMMFQYFVKVVPTVYMKVDGE

SEQ ID NO: 838026 - protein, 296 aa, Homo sapiens; identical to SEQ ID NO: 838025

SEQ ID NO: 838027 - protein, 252 aa, Homo sapiens; identical to SEQ ID NO: 838024

SEQ ID NO: 838028 - protein, 252 aa, Homo sapiens; identical to SEQ ID NO: 838024

SEQ ID NO: 838029 - protein, 292 aa, Homo sapiens
MIPDRNLEMQKEFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERHELGKVEVTVFDPDSLDPDRCESCYGAEAEDIKCCNTCEDVREAYRRRGWAFKNPDTIEQCRREGFSQKMQEQKNEGCQVYGFLEVNKVAGNFHFAPGKSFQQSHVHVHDLQSFGLDNINMTHYIQHLSFGEDYPGIVNPLDHTNVTAPQEKASMMLTVLKCMSRSTV

SEQ ID NO: 838030 - protein, 272 aa, Homo sapiens
MIPDRNLEMQKEFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERHELGKVEVTVFDPDSLDPDRCESCYGAEAEDIKCCNTCEDVREAYRRRGWAFKNPDTIEQCRREGFSQKMQEQKNEGCQVYGFLEVNKVAGNDHRAPWEEVPTVQCDTSMTGQRELICPQYLSVHVDVHSGLPPSRSTGTSWMTWGSK

SEQ ID NO: 838031 - protein, 385 aa, Homo sapiens
TSLMMFQYFVKVVPTVYMKVDGEVLRTNQFSVTIVSGLLMLLLFLSELQYYLTTEVHPELYVDKSRGDKLKINIDVLFPHMPCAYLSIDAMDVAGEQQLDVEHNLFKQRLDKDGIPVSSEAERHELGKVEVTVFDPDSLDPDRCESCYGAEAEDIKCCNTCEDVREAYRRRGWAFKNPDTIEQCRREGFSQKMQEQKNEGCQVYGFLEVNKVAGNFHFAPGKSFQQSHVHVHDLQSFGLDNINMTHYIQHLSFGEDYPGIVNPLDHTNVTAPQASMMFQYFVKVVPTVYMKVDGEVLRTNQFSVTRHEKVANGLLGDQGLPGVFVLYELSPMMVKLTEKHRSFTHFLTGVCAIIGGMFTVAGLIDSLIYHSARAIQKKIDLGKTT

SEQ ID NO: 838032 - protein, 347 aa, Homo sapiens
TGIVVLLLSVLSITPTEVHPELYVDKSRGDKLKINIDVLFPHMPCAYLSIDAMDVAGEQQLDVEHNLFKQRLDKDGIPVSSEAERHELGKVEVTVFDPDSLDPDRCESCYGAEAEDIKCCNTCEDVREAYRRRGWAFKNPDTIEQCRREGFSQKMQEQKNEGCQVYGFLEVNKVAGNFHFAPGKSFQQSHVHVHDLQSFGLDNINMTHYIQHLSFGEDYPGIVNPLDHTNVTAPQASMMFQYFVKVVPTVYMKVDGEVLRTNQFSVTRHEKVANGLLGDQGLPGVFVLYELSPMMVKLTEKHRSFTHFLTGVCAIIGGMFTVAGLIDSLIYHSARAIQKKIDLGKTT

SEQ ID NO: 838033 - protein, 398 aa, Homo sapiens
MIPDRNLEMQKEFDAYPKTLEDFRVKTCGGATVTIVSGLLMLLLFLSELQYYLTTEVHPELYVDKSRGDKLKINIDVLFPHMPCAWSQYLSLIFLLPDLSIDAMDVAGEQQLDVEHNLFKQRLDKDGIPVSSEAERHELGKVEVTVFDPDSLDPDRCESCYGAEAEDIKCCNTCEDVREAYRRRGWAFKNPDTIEQCRREGFSQKMQEQKNEGCQVYGFLEVNKVAGNFHFAPGKSFQQSHVHVHDLQSFGLDNINMTHYIQHLSFGEDYPGIVNPLDHTNVTAPQASMMFQYFVKVVPTVYMKVDGEVLRTNQFSVTRHEKVANGLLGDQGLPGVFVLYELSPMMVKLTEKHRSFTHFLTGVCAIIGGMFTVAGLIDSLIYHSARAIQKKIDLGKTT

SEQ ID NO: 838034 - protein, 386 aa, Homo sapiens; identical to SEQ ID NO: 838011

SEQ ID NO: 838035 - protein, 312 aa, Homo sapiens
RKRESVGAGRLASPFRPVPMEALGKLKQFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERHELGKVEVTVFDPDSLDPDRCESCYGAEAEDIKCCNTCEDVREAYRRRGWAFKNPDTIEQCRREGFSQKMQEQKNEGCQVYGFLEVNKVAGNFHFAPGKSFQQSHVHVHDLQSFGLDNINMTHYIQHLSFGEDYPGIVNPLDHTNVTAPQASMMFQYFVKVVPTVYMKVDGE

SEQ ID NO: 838036 - protein, 245 aa, Homo sapiens
ATLADPCIGGACEDIKCCNTCEDVREAYRRRGWAFKNPDTIEQCRREGFSQKMQEQKNEGCQVYGFLEVNKVAGNFHFAPGKSFQQSHVHVHDLQSFGLDNINMTHYIQHLSFGEDYPGIVNPLDHTNVTAPQASMMFQYFVKVVPTVYMKVDGEVLRTNQFSVTRHEKVANGLLGDQGLPGVFVLYELSPMMVKLTEKHRSFTHFLTGVCAIIGGMFTVAGLIDSLIYHSARAIQKKIDLGKTT

SEQ ID NO: 838037 - protein, 417 aa, Homo sapiens; identical to SEQ ID NO: 838018

SEQ ID NO: 838038 - protein, 191 aa, Homo sapiens
SVPVSARQVYGFLEVNKVAGNFHFAPGKSFQQSHVHVHDLQSFGLDNINMTHYIQHLSFGEDYPGIVNPLDHTNVTAPQASMMFQYFVKVVPTVYMKVDGEVLRTNQFSVTRHEKVANGLLGDQGLPGVFVLYELSPMMVKLTEKHRSFTHFLTGVCAIIGGMFTVAGLIDSLIYHSARAIQKKIDLGKTT

SEQ ID NO: 838039 - protein, 373 aa, Homo sapiens
MHHQQTHIKGNTIAFFRQNEMIPDRNLEMQKEFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERHELGKVEVTVFDPDSLDPDRCESCYGAEAEDIKCCNTCEDVREAYRRRGWAFKNPDTIEQCRREGFSQKMQEQKNEGCQVYGFLEVNKVAGNFHFAPGKSFQQSHVHVHDLQSFGLDNINMTHYIQHLSFGEDYPGIVNPLDHTNVTAPQASMMFQYFVKVVPTVYMKVDGEVLRTNQFSVTRHEKVANGLLGDQGLPGVFVSLSLSQWLDSSIRSSTTQHEPSRRKLI

SEQ ID NO: 838040 - protein, 334 aa, Homo sapiens
MIPDRNLEMQKEFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERHELGKVEVTVFDPDSLDPDRCESCYGAEAEDIKCCNTCEDVREAYRRRGWAFKNPDTIEQCRREGFSQKMQEQKNEGCQVYGFLEVNKVAGNFHFAPGKSFQQSHVHVHDLQSFGLDNINMTHYIQHLSFGEDYPGIVNPLDHTNVTAPQASMMFQYFVKVVPTVYMKVDGEVLHPLPDRCVRHHWGHVHSGWTHRFAHLPLSTSHPEEN

SEQ ID NO: 838041 - protein, 311 aa, Homo sapiens
MIPDRNLEMQKEFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERHELGKVEVTVFDPDSLDPDRCESCYGAEAEDIKCCNTCEDVREAYRRRGWAFKNPDTIEQCRREGFSQKMQEQKNEGCQVYGFLEVNKVAGNFHFAPGKSFQQSHVHVHDLQSFGLDNINMTHYIQHLSFGEDYPGIVNPLDHTNVTAPQASMMFQYFVKVVPTVYMKVDGETEDKSVLMSGHRGRR

SEQ ID NO: 838042 - protein, 369 aa, Homo sapiens
MHHQQTHIKGNTIAFFRQNEMIPDRNLEMQKEFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERHELGKVEVTVFDPDSLDPDRCESCYGAEAEDIKCCNTCEDVREAYRRRGWAFKNPDTIEQCRREGFSQKMQEQKNEGCQVYGFLEVNKVAGNFHFAPGKSFQQSHVHVHDLQSFGLDNINMTHYIQHLSFGEDYPGIVNPLDHTNVTAPQASMMFQYFVKVVPTVLYELSPMMVKLTEKHRSFTHFLTGVCAIIGGMFTVAGLIDSLIYHSARAIQKKIDLGKTT

SEQ ID NO: 838043 - protein, 297 aa, Homo sapiens
MIPDRNLEMQKEFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERHELGKVEVTVFDPDSLDPDRCESCYGAEAEDIKCCNTCEDVREAYRRRGWAFKNPDTIEQCRREGFSQKMQEQKNEGCQVYGFLEVNKVAGNFHFAPGKSFQQSHVHVHDLQSFGLDNINMTHYIQHLSFGEDYPGIVNPLDHTNVTAPQASMMFQYFVKVVPTVYMKVDGEI

SEQ ID NO: 838044 - protein, 306 aa, Homo sapiens
MIPDRNLEMQKEFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERHELGKVEVTVFDPDSLDPDRCESCYGAEAEDIKCCNTCEDVREAYRRRGWAFKNPDTIEQCRREGFSQKMQEQKNEGCQVYGFLEVNKVAGNFHFAPGKSFQQSHVHVHDLQSFGLDNINMTHYIQHLSFGEDYPGIVNPLDHTNVTAPQALVSLPVAGLIDSLIYHSARAIQKKIDLGKTT

SEQ ID NO: 838045 - protein, 280 aa, Homo sapiens
MIPDRNLEMQKEFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERHELGKVEVTVFDPDSLDPDRCESCYGAEAEDIKCCNTCEDVREAYRRRGWAFKNPDTIEQCRREGFSQKMQEQKNEGCQVYGFLEVNKVAGNFHFAPGKSFQQSHVHVHDLQSFGLDNVLHPLPDRCVRHHWGHVHSGWTHRFAHLPLSTSHPEEN

SEQ ID NO: 838046 - protein, 147 aa, Homo sapiens
MHHQQTHIKGNTIAFFRQNEMIPDRNLEMQKEFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERHAD

SEQ ID NO: 838047 - protein, 1711 aa, Homo sapiens
MSAKVRLKKLEQLLLDGPWRNESALSVETLLDVLVCLYTECSHSALRRDKYVAEFLEWAKPFTQLVKEMQLHREDFEIIKVIGRGAFGEVAVVKMKNTERIYAMKILNKWEMLKRAETACFREERDVLVNGDCQWITALHYAFQDENHLYLVMDYYVGGDLLTLLSKFEDKLPEDMARFYIGEMVLAIDSIHQLHYVHRDIKPDNVLLDVNGHIRLADFGSCLKMNDDGTVQSSVAVGTPDYISPEILQAMEDGMGKYGPECDWWSLGVCMYEMLYGETPFYAESLVETYGKIMNHEERFQFPSHVTDVSEEAKDLIQRLICSRERRLGQNGIEDFKKHAFFEGLNWENIRNLEAPYIPDVSSPSDTSNFDVDDDVLRNTEILPPGSHTGFSGLHLPFIGFTFTTESCFSDRGSLKSIMQSNTLTKDEDVQRDLEHSLQMEAYERRIRRLEQEKLELSRKLQESTQTVQSLHGSSRALSNSNRDKEIKKLNEEIERLKNKIADSNRLERQLEDTVALRQEREDSTQRLRGLEKQHRVVRQEKEELHKQLVEASERLKSQAKELKDAHQQRKLALQEFSELNERMAELRAQKQKVSRQLRDKEEEMEVATQKVDAMRQEMRRAEKLRKELEAQLDDAVAEASKERKLREHSENFCKQMESELEALKVKQGGRGAGATLEHQQEISKIKSELEKKVLFYEEELVRREASHVLEVKNVKKEVHDSESHQLALQKEILMLKDKLEKSKRERHNEMEEAVGTIKDKYERERAMLFDENKKLTAENEKLCSFVDKLTAQNRQLEDELQDLAAKKESVAHWEAQIAEIIQWVSDEKDARGYLQALASKMTEELEALRSSSLGSRTLDPLWKVRRSQKLDMSARLELQSALEAEIRAKQLVQEELRKVKDANLTLESKLKDSEAKNRELLEEMEILKKKMEEKFRADTGLKLPDFQDSIFEYFNTAPLAHDLTFRTSSASEQETQAPKPEASPSMSVAASEQQEDMARPPQRPSAVPLPTTQALALAGPKPKAHQFSIKSFSSPTQCSHCTSLMVGLIRQGYACEVCSFACHVSCKDGAPQVCPIPPEQSKRPLGVDVQRGIGTAYKGHVKVPKPTGVKKGWQRAYAVVCDCKLFLYDLPEGKSTQPGVIASQVLDLRDDEFSVSSVLASDVIHATRRDIPCIFRVTASLLGAPSKTSSLLILTENENEKRKWVGILEGLQSILHKNRLRNQVVHVPLEAYDSSLPLIKAILTAAIVDADRIAVGLEEGLYVIEVTRDVIVRAADCKKVHQIELAPREKIVILLCGRNHHVHLYPWSSLDGAEGSFDIKLPETKGCQLMATATLKRNSGTCLFVAVKRLILCYEIQRTKPFHRKFNEIVAPGSVQCLAVLRDRLCVGYPSGFCLLSIQGDGQPLNLVNPNDPSLAFLSQQSFDALCAVELESEEYLLCFSHMGLYVDPQGRRARAQELMWPAAPVACSCSPTHVTVYSEYGVDVFDVRTMEWVQTIGLRRIRPLNSEGTLNLLNCEPPRLIYFKSKFSGAVLNVPDTSDNSKKQMLRTRSKRRFVFKVPEEERLQQRREMLRDPELRSKMISNPTNFNHVAHMGPGDGMQVLMDLPLSAVPPSQEERPGPAPTNLARQPPSRNKPYISWPSSGGSEPSVTVPLRSMSDPDQDFDKEPDSDSTKHSTPSNSSNPSGPPSPNSPHRSQLPLEGLEQPACDT

SEQ ID NO: 838048 - protein, 1711 aa, Homo sapiens; identical to SEQ ID NO: 838047

SEQ ID NO: 838049 - protein, 1685 aa, Homo sapiens
MSAKVRLKKLEQLLLDGPWRNESALSVETLLDVLVCLYTECSHSALRRDKYVAEFLEWAKPFTQLVKEMQLHREDFEIIKVIGRGAFGEVAVVKMKNTERIYAMKILNKWEMLKRAETACFREERDVLVNGDCQWITALHYAFQDENHLYLVMDYYVGGDLLTLLSKFEDKLPEDMARFYIGEMVLAIDSIHQLHYVHRDIKPDNVLLDVNGHIRLADFGSCLKMNDDGTVQSSVAVGTPDYISPEILQAMEDGMGKYGPECDWWSLGVCMYEMLYGETPFYAESLVETYGKIMNHEERFQFPSHVTDVSEEAKDLIQRLICSRERRLGQNGIEDFKKHAFFEGLNWENIRNLEAPYIPDVSSPSDTSNFDVDDDVLRNTEILPPGSHTGFSGLHLPFIGFTFTTESCFSDRGSLKSIMQSNTLTKDEDVQRDLEHSLQMEAYERRIRRLEQEKLELSRKLQESTQTVQSLHGSSRALSNSNRDKEIKKLNEEIERLKNKIADSNRLERQLEDTVALRQEREDSTQRLRGLEKQHRVVRQEKEELHKQLVEASERLKSQAKELKDAHQQRKLALQEFSELNERMAELRAQKQKVSRQLRDKEEEMEVATQKVDAMRQEMRRAEKLRKELEAQLDDAVAEASKERKLREHSENFCKQMESELEALKVKQGGRGAGATLEHQQEISKIKSELEKKVLFYEEELVRREASHVLEVKNVKKEVHDSESHQLALQKEILMLKDKLEKSKRERHNEMEEAVGTIKDKYERERAMLFDENKKLTAENEKLCSFVDKLTAQNRQLEDELQDLAAKKESVAHWEAQIAEIIQWVSDEKDARGYLQALASKMTEELEALRSSSLGSRTLDPLWKVRRSQKLDMSARLELQSALEAEIRAKQLVQEELRKVKDANLTLESKLKDSEAKNRELLEEMEILKKKMEEKFRADTGLKLPDFQDSIFEYFNTAPLAHDLTFRTSSASEQETQAPKPEASPSMSVAASEQQEPKAHQFSIKSFSSPTQCSHCTSLMVGLIRQGYACEVCSFACHVSCKDGAPQVCPIPPEQSKRPLGVDVQRGIGTAYKGHVKVPKPTGVKKGWQRAYAVVCDCKLFLYDLPEGKSTQPGVIASQVLDLRDDEFSVSSVLASDVIHATRRDIPCIFRVTASLLGAPSKTSSLLILTENENEKRKWVGILEGLQSILHKNRLRNQVVHVPLEAYDSSLPLIKAILTAAIVDADRIAVGLEEGLYVIEVTRDVIVRAADCKKVHQIELAPREKIVILLCGRNHHVHLYPWSSLDGAEGSFDIKLPETKGCQLMATATLKRNSGTCLFVAVKRLILCYEIQRTKPFHRKFNEIVAPGSVQCLAVLRDRLCVGYPSGFCLLSIQGDGQPLNLVNPNDPSLAFLSQQSFDALCAVELESEEYLLCFSHMGLYVDPQGRRARAQELMWPAAPVACSCSPTHVTVYSEYGVDVFDVRTMEWVQTIGLRRIRPLNSEGTLNLLNCEPPRLIYFKSKFSGAVLNVPDTSDNSKKQMLRTRSKRRFVFKVPEEERLQQRREMLRDPELRSKMISNPTNFNHVAHMGPGDGMQVLMDLPLSAVPPSQEERPGPAPTNLARQPPSRNKPYISWPSSGGSEPSVTVPLRSMSDPDQDFDKEPDSDSTKHSTPSNSSNPSGPPSPNSPHRSQLPLEGLEQPACDT

SEQ ID NO: 838050 - protein, 1441 aa, Homo sapiens
MSAKVRLKKLEQLLLDGPWRNESALSVETLLDVLVCLYTECSHSALRRDKYVAEFLEWAKPFTQLVKEMQLHREDFEIIKVIGRGAFGEVAVVKMKNTERIYAMKILNKWEMLKRAETACFREERDVLVNGDCQWITALHYAFQDENHLYLVMDYYVGGDLLTLLSKFEDKLPEDMARFYIGEMVLAIDSIHQLHYVHRDIKPDNVLLDVNGHIRLADFGSCLKMNDDGTVQSSVAVGTPDYISPEILQAMEDGMGKYGPECDWWSLGVCMYEMLYGETPFYAESLVETYGKIMNHEERFQFPSHVTDVSEEAKDLIQRLICSRERRLGQNGIEDFKKHAFFEGLNWENIRNLEAPYIPDVSSPSDTSNFDVDDDVLRNTEILPPGSHTGFSGLHLPFIGFTFTTESCFSDRGSLKSIMQSNTLTKDEDVQRDLEHSLQMEAYERRIRRLEQEKLELSRKLQESTQTVQSLHGSSRALSNSNRDKEIKKLNEEIERLKNKIADSNRLERQLEDTVALRQEREDSTQRLRGLEKQHRVVRQEKEELHKQLVEASERLKSQAKELKDAHQQRKLALQEFSELNERMAELRAQKQKVSRQLRDKEEEMEVATQKVDAMRQEMRRAEKLRKELEAQLDDAVAEASKERKLREHSENFCKQMESELEALKVKQGGRGAGATLEHQQEISKIKSELEKKVLFYEEELVRREASHVLEVKNVKKEVHDSESHQLALQKEILMLKDKLEKSKRERHNEMEEAVGTIKDKYERERAMLFDENKKLTAENEKLCSFVDKLTAQNRQLEDELQDLAAKKESVAHWEAQIAEIIQWVSDEKDARGYLQALASKMTEELEALRSSSLGSRTLDPLWKVRRSQKLDMSARLELQSALEAEIRAKQLVQEELRKVKDANLTLESKLKDSEAKNRELLEEMEILKKKMEEKFRADTGLKLPDFQDSIFEYFNTAPLAHDLTFRTSSASEQETQAPKPEASPSMSVAASEQQEDMARPPQRPSAVPLPTTQALALAGPKPKAHQFSIKSFSSPTQCSHCTSLMVGLIRQGYACEVCSFACHVSCKDGAPQVCPIPPEQSKRPLGVDVQRGIGTAYKGHVKVPKPTGVKKGWQRAYAVVCDCKLFLYDLPEGKSTQPGVIASQVLDLRDDEFSVSSVLASDVIHATRRDIPCIFRVTASLLGAPSKTSSLLILTENENEKRKWVGILEGLQSILHKNRLRNQVVHVPLEAYDSSLPLIKAILTAAIVDADRIAVGLEEGLYVIEVTRDVIVRAADCKKVHQIELAPREKIVILLCGRNHHVHLYPWSSLDGAEGSFDIKLPETKGCQLMATATLKRNSGTCLFVAVKRLILCYEIQRTKPFHRKFNEIVAPGSVQCLAVLRDRLCVGYPSGFCLLSIQGDGQPLNLVAAPPTSRCTASMAWTSLMCAPWSGCRPSACGG

SEQ ID NO: 838051 - protein, 1711 aa, Homo sapiens; identical to SEQ ID NO: 838047

SEQ ID NO: 838052 - protein, 252 aa, Homo sapiens
MEWVQTIGLRRVRRPRCPPVRAGFSRCSLCVAALTVPPWFPIQIRPLNSEGTLNLLNCEPPRLIYFKSKFSGAVLNVPDTSDNSKKQMLRTRSKRRFVFKVPEEERLQQRREMLRDPELRSKMISNPTNFNHVAHMGPGDGMQVLMDLPLSAVPPSQEERPGPAPTNLARQPPSRNKPYISWPSSGGSEPSVTVPLRSMSDPDQDFDKEPDSDSTKHSTPSNSSNPSGPPSPNSPHRSQLPLEGLEQPACDT

SEQ ID NO: 838053 - protein, 150 aa, Homo sapiens
GGYVSEGAGVVNRLDGRLRYKISNPTNFNHVAHMGPGDGMQVLMDLPLSAVPPSQEERPGPAPTNLARQPPSRNKPYISWPSSGGSEPSVTVPLRSMSDPDQDFDKEPDSDSTKHSTPSNSSNPSGPPSPNSPHRSQLPLEGLEQPACDT

SEQ ID NO: 838054 - protein, 1504 aa, Homo sapiens
MSAKVRLKKLEQLLLDGPWRNESALSVETLLDVLVCLYTECSHSALRRDKYVAEFLEWAKPFTQLVKEMQLHREDFEIIKVIGRGAFGEVAVVKMKNTERIYAMKILNKWEMLKRAETACFREERDVLVNGDCQWITALHYAFQDENHLYLVMDYYVGGDLLTLLSKFEDKLPEDMARFYIGEMVLAIDSIHQLHYVHRDIKPDNVLLDVNGHIRLADFGSCLKMNDDGTVQSSVAVGTPDYISPEILQAMEDGMGKYGPECDWWSLGVCMYEMLYGETPFYAESLVETYGKIMNHEERFQFPSHVTDVSEEAKDLIQRLICSRERRLGQNGIEDFKKHAFFEGLNWENIRNLEAPYIPDVSSPSDTSNFDVDDDVLRNTEILPPGSHTGFSGLHLPFIGFTFTTESCFSDRGSLKSIMQSNTLTKDEDVQRDLEHSLQMEAYERRIRRLEQEKLELSRKLQESTQTVQSLHGSSRALSNSNRDKEIKKLNEEIERLKNKIADSNRLERQLEDTVALRQEREDSTQRLRGLEKQHRVVRQEKEELHKQLVEASERLKSQAKELKDAHQQRKLALQEFSELNERMAELRAQKQKVSRQLRDKEEEMEVATQKVDAMRQEMRRAEKLRKELEAQLDDAVAEASKERKLREHSENFCKQMESELEALKVKQGGRGAGATLEHQQEISKIKSELEKKVLFYEEELVRREASHVLEVKNVKKEVHDSESHQLALQKEILMLKDKLEKSKRERHNEMEEAVGTIKDKYERERAMLFDENKKLTAENEKLCSFVDKLTAQNRQLEDELQDLAAKKESVAHWEAQIAEIIQWVSDEKDARGYLQALASKMTEELEALRSSSLGSRTLDPLWKVRRSQKLDMSARLELQSALEAEIRAKQLVQEELRKVKDANLTLESKLKDSEAKNRELLEEMEILKKKMEEKFRADTGLKLPDFQDSIFEYFNTAPLAHDLTFRTSSASEQETQAPKPEASPSMSVAASEQQEDMARPPQRPSAVPLPTTQALALAGPKPKAHQFSIKSFSSPTQCSHCTSLMVGLIRQGYACEVCSFACHVSCKDGAPQVCPIPPEQSKRPLGVDVQRGIGTAYKGHVKVPKPTGVKKGWQRAYAVVCDCKLFLYDLPEGKSTQPGVIASQVLDLRDDEFSVSSVLASDVIHATRRDIPCIFRVTASLLGAPSKTSSLLILTENENEKRKWVGILEGLQSILHKNRLRNQVVHVPLEAYDSSLPLIKAILTAAIVDADRIAVGLEEGLYVIEVTRDVIVRAADCKKVHQIELAPREKIVILLCGRNHHVHLYPWSSLDGAEGSFDIKLPETKGCQLMATATLKRNSGTCLFVAVKRLILCYEIQRTKPFHRKFNEIVAPGSVQCLAVLRDRLCVGYPSGFCLLSIQGDGQPLNLVNPNDPSLAFLSQQSFDALCAVELESEEYLLCFSHMGLYVDPQGRRARAQELMWPAAPVACSMYMFSVAYPCCCFSHRQSACVRFCFGLSSSPLVE

SEQ ID NO: 838055 - protein, 596 aa, Homo sapiens
MSAKVRLKKLEQLLLDGPWRNESALSVETLLDVLVCLYTECSHSALRRDKYVAEFLEWAKPFTQLVKEMQLHREDFEIIKVIGRGAFGEVAVVKMKNTERIYAMKILNKWEMLKRAETACFREERDVLVNGDCQWITALHYAFQDENHLYLVMDYYVGGDLLTLLSKFEDKLPEDMARFYIGEMVLAIDSIHQLHYVHRDIKPDNVLLDVNGHIRLADFGSCLKMNDDGTVQSSVAVGTPDYISPEILQAMEDGMGKYGPECDWWSLGVCMYEMLYGETPFYAESLVETYGKIMNHEERFQFPSHVTDVSEEAKDLIQRLICSRERRLGQNGIEDFKKHAFFEGLNWENIRNLEAPYIPDVSSPSDTSNFDVDDDVLRNTEILPPGSHTGFSGLHLPFIGFTFTTESCFSDRGSLKSIMQSNTLTKDEDVQRDLEHSLQMEAYERRIRRLEQEKLELSRKLQESTQTVQSLHGSSRALSNSNRDKEIKKLNEEIERLKNKIADSNRLERQLEDTVALRQEREDSTQRLRGLEKQHRVVRQEKEELHKQLVEASERLKSQAKSALSGPAPPSPATPLPSWAFCWMGTWGVLVFTFLM

SEQ ID NO: 838056 - protein, 330 aa, Homo sapiens
MSAKVRLKKLEQLLLDGPWRNESALSVETLLDVLVCLYTECSHSALRRDKYVAEFLEWAKPFTQLVKEMQLHREDFEIIKVIGRGAFGEVAVVKMKNTERIYAMKILNKWEMLKRAETACFREERDVLVNGDCQWITALHYAFQDENHLYLVMDYYVGGDLLTLLSKFEDKLPEDMARFYIGEMVLAIDSIHQLHYVHRDIKPDNVLLDVNGHIRLADFGSCLKMNDDGTVQSSVAVGTPDYISPEILQAMEDGMGKYGPECDWWSLGVCMYEMLYGETPFYAESLVETYGKIMNHEERFQFPSHVTDVSEEAKDLIQRLSCIQRTPYLQ

SEQ ID NO: 838057 - protein, 121 aa, Homo sapiens
MNFSLIFLTKHMVKTDCSRHVIVLRQPSAHLQCGPRVSTSSLAPGPCASRPGQVAACARLGEPPGWLLPRHPSSLTLPSPTSETPLPLSPRPGHCPHSVCTARRALWQVRHEGASPVPPSQ

SEQ ID NO: 838058 - protein, 203 aa, Homo sapiens
LFQRIPFYSTLEWVQTIVLRRIRPLNSEGTLNLLNCEPPRLIYFKSKFSGAVLNVPDTSDNSKKQMLRTRSKRRFVFKVPEEERLQQRREMLRDPELRSKMISNPTNFNHVAHMGPGDGMQVLMDLPLSAVPPSQEERPGPAPTNLARQPPSRNKPYISWPSSGGSEPSVTVPLRSMSDPDQDFDKEPDSDSKHSTPDDADGY

SEQ ID NO: 838059 - protein, 1142 aa, Homo sapiens
TLSRLYPVSALPLSLGSTLSLGSTVSRQLRDKEEEMEVATQKVDAMRQEMRRAEKLRKELEAQLDDAVAEASKERKLREHSENFCKQMESELEALKVKQGGRGAGATLEHQQEISKIKSELEKKVLFYEEELVRREASHVLEVKNVKKEVHDSESHQLALQKEILMLKDKLEKSKRERHNEMEEAVGTIKDKYERERAMLFDENKKLTAENEKLCSFVDKLTAQNRQLEDELQDLAAKKESVAHWEAQIAEIIQWVSDEKDARGYLQALASKMTEELEALRSSSLGSRTLDPLWKVRRSQKLDMSARLELQSALEAEIRAKQLVQEELRKVKDANLTLESKLKDSEAKNRELLEEMEILKKKMEEKFRADTGLKLPDFQDSIFEYFNTAPLAHDLTFRTSSASEQETQAPKPEASPSMSVAASEQQEDMARPPQRPSAVPLPTTQALALAGPKPKAHQFSIKSFSSPTQCSHCTSLMVGLIRQGYACEVCSFACHVSCKDGAPQVCPIPPEQSKRPLGVDVQRGIGTAYKGHVKVPKPTGVKKGWQRAYAVVCDCKLFLYDLPEGKSTQPGVIASQVLDLRDDEFSVSSVLASDVIHATRRDIPCIFRVTASLLGAPSKTSSLLILTENENEKRKWVGILEGLQSILHKNRLRNQVVHVPLEAYDSSLPLIKAILTAAIVDADRIAVGLEEGLYVIEVTRDVIVRAADCKKVHQIELAPREKIVILLCGRNHHVHLYPWSSLDGAEGSFDIKLPETKGCQLMATATLKRNSGTCLFVAVKRLILCYEIQRTKPFHRKFNEIVAPGSVQCLAVLRDRLCVGYPSGFCLLSIQGDGQPLNLVNPNDPSLAFLSQQSFDALCAVELESEEYLLCFSHMGLYVDPQGRRARAQELMWPAAPVACSCSPTHVTVYSEYGVDVFDVRTMEWVQTIGLRRIRPLNSEGTLNLLNCEPPRLIYFKSKFSGAVLNVPDTSDNSKKQMLRTRSKRRFVFKVPEEERLQQRREMLRDPELRSKMISNPTNFNHVAHMGPGDGMQVLMDLPLSAVPPSQEERPGPAPTNLARQPPSRNKPYISWPSSGGSEPSVTVPLRSMSDPDQDFDKEPDSDSTKHSTPSNSSNPSGPPSPNSPHRSQLPLEGLEQPACDT

SEQ ID NO: 838060 - protein, 220 aa, Homo sapiens
MEWVQTIGLRRIRPLNSEGTLNLLNCEPPRLIYFKSKFSGAVLNVPDTSDNSKKQMLRTRSKRRFVFKVPEEERLQQRREMLRDPELRSKMISNPTNFNHVAHMGPGDGMQVLMDLPLSAVPPSQEERPGPAPTNLARQPPSRNKPYISWPSSGGSEPSVTVPLRSMSDPDQDFDKEPDSDSTKHSTPSNSSNPSGPPSPNSPHRSQLPLEGLEQPACDT

SEQ ID NO: 838061 - protein, 132 aa, Homo sapiens
GLVANSARGFNHVAHMGPGDGMQVLMDLPLSAVPPSQEERPGPAPTNLARQPPSRNKPYISWPSSGGSEPSVTVPLRSMSDPDQDFDKEPDSDSTKHSTPSNSSNPSGPPSPNSPHRSQLPLEGLEQPACDT

SEQ ID NO: 838062 - protein, 1711 aa, Homo sapiens; identical to SEQ ID NO: 838047

SEQ ID NO: 838063 - protein, 246 aa, Homo sapiens
MSAKVRLKKLEQLLLDGPWRNESALSVETLLDVLVCLYTECSHSALRRDKYVAEFLEWAKPFTQLVKEMQLHREDFEIIKVIGRGAFGEVAVVKMKNTERIYAMKILNKWEMLKRAETACFREERDVLVNGDCQWITALHYAFQDENHLYLVMDYYVGGDLLTLLSKFEDKLPEDMARFYIGEMVLAIDSIHQLHYVHRDIKPDNVLLDVNGHIRLADFGSCLKMNDDGTVGIFVGDFPFGFGFGI

SEQ ID NO: 838064 - protein, 867 aa, Homo sapiens
GELKQEMVRTDVNLENGLEPAETHSMVRHKDGGYSEEEDVKTCARDSGYDSLSNRLSILDRLLHTHPIWLQLSLSEEEAAEVLQAQPPGIFLVHKSTKMQKKVLSLRLPCEFGAPLKEFAIKESTYTFSLEGSGISFADLFRLIAFYCISRDVLPFTLKLPYAISTAKSEAQLEELAQMGLNFWSSPADSKPPNLPPPHRPLSSDGVCPASLRQLCLINGVHSIKTRTPSELECSQTNGALCFINPLFLKVHSQDLSGGLKRPSTRTPNANGTERTRSPPPRPPPPAINSLHTSPRLARTETQTSMPETVNHNKHGNVALPGTKPTPIPPPRLKKQASFLEAEGGAKTLSGGRPGAGPELELGTAGSPGGAPPEAAPGDCTRAPPPSSESRPPCHGGRQRLSDMSISTSSSDSLEFDRSMPLFGYEADTNSSLEDYEGESDQETMAPPIKSKKKRSSSFVLPKLVKSQLQKVSGVFSSFMTPEKRMVRRIAELSRDKCTYFGCLVQDYVSFLQENKECHVSSTDMLQTIRQFMTQVKNYLSQSSELDPPIESLIPEDQIDVVLEKAMHKCILKPLKGHVEAMLKDFHMADGSWKQLKENLQLVRQRNPQELGVFAPTPDFVDVEKIKVKFMTMQKMYSPEKKVMLLLRVCKLIYTVMENNSGRMYGADDFLPVLTYVIAQCDMLELDTEIEYMMELLDPSLLHGEGGYYLTSAYGALSLIKNFQEEQAARLLSSETRDTLRQWHKRRTTNRTIPSVDDFQNYLRVAFQEVNSGCTGKTLLVRPYITTEDVCQICAEKFKVGDPEEYSLFLFVDETWQQLAEDTYPQKIKAELHSRPQPHIFHFVYKRIKNDPYGIIFQNGEEDLTTS

SEQ ID NO: 838065 - protein, 843 aa, Homo sapiens
GELKQEMVRTDVNLENGLEPAETHSMVRHKDGGYSEEEDVKTCARDSGYDSLSNRLSILDRLLHTHPIWLQLSLSEEEAAEVLQAQPPGIFLVHKSTKMQKKVLSLRLPCEFGAPLKEFAIKESTYRMFYHLPVKLPYAISTAKSEAQLEELAQMGLNFWSSPADSKPPNLPPPHRPLSSDGVCPASLRQLCLINGVHSIKTRTPSELECSQTNGALCFINPLFLKVHSQDLSGGLKRPSTRTPNANGTERTRSPPPRPPPPAINSLHTSPRLARTETQTSMPETVNHNKHGNVALPGTKPTPIPPPRLKKQASFLEAEGGAKTLSGGRPGAGPELELGTAGSPGGAPPEAAPGDCTRAPPPSSESRPPCHGGRQRLSDMSISTSSSDSLEFDRSMPLFGYEADTNSSLEDYEGESDQETMAPPIKSKKKRSSSFVLPKLVKSQLQKVSGVFSSFMTPEKRMVRRIAELSRDKCTYFGCLVQDYVSFLQENKECHVSSTDMLQTIRQFMTQVKNYLSQSSELDPPIESLIPEDQIDVVLEKAMHKCILKPLKGHVEAMLKDFHMADGSWKQLKENLQLVRQRNPQELGVFAPTPDFVDVEKIKVKFMTMQKMYSPEKKVMLLLRVCKLIYTVMENNSGRMYGADDFLPVLTYVIAQCDMLELDTEIEYMMELLDPSLLHGEGGYYLTSAYGALSLIKNFQEEQAARLLSSETRDTLRQWHKRRTTNRTIPSVDDFQNYLRVAFQEVNSGCTGKTLLVRPYITTEDVCQICAEKFKVGDPEEYSLFLFVDETWQQLAEDTYPQKIKAELHSRPQPHIFHFVYKRIKNDPYGIIFQNGEEDLTTS

SEQ ID NO: 838066 - protein, 140 aa, Homo sapiens
MSIVRKQMLHFFFLQTIVIVATLSLADVVLEKAMHKCILKPLKGHVEAMLKDFHMADGSWKQLKENLQLVRQRNPQELGVFAPTPDFVDVEKIKVKFMTMQKMYSPEKKVMLLLRVCKLIYTVMENNSGEAAGSPGFVPL

SEQ ID NO: 838067 - protein, 843 aa, Homo sapiens; identical to SEQ ID NO: 838065

SEQ ID NO: 838068 - protein, 843 aa, Homo sapiens; identical to SEQ ID NO: 838065

SEQ ID NO: 838069 - protein, 892 aa, Homo sapiens
MSERAADDVRGEPRRAAAAAGGAAAAAARQQQQQQQQQQPPPPQPQRQQHPPPPPRRTRPEDGGPGAASTSAAAMATVGERRPLPSPEVMLGQSWNLWVEASKLPGKDGTELDESFKEFGKNREVMGLCREDMPIFGFCPAHDDFYLVVCNDCNQVVKPQAFQSHYERRHSSSSKPPLAVPPTSVFSFFPSLSKSKGGSASGSNRSSSGGVLSASSSSSKLLKSPKEKLQLRGNTRPMHPIQQSRVPHGRIMTPSVKVEKIHPKMDGTLLKSAVGPTCPATVSSLVKPGLNCPSIPKPTLPSPGQILNGKGLPAPPTLEKKPEDNSNNRKFLNKRLSEREFDPDIHCGVIDLDTKKPCTRSLTCKTHSLTQRRAVQGRRKRFDVLLAEHKNKTREKELIRHPDSQQPPQPLRDPHPAPPRTSQEPHQNPHGVIPSESKPFVASKPKPHTPSLPRPPGCPAQQGGSAPIDPPPVHESPHPPLPATEPASRLSSEEGEGDDKEESVEKLDCHYSGHHPQPASFCTFGSRQIGRGYYVFDSRWNRLRCALNLMVEKHLNAQLWKKIPPVPSTTSPISTRIPHRTNSVPTSQCGVSYLAAATVSTSPVLLSSTCISPNSKSVPAHGTTLNAQPAASGAMDPVCSMQSRQVSSSSSSPSTPSGLSSVPSSPMSRKPQKLKSSKSLRPKESSGNSTNCQNASSSTSGGSGKKRKNSSPLLVHSSSSSSSSSSSSHSMESFRKNCVAHSGPPYPSTVTSSHSIGLNCVTNKANAVNVRHDQSGRGPPTGSPAESIKRMSVMVNSSDSTLSLGPFIHQSNELPVNSHGSFSHSHTPLDKLIGKKRKCSPSSSSINNSSSKPTKVAKVPAMNNVHMKHTGTIPGAQGLMNSSLLHQPKARP

SEQ ID NO: 838070 - protein, 892 aa, Homo sapiens; identical to SEQ ID NO: 838069

SEQ ID NO: 838071 - protein, 945 aa, Homo sapiens
MSERAADDVRGEPRRAAAAAGGAAAAAARQQQQQQQQQQPPPPQPQRQQHPPPPPRRTRPEDGGPGAASTSAAAMATVGERRPLPSPEVMLGQSWNLWVEASKLPGKDGTELDESFKEFGKNREVMGLCREDMPIFGFCPAHDDFYLVVCNDCNQVVKPQAFQSHYERRHSSSSKPPLAVPPTSVFSFFPSLSKSKGGSASGSNRSSSGGVLSASSSSSKLLKSPKEKLQLRGNTRPMHPIQQSRVPHGRIMTPSVKVEKIHPKMDGTLLKSAVGPTCPATVSSLVKPGLNCPSIPKPTLPSPGQILNGKGLPAPPTLEKKPEDNSNNRKFLNKRLSEREFDPDIHCGVIDLDTKKPCTRSLTCKTHSLTQRRAVQGRRKRFDVLLAEHKNKTREKELIRHPDSQQPPQPLRDPHPAPPRTSQEPHQNPHGVIPSESKPFVASKPKPHTPSLPRPPGCPAQQGGSAPIDPPPVHESPHPPLPATEPASRLSSEEGEGDDKEESVEKLDCHYSGHHPQPASFCTFGSRQIGRGYYVFDSRWNRLRCALNLMVEKHLNAQLWKKIPPVPSTTSPISTRIPHRTNSVPTSQCGVSYLAAATVSTSPVLLSSTCISPNSKSVPAHGTTLNAQPAASGAMDPVCSMQSRQVSSSSSSPSTPSGLSSVPSSPMSRKPQKLKSSKSLRPKESSGNSTNCQNASSSTSGGSGKKRKNSSPLLVHSSSSSSSSSSSSHSMESFRKNCVAHSGPPYPSTVTSSHSIGLNCVTNKANAVNVRHDQSGRGPPTGSPAESIKRMSVMVNSSDSTLSLGPFIHQSNELPVNSHGSFSHSHTPLDKLIGKKRKCSPSSSSINNSSSKPTKVAKVPAMNNVHMKHTGTIPGAQGLMNSSLLHQDISSPCLRTGISATSPQSPDLKSKGTSLTAENSTGRNNADTFEDKLHLHSALWTPRCL

SEQ ID NO: 838072 - protein, 346 aa, Homo sapiens
MAVVSVIHCPLIFFRKIPPVPSTTSPISTRIPHRTNSVPTSQCGVSYLAAATVSTSPVLLSSTCISPNSKSVPAHGTTLNAQPAASGAMDPVCSMQSRQVSSSSSSPSTPSGLSSVPSSPMSRKPQKLKSSKSLRPKESSGNSTNCQNASSSTSGGSGKKRKNSSPLLVHSSSSSSSSSSSSHSMESFRKNCVAHSGPPYPSTVTSSHSIGLNCVTNKANAVNVRHDQSGRGPPTGSPAESIKRMSVMVNSSDSTLSLGPFIHQSNELPVNSHGSFSHSHTPLDKLIGKKRKCSPSSSSINNSSSKPTKVAKVPAMNNVHMKHTGTIPGAQGLMNSSLLHQPKARP

SEQ ID NO: 838073 - protein, 892 aa, Homo sapiens; identical to SEQ ID NO: 838069

SEQ ID NO: 838074 - protein, 454 aa, Homo sapiens
MSERAADDVRGEPRRAAAAAGGAAAAAARQQQQQQQQQQPPPPQPQRQQHPPPPPRRTRPEDGGPGAASTSAAAMATVGERRPLPSPEVMLGQSWNLWVEASKLPGKDGTELDESFKEFGKNREVMGLCREDMPIFGFCPAHDDFYLVVCNDCNQVVKPQAFQSHYERRHSSSSKPPLAVPPTSVFSFFPSLSKSKGGSASGSNRSSSGGVLSASSSSSKLLKSPKEKLQLRGNTRPMHPIQQSRVPHGRIMTPSVKVEKIHPKMDGTLLKSAVGPTCPATVSSLVKPGLNCPSIPKPTLPSPGQILNGKGLPAPPTLEKKPEDNSNNRKFLNKRLSEREFDPDIHCGVIDLDTKKPCTRSLTCKTHSLTQRRAVQGRRKRFDVLLAEHKNKTREKELIRHPDSQQPPQPLRDPHPAPPRTSQEPHQNPHGVIPSESKPFVASKPKPHTPSLPR

SEQ ID NO: 838075 - protein, 892 aa, Homo sapiens
MSERAADDVRGEPRRAAAAAGGAAAAAARQQQQQQQQQQPPPPQPQRQQHPPPPPRRTRPEDGGPGAASTSAAAMATVGERRPLPSPEVMLGQSWNLWVEASKLPGKDGTELDESFKEFGKNREVMGLCREDMPIFGFCPAHDDFYLVVCNDCNQVVKPQAFQSHYERRHSSSSKPPLAVPPTSVFSFFPSLSKSKGGSASGSNRSSSGGVLSASSSSSKLLKSPKEKLQLRGNTRPMHPIQQSRVPHGRIMTPSVKVEKIHPKMDGTLLKSAVGPTCPATVSSLVKPGLNCPSIPKPTLPSPGQILNGKGLPAPPTLEKKPEDNSNNRKFLNKRLSEREFDPDIHCGVIDLDTKKPCTRSLTCKTHSLTQRRAVQGRRKRFDVLLAEHKNKTREKELIRHPDSQQPPQPLRDPHPAPPRTSQEPHQNPHGVIPSESKPFVASKPKPHTPSLPRPPGCPAQQGGSAPIDPPPVHESPHPPLPATEPASRLSSEEGEGDDKEESVEKLDCHYSGHHPQPASFCTFGSRQIGRGYYVFDSRWNRLRCALNLMVEKHLNAQLWKKIPPVPSTTSPISTRIPHRTNSVPTSQCGVSYLAAATVSTSPVLLSSTCISPNSKSVPAHGTTLNAQPAASGAMDPVCSMQSRQVSSSSSSPSTPSGLSSVPSSPMSRKPQKLKSSKSLRPKESSGNSTNCQNASSSTSGGSGKKRKNSSPLLVHSSSSSSSSSSSSHSMESFRKNCVAHSGPPYPSTVTSSHSIGLNCVTNKANAVNVRHDQSGRGPPTGSPAESIKRMSVMVNSSDSTLSLGPFIHQSNELPVNSHGSFSHSHTPLDKLIGKKRKCSPSSSSINNSSSKPTKVAKVPAMNNVHMKHTGTIPGAQGLMNSSLLHQVGNGL

SEQ ID NO: 838076 - protein, 874 aa, Homo sapiens
MSERAADDVRGEPRRAAAAAGGAAAAAARQQQQQQQQQQPPPPQPQRQQHPPPPPRRTRPEDGGPGAASTSAAAMATVGERRPLPSPEVMLGQSWNLWVEASKLPGKDGTELDESFKEFGKNREVMGLCREDMPIFGFCPAHDDFYLVVCNDCNQVVKPQAFQSHYERRHSSSSKPPLAVPPTSVFSFFPSLSKSKGGSASGSNRSSSGGVLSASSSSSKLLKSPKEKLQLRGNTRPMHPIQQSRVPHGRIMTPSVKVEKIHPKMDGTLLKSAVGPTCPATVSSLVKPGLNCPSIPKPTLPSPGQILNGKGLPAPPTLEKKPEDNSNNRKFLNKRLSEREFDPDIHCGVIDLDTKKPCTRSLTCKTHSLTQRRAVQGRRKRFDVLLAEHKNKTREKELIRHPDSQQPPQPLRDPHPAPPRTSQEPHQNPHGVIPSESKPFVASKPKPHTPSLPRPPGCPAQQGGSAPIDPPPVHESPHPPLPATEPASRLSSEEGEGDDKEESVEKLDCHYSGHHPQPASFCTFGSRQIGRGYYVFDSRWNRLRCALNLMVEKHLNAQLWKKIPPVPSTTSPISTRIPHRTNSVPTSQCGVSYLAAATVSTSPVLLSSTCISPNSKSVPAHGTTLNAQPAASGAMDPVCSMQSRQVSSSSSSPSTPSGLSSVPSSPMSRKPQKLKSSKSLRPKESSGNSTNCQNASSSTSGGSGKKRKNSSPLLVHSSSSSSSSSSSSHSMESFRKNCVAHSGPPYPSTVTSSHSIGLNCVTNKANAVNVRHDQSGRGPPTGSPAESIKRMSVMVNSSDSTLSLGPFIHQSNELPVNSHGSFSHSHTPLDKLIGKKKVAKVPAMNNVHMKHTGTIPGAQGLMNSSLLHQPKARP

SEQ ID NO: 838077 - protein, 388 aa, Homo sapiens
MPVWESASTRLCFLLQFCTFGSRQIGRGYYVFDSRWNRLRCALNLMVEKHLNAQLWKKIPPVPSTTSPISTRIPHRTNSVPTSQCGVSYLAAATVSTSPVLLSSTCISPNSKSVPAHGTTLNAQPAASGAMDPVCSMQSRQVSSSSSSPSTPSGLSSVPSSPMSRKPQKLKSSKSLRPKESSGNSTNCQNASSSTSGGSGKKRKNSSPLLVHSSSSSSSSSSSSHSMESFRKNCVAHSGPPYPSTVTSSHSIGLNCVTNKANAVNVRHDQSGRGPPTGSPAESIKRMSVMVNSSDSTLSLGPFIHQSNELPVNSHGSFSHSHTPLDKLIGKKRKCSPSSSSINNSSSKPTKVAKVPAMNNVHMKHTGTIPGAQGLMNSSLLHQPKARP

SEQ ID NO: 838078 - protein, 561 aa, Homo sapiens
MSERAADDVRGEPRRAAAAAGGAAAAAARQQQQQQQQQQPPPPQPQRQQHPPPPPRRTRPEDGGPGAASTSAAAMATVGERRPLPSPEVMLGQSWNLWVEASKLPGKDGTELDESFKEFGKNREVMGLCREDMPIFGFCPAHDDFYLVVCNDCNQVVKPQAFQSHYERRHSSSSKPPLAVPPTSVFSFFPSLSKSKGGSASGSNRSSSGGVLSASSSSSKLLKSPKEKLQLRGNTRPMHPIQQSRVPHGRIMTPSVKVEKIHPKMDGTLLKSAVGPTCPATVSSLVKPGLNCPSIPKPTLPSPGQILNGKGLPAPPTLEKKPEDNSNNRKFLNKRLSEREFDPDIHCGVIDLDTKKPCTRSLTCKTHSLTQRRAVQGRRKRFDVLLAEHKNKTREKELIRHPDSQQPPQPLRDPHPAPPRTSQEPHQNPHGVIPSESKPFVASKPKPHTPSLPRPPGCPAQQGGSAPIDPPPVHESPHPPLPATEPASRLSSEEGEGDDKEESVEKLDCHYSGHHPQPASFCTFGSRQIGRGYYVFDSRWNRLRCALNLMVEKHLNAQLWK

SEQ ID NO: 838079 - protein, 591 aa, Homo sapiens
MSERAADDVRGEPRRAAAAAGGAAAAAARQQQQQQQQQQPPPPQPQRQQHPPPPPRRTRPEDGGPGAASTSAAAMATVGERRPLPSPEVMLGQSWNLWVEASKLPGKDGTELDESFKEFGKNREVMGLCREDMPIFGFCPAHDDFYLVVCNDCNQVVKPQAFQSHYERRHSSSSKPPLAVPPTSVFSFFPSLSKSKGGSASGSNRSSSGGVLSASSSSSKLLKSPKEKLQLRGNTRPMHPIQQSRVPHGRIMTPSVKVEKIHPKMDGTLLKSAVGPTCPATVSSLVKPGLNCPSIPKPTLPSPGQILNGKGLPAPPTLEKKPEDNSNNRKFLNKRLSEREFDPDIHCGVIDLDTKKPCTRSLTCKTHSLTQRRAVQGRRKRFDVLLAEHKNKTREKELIRHPDSQQPPQPLRDPHPAPPRTSQEPHQNPHGVIPSESKPFVASKPKPHTPSLPRPPGCPAQQGGSAPIDPPPVHESPHPPLPATEPASRLSSEEGEGDDKEESVEKLDCHYSGHHPQPASFCTFGSRQIGRGYYVFDSRWNRLRCALNLMVEKHLNAQLWKKIPPVPSTTSPISTRIPHQILGSRHNLRYR

SEQ ID NO: 838080 - protein, 113 aa, Homo sapiens
MDTCEMVECASSLNSRSQDLGAFCFQKPDLIFIKSAPPLSQPGCPSRPGQQRCLARQGGAETGEPLGRLLWARWQRGGWLLFPALILAFSRLPHTTGFHFHPWVKRKAEIKSF

SEQ ID NO: 838081 - protein, 80 aa, Homo sapiens
LGVHRYKKLEGLNKRQAPVQVTSLLSDDPHWLCHISGAEWMHNTSVLIWASMQLFNLKNDGMNNPAYGFQTENSELKALV

SEQ ID NO: 838082 - protein, 544 aa, Homo sapiens
RCSGSSRFILSVLCPVLIEARPLWPCDLQVLGEPQLNPGTPGSLEMGPLQFRDVAIEFSLEEWHCLDTAQRNLYRDVMLENYRNLVFLGIVVSKPDLVTCLEQGKKPLTMERHEMIAKPPVMSSHFAQDLWPENIQNSFQIGMLRRYEECRHDNLQLKKGCKSVGEHKVHKGGYNGLNQCLTTTQKEIFQCDKYGKVFHKFSNSNTYKTRHTGINLFKCIICGKAFKRSSTLTTHKKIHTGEKPYRCEECGKAFNQSANLTTHKRIHTGEKPYRCEECGKAFKQSSNLTTHKKIHTGEKPYKCEECGKAFNRSTDLTTHKIVHTGEKPYKCEECGKAFKHPSHVTTHKKIHTRGKPYNCEECGKSFKHCSNLTIHKRIHTGEKPYKCEECGKAFHLSSHLTTHKILHTGEKPYRCRECGKAFNHSTTLFSHEKIHTGEKPYKCDECGKTFTWPSILSKHKRTHTGEKPYKCEECGKSFTASSTLTTHKRIHTGEKPYKCEECGKAFNWSSDLNKHKKIHIERKPYIVKNVTDLLNVPPLLISIR

SEQ ID NO: 838083 - protein, 275 aa, Homo sapiens
RCSGSSRFILSVLCPVLIEARPLWPCDLQVLGEPQLNPGTPGSLEMGPLQFRDVAIEFSLEEWHCLDTAQRNLYRDVMLENYRNLVFLGIVVSKPDLVTCLEQGKKPLTMERHEMIAKPPVMSSHFAQDLWPENIQNSFQIGMLRRYEECRHDNLQLKKGCKSVGEHKVHKGGYNGLNQCLTTTQKEIFQCDKYGKVFHKFSNSNTYKTRHTGINLFKCIICGKAFKRSSTLTTHKKIHTGEKPYRCEECGKAFNQSANLTTHKRIHTGEKPLQM

SEQ ID NO: 838084 - protein, 275 aa, Homo sapiens; identical to SEQ ID NO: 838083

SEQ ID NO: 838085 - protein, 275 aa, Homo sapiens; identical to SEQ ID NO: 838083

SEQ ID NO: 838086 - protein, 104 aa, Homo sapiens
MRAVGLWGSPGVLRWLPTVLAFVCHLHRVSRSVSWEVFLGLCAVISRHTLEPFRAPWTSPAFPSWVLGQPLVCPTSAPASGSCRVKQLPLVPFDKSPQELGCFH

SEQ ID NO: 838087 - protein, 78 aa, Homo sapiens
GLRLYPLNTAKVAAFWQAELTGLSSATTAGAAGMSWEEGSIAVAFVYQRPFQREICRGKERLPSRLGSELFLLETCGC

SEQ ID NO: 838088 - protein, 82 aa, Homo sapiens
MLLIFGVELQAGDLEGPRSACSHPLTSRKRRNVGLEPMKSTGIWLCSVTLDKSLPLSGLQFPPCSMRAGDFVCFIHNVFPEL

SEQ ID NO: 838089 - protein, 131 aa, Homo sapiens
ISELMQTEMHHIQTLFIMSEIFRKGMKEELQLDHSTVDKIFPCLDELLEIHRHFFYSMKERRQESCAGSDRNFVIDRIGDILVQQFSEENASKMKKIYGEFCCHHKEAVNLFKELQQNKKFQNFIKASILK

SEQ ID NO: 838090 - protein, 1094 aa, Homo sapiens
QTETDRMDFLRLYLPGLHQALRGALDSLGTFVSYLLGDAVPTVEREAQAAEELGVVAVGKTGKIVEEEAQEDLEGLRGSQNEGAGRLRGPGDDRRHEVGSSAVEQTWGWGDGSSHGSQAERQDSGAGETAKAARCQEPSAHLEARKKSKAGSGACQDRSGQAQERQESHEQEVNREERLRSWEQEEEEEEVRAREPGMARGAESEWTWHGETEGKAGAVGPKAAGDNREMEQGVREADAGETEEPGAEGAGKGEEVVVVEKACESTRAWGTWGPGAEPEDWGILGREEARTTPGREEARAILDGEEARTISGGEEAETASGGEEAETASGGEEAGTASGGEEAGISSGGEAGTASGGEEAGTASGGDEAWTTSGKEEADLLGVRQTQYGAVPGERLLEATGKVWVLEEEGDEEREAEVSPFPKQAQVLGTERTEEAAESQTAGREAVGGQEAGESFEGQVDLRGKEAEMRQDLGIRADRARMEELVQAEEAQEERGSSRDPVAELPSDGEAEGTADLEATPEARPEEELTGEESEAAQTSCGLLGVEWGGLTHSVTKGQGPELMGGAQTPTKQPEEREAGEVELMGVLALSKEEQERSLEAGPRHAGSVKPEASEAFPGAWENRTRKDMERGNTQEDAADGEQREEEETAGGQTLAAEAEGDRESELSEVPEAGGEGLTTQDAGCGTEEGEASVSENQELDGSTGADAGPCPSLGEAYARETEDEEAEADRTSRRGWRLQAVAVGLPDREDAQTGSVAAGIMGGDVVPHISAAGAGEALEGALGQGWDSKEKEEAAAGEHAGGQEFGLEGSAEEEVTGRGSQVEAFESREGGPWGGRVEAEESAGAEDSCGLDPAGSQTARAEGMGAMVEAGGLLEKWTLLEEEAVGWQEREQREDSEGRCGDYHPEGEAPRLLDAEGLMVTGGRRAEAKETEPESLEHVRGQEEQPTHQAPAEAAPESVGEAETAEAMGSARGGAANSWSEAPLPGSLLDVSVPRSRVHLSRSSSQRRSRPSFRRTPAWEQQEEPPAPNPPEEELSAPEQRPLQLEEPLEPSPLRHDGTPVPARRRPLGHGFGLAHPGMMQELQARLGRPKPQ

SEQ ID NO: 838091 - protein, 128 aa, Homo sapiens
ILISDKTNFKATMVKTDKEEHYIMVKGLVQQENIKILNIYAPNTGAHQFTKQLLTDLRNETDSNTIIVGDFNTPLTALDRSSRQKVNKETIDLNYTLEQMDLTDIYRTFHPTTAEYTSIQQHMELSPR

SEQ ID NO: 838092 - protein, 1159 aa, Homo sapiens
SAAAAAAEMSRRKQSKPRQIKRPLEDAIEDEEEECPSEETDIISKGDFPLEESFSTEFGPENLSCEEVEYFCNKGDDEGIQETAESDGDTQSEKPGQPGVETDDWDGPGELEVFQKDGERKIQSRQQLPVGTTWGPFPGKMDLNNNSLKTKAQVPMVLTAGPKWLLDVTWQGVEDNKNNCIVYSKGGQLWCTTTKAISEGEELIAFVVDFDSRLQAASQMTLTEGMYPARLLDSIQLLPQQAAMASILPTAIVNKDIFPCKSCGIWYRSERNLQAHLMYYCSGRQREAAPVSEENEDSAHQISSLCPFPQCTKSFSNARALEMHLNSHSGVKMEEFLPPGASLKCTVCSYTADSVINFHQHLFSHLTQAAFRCNHCHFGFQTQRELLQHQELHVPSGKLPRESDMEHSPSATEDSLQPATDLLTRSELPQSQKAMQTKDASSDTELDKCEKKTQLFLTNQRPEIQPTTNKQSFSYTKIKSEPSSPRLASSPVQPNIGPSFPVGPFLSQFSFPQDITMVPQASEILAKMSELVHRRLRHGSSSYPPVIYSPLMPKGATCFECNITFNNLDNYLVHKKHYCSSRWQQMAKSPEFPSVSEKMPEALSPNTGQTSINLLNPAAHSADPENPLLQTSCINSSTVLDLIGPNGKGHDKDFSTQTKKLSTSSNNDDKINGKPVDVKNPSVPLVDGESDPNKTTCEACNITFSRHETYMVHKQYYCATRHDPPLKRSASNKVPAMQRTMRTRKRRKMYEMCLPEQEQRPPLVQQRFLDVANLNNPCTSTQEPTEGLGECYHPRCDIFPGIVSKHLETSLTINKCVPVSKCDTTHSSVSCLEMDVPIDLSKKCLSQSERTTTSPKRLLDYHECTVCKISFNKVENYLAHKQNFCPVTAHQRNDLGQLDGKVFPNPESERNSPDVSYERSIIKCEKNGNLKQPSPNGNLFSSHLATLQGLKVFSEAAQLIATKEENRHLFLPQCLYPGAIKKAKGADQLSPYYGIKPSDYISGSLVIHNTDIEQSRNAENESPKGQASSNGCAALKKDSLPLLPKNRGMVIVNGGLKQDERPAANPQQENISQNPQHEDDHKSPSWISENPLAANENVSPGIPSAEEQLSSIAKGVNGSSQAPTSGKYCRLCDIQFNNLSNFITHKKFYCSSHAAEHVK

SEQ ID NO: 838093 - protein, 149 aa, Homo sapiens
MDLNNNSLKTKAQVPMVLTAGPKWLLDVTWQGVEDNKNNCIVYSKGGQLWCTTTKAISEGEELIAFVVDFDSRLQAASQMTLTEGMYPARLLDSIQLLPQQAAMASILPTAIVNSKCSVLCSPALEVMGIYGRKKCLLTRNQEQTFFLQ

SEQ ID NO: 838094 - protein, 329 aa, Homo sapiens
LVLEAFQEQVWAEMCSIKAVTAIEKQREENSSEASDVETKLREFEDLQMQLNTSIDLRTNVLNHAYENLTRYKEAVTRAVESITSLEAIIIPYRVDVGNPEESLEMPLRKQEELESTVARIQDLTEKLGMISSPEAKLQLQYTLQELVSKNSAMKEAFKAQETEAERYLENYKCYRKMEEDIYTNLSKMETVLGQSMSSLPLSYREALERLEQSKALVSNLISTKEELMKLRQILRLLRLRCTENDGICLLKMVSALWEKWLSLLEAAKEWEMWCEELKQEWKFVSEEIEREAIILDNLQEELPEISKTKEAATTEELSELLDCLCQYG

SEQ ID NO: 838095 - protein, 349 aa, Homo sapiens
MTAASMGPVRVAFVVLLALCSRPAVGQNCSGPCRCPDEPAPRCPAGVSLVLDGCGCCRVCAKQLGELCTERDPCDPHKGLFCDFGSPANRKIGVCTAKDGAPCIFGGTVYRSGESFQSSCKYQCTCLDGAVGCMPLCSMDVRLPSPDCPFPRRVKLPGKCCEEWVCDEPKDQTVVGPALAAYRLEDTFGPDPTMIRANCLVQTTEWSACSKTCGMGISTRVTNDNASCRLEKQSRLCMVRPCEADLEENIKKGKKCIRTPKISKPIKFELSGCTSMKTYRAKFCGVCTDGRCCTPHRTTTLPVEFKCPDGEVMKKNMMFIKTCACHYNCPGDNDIFESLYYRKMYGDMA

SEQ ID NO: 838096 - protein, 208 aa, Homo sapiens
MTAASMGPVRVAFVVLLALCSRPAVGQNCSGPCRCPDEPAPRCPAGVSLVLDGCGCCRVCAKQLGELCTERDPCDPHKGLFCDFGSPANRKIGVCTAKDGAPCIFGGTVYRSGESFQSSCKYQCTCLDGAVGCMPLCSMDVRLPSPDCPFPRRVKLPGKCCEEWVCDEPKDQTVVGPALAYQNWKTRFGPKPKLIELEAKLGLVQEPT

SEQ ID NO: 838097 - protein, 191 aa, Homo sapiens
MTAASMGPVRVAFVVLLALCSRPAVGQNCSGPCRCPDEPAPRCPAGVSLVLDGCGCCRVCAKQLGELCTERDPCDPHKGLFCDFGSPANRKIGVCTAKDGAPCIFGGTVYRSGESFQSSCKYQCTCLDGAVGCMPLCSMDVSSGPKPLNCPPFPERKGFKSLPPGEKLLAKEIWGFLKRKPPKGPKNPVGG

SEQ ID NO: 838098 - protein, 104 aa, Homo sapiens
MTAASMGPVRVAFVVLLALCSRPAVGQNCSGPCRCPDEPAPRCPAGVSLVLDGCGCCRVCAKQLGELCTERDPCDPHKGLFCDFGSPANRKIGVCTGKTRSPHR

SEQ ID NO: 838099 - protein, 267 aa, Homo sapiens
MTAASMGPVRVAFVVLLALCSRPAVGQNCSGPCRCPDEPAPRCPAGVSLVLDGCGCCRVCAKQLGELCTERDPCDPHKGLFCDFGSPANRKIGVCTAKDGAPCIFGGTVYRSGESFQSSCKYQCTCLDGAVGCMPLCSMDVRLPSPDCPFPRRVKLPGKCCEEWVCDEPKDQTVVGPALAAYRLEDTFGPDPTMIRANCLVQTTEWSACSKTCGMGISTRVTNDNASCRLEKQSRLCMVRPCEADLEENIKVHVLLLLTIFHRKNSG

SEQ ID NO: 838100 - protein, 267 aa, Homo sapiens; identical to SEQ ID NO: 838099

SEQ ID NO: 838101 - protein, 203 aa, Homo sapiens
MTPFPRRVKLPGKCCEEWVCDEPKDQTVVGPALAAYRLEDTFGPDPTMIRANCLVQTTEWSACSKTCGMGISTRVTNDNASCRLEKQSRLCMVRPCEADLEENIKKGKKCIRTPKISKPIKFELSGCTSMKTYRAKFCGVCTDGRCCTPHRTTTLPVEFKCPDGEVMKKNMMFIKTCACHYNCPGDNDIFESLYYRKMYGDMA

SEQ ID NO: 838102 - protein, 349 aa, Homo sapiens; identical to SEQ ID NO: 838095

SEQ ID NO: 838103 - protein, 349 aa, Homo sapiens; identical to SEQ ID NO: 838095

SEQ ID NO: 838104 - protein, 349 aa, Homo sapiens; identical to SEQ ID NO: 838095

SEQ ID NO: 838105 - protein, 349 aa, Homo sapiens; identical to SEQ ID NO: 838095

SEQ ID NO: 838106 - protein, 349 aa, Homo sapiens; identical to SEQ ID NO: 838095

SEQ ID NO: 838107 - protein, 196 aa, Homo sapiens
MTAASMGPVRVAFVVLLALCSRPAVGQNCSGPCRCPDEPAPRCPAGVSLVLDGCGCCRVCAKQLGELCTERDPCDPHKGLFCDFGSPANRKIGVCTAKDGAPCIFGGTVYRSGESFQSSCKYQCTCLDGAVGCMPLCSMDVRLPSPDCPFPRRVKLPGKCCEEWVCDEPKDQTGWLLGYMKTCNTYKHVQQMFNMD

SEQ ID NO: 838108 - protein, 60 aa, Homo sapiens
MVRGRNRPRARAAQKASRSSDRTAAPHHTCTLDASQPTTHEQTSPIHTDARAPNTNHSQP

SEQ ID NO: 838109 - protein, 393 aa, Homo sapiens
MTAASMGPVRVAFVVLLALCSRPAVGQNCSGPCRCPDEPAPRCPAGVSLVLDGCGCCRVCAKQLGELCTERDPCDPHKGLFCDFGSPANRKIGVCTAKDGAPCIFGGTVYRSGESFQSSCKYQCTCLDGAVGCMPLCSMDVRLPSPDCPFPRRVKLPGKCCEEWVCDEPKDQTVVGPALAGESSLPLSQGRDSLPGRESYTVPTERGKYLIQAFYMVFVCSALAAYRLEDTFGPDPTMIRANCLVQTTEWSACSKTCGMGISTRVTNDNASCRLEKQSRLCMVRPCEADLEENIKKGKKCIRTPKISKPIKFELSGCTSMKTYRAKFCGVCTDGRCCTPHRTTTLPVEFKCPDGEVMKKNMMFIKTCACHYNCPGDNDIFESLYYRKMYGDMA

SEQ ID NO: 838110 - protein, 218 aa, Homo sapiens
MVLPASSVVRCTAAESPSRAAASTSARAWTGRWAACPCAAWTFVCPALTAYRLEDTFGPDPTMIRANCLVQTTEWSACSKTCGMGISTRVTNDNASCRLEKQSRLCMVRPCEADLEENIKKGKKCIRTPKISKPIKFELSGCTSMKTYRAKFCGVCTDGRCCTPHRTTTLPVEFKCPDGEVMKKNMMFIKTCACHYNCPGDNDIFESLYYRKMYGDMA

SEQ ID NO: 838111 - protein, 330 aa, Homo sapiens
MTAASMGPVRVAFVVLLALCSRPAVGQNCSGPCRCPDEPAPRCPAGVSLVLDGCGCCRVCAKQLGELCTERDPCDPHKGLFCDFGSPANRKIGVCTAKDGAPCIFGGTVYRSGESFQSSCKYQCTCLDGAVGCMPLCSMDVRLPSPDCPFPRRVKLPGKCCEEWVCDEPKDQTVVGPALAAYRLEDTFGPDPTMIRANCLVQTTEWSACSKTCGMGISTRVTNDNASCRLEKQSRLCMVRPCEADLEENIKKGKKCIRTYRAKFCGVCTDGRCCTPHRTTTLPVEFKCPDGEVMKKNMMFIKTCACHYNCPGDNDIFESLYYRKMYGDMA

SEQ ID NO: 838112 - protein, 349 aa, Homo sapiens; identical to SEQ ID NO: 838095

SEQ ID NO: 838113 - protein, 349 aa, Homo sapiens; identical to SEQ ID NO: 838095

SEQ ID NO: 838114 - protein, 580 aa, Homo sapiens
WLCACPERVARACVFRPEDMMQGEAHPSASLIDRTIKMRKETEARKVVLAWGLLNVSMAGMIYTEMTGKLISSYYNVTYWPLWYIELALASLFSLNALFDFWRYFKYTVAPTSLVVSPGQQTLLGLKTAVVQTTPPHDLAATQIPPAPPSPSIQGQSVLSYSPSRSPSTSPKFTTSCMTGYSPQLQGLSSGGSGSYSPGVTYSPVSGYNKLASFSPSPPSPYPTTVGPVESSGLRSRYRSSPTVYNSPTDKEDYMTDLRTLDTFLRSEEEKQHRVKLGSPDSTSPSSSPTFWNYSRSMGDYAQTLKKFQYQLACRSQAPCANKDEADLSSKQAAEEVWARVAMNRQLLDHMDSWTAKFRNWINETILVPLVQEIESVSTQMRRMGCPELQIGEASITSLKQAALVKAPLIPTLNTIVQYLDLTPNQEYLFERIKELSQGGCMSSFRWNRGGDFKGRKWDTDLPTDSAIIMHVFCTYLDSRLPPHPKYPDGKTFTSQHFVQTPNKPDVTNENVFCIYQSAINPPHYELIYQRHVYNLPKGRNNMFHTLLMFLYIIKTKESGMLGRVNLGLSGVNILWIFGE

SEQ ID NO: 838115 - protein, 580 aa, Homo sapiens; identical to SEQ ID NO: 838114

SEQ ID NO: 838116 - protein, 580 aa, Homo sapiens; identical to SEQ ID NO: 838114

SEQ ID NO: 838117 - protein, 533 aa, Homo sapiens
HLEDLPGSSLAAKVIYTEMTGKLISSYYNVTYWPLWYIELALASLFSLNALFDFWRYFKYTVAPTSLVVSPGQQTLLGLKTAVVQTTPPHDLAATQIPPAPPSPSIQGQSVLSYSPSRSPSTSPKFTTSCMTGYSPQLQGLSSGGSGSYSPGVTYSPVSGYNKLASFSPSPPSPYPTTVGPVESSGLRSRYRSSPTVYNSPTDKEDYMTDLRTLDTFLRSEEEKQHRVKLGSPDSTSPSSSPTFWNYSRSMGDYAQTLKKFQYQLACRSQAPCANKDEADLSSKQAAEEVWARVAMNRQLLDHMDSWTAKFRNWINETILVPLVQEIESVSTQMRRMGCPELQIGEASITSLKQAALVKAPLIPTLNTIVQYLDLTPNQEYLFERIKELSQGGCMSSFRWNRGGDFKGRKWDTDLPTDSAIIMHVFCTYLDSRLPPHPKYPDGKTFTSQHFVQTPNKPDVTNENVFCIYQSAINPPHYELIYQRHVYNLPKGRNNMFHTLLMFLYIIKTKESGMLGRVNLGLSGVNILWIFGE

SEQ ID NO: 838118 - protein, 222 aa, Homo sapiens
WLCACPERVARACVFRPEDMMQGEAHPSASLIDRTIKMRKETEARKVVLAWGLLNVSMAGMIYTEMTGKLISSYYNVTYWPLWYIELALASLFSLNALFDFWRYFKYTVAPTSLVVSPGQQTLLGLKTAVVQTTPPHDLAATQIPPAPPSPSIQGQSVLSYSPSRSPSTSPKFTTSCMTGYSPQLQGLSSGGSGSYSPGVTYSPVSGYNKVMTLFSCLVTLF

SEQ ID NO: 838119 - protein, 590 aa, Homo sapiens
WLCACPERVARACVFRPEDMMQGEAHPSASLIDRTIKMRKETEARKVVLAWGLLNVSMAGMIYTEMTGKLISSYYNVTYWPLWYIELALASLFSLNALFDFWRYFKYTVAPTSLVVSPGQQTLLGLKTAVVQTTPPHDLAATQIPPAPPSPSIQGQSVLSYSPSRSPSTSPKFTTSCMTGYSPQLQGLSSGGSGSYSPGVTYSPVSGYNKLASFSPSPPSPYPTTVGPVESSGLRSRYRSSPTVYNSPTDKEDYMTDLRTLDTFLRSEEEKQHRVKLGSPDSTSPSSSPTFWNYSRSMGDYAQTLKKFQYQLACRSQAPCANKDEADLSSKQAAEEVWARVAMNRQLLDHMDSWTAKFRNWINETILVPLVQEIESVSTQMRRMGCPELQIGEASITSLKQAALVKAPLIPTLNTIVQYLDLTPNQEYLFERIKAFKNFTLFATELSQGGCMSSFRWNRGGDFKGRKWDTDLPTDSAIIMHVFCTYLDSRLPPHPKYPDGKTFTSQHFVQTPNKPDVTNENVFCIYQSAINPPHYELIYQRHVYNLPKGRNNMFHTLLMFLYIIKTKESGMLGRVNLGLSGVNILWIFGE

SEQ ID NO: 838120 - protein, 470 aa, Homo sapiens
WLCACPERVARACVFRPEDMMQGEAHPSASLIDRTIKMRKETEARKVVLAWGLLNVSMAGMIYTEMTGKLISSYYNVTYWPLWYIELALASLFSLNALFDFWRYFKYTVAPTSLVVSPGQQTLLGLKTAVVQTTPPHDLAATQIPPAPPSPSIQGQSVLSYSPSRSPSTSPKFTTSCMTGYSPQLQGLSSGGSGSYSPGVTYSPVSGYNKLASFSPSPPSPYPTTVGPVESSGLRSRYRSSPTVYNSPTDKEDYMTDLRTLDTFLRSEEEKQHRVKLGSPDSTSPSSSPTFWNYSRSMGDYAQTLKKFQYQLACRSQAPCANKDEADLSSKQAAEEVWARVAMNRQLLDHMDSWTAKFRNWINETILVPLVQEIESVSTQMRRMGCPELQIGEASITSLKQAALVKAPLIPTLNTIVQYLDLTPNQEYLFERIKELSQGGCMSSFRWNRGGDFKGRKWDTDLPTDSAVSP

SEQ ID NO: 838121 - protein, 69 aa, Homo sapiens
NLLIFLPSAPMSGAVLDAQNAKAREASQSESPMGLGLLAVDCSADDFLSLVEKLKEGIAGKGDGGSRGL

SEQ ID NO: 838122 - protein, 811 aa, Homo sapiens
MHELVRQGVRSLILTSGTLAPVSSFALEMQMYGPPLPGPEHRDTSDISGVEVVGVPMSRVLGVSGLEGYRGAGALPHCLLPLATLSPFPVCLENPHIIDKHQIWVGVVPRGPDGAQLSSAFDRRFSEECLSSLGKALGNIARVVPYGLLIFFPSYPVMEKSLEFWRARDLARKMEALKPLFVEPRSKGSFSETISAYYARVAAPGSTGATFLAVCRGKASEGLDFSDTNGRGVIVTGLPYPPRMDPRVVLKMQFLDEMKGQGGAGGQFLSGQEWYRQQASRAVNQAIGRVIRHRQDYGAVFLCDHRFAFADARAQLPSWVRPHVRVYDNFGHVIRDVAQFFRVAERTMPAPAPRATAPSVRGEDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTGRTAPDPKLTVSTAAAQQLDPQEHLNQGRPHLSPRPPPTGDPGSQPQWGSGVPRAGKQGQHAVSAYLADARRALGSAGCSQLLAALTAYKQDDDLDKVLAVLAALTTAKPEDFPLLHRFSMFVRPHHKQRFSQTCTDLTGRPYPGMEPPGPQEERLAVPPVLTHRAPQPGPSRSEKTGKTQSKISSFLRQRPAGTVGAGGEDAGPSQSSGPPHGPAASEWGL

SEQ ID NO: 838123 - protein, 545 aa, Homo sapiens
MPAPAPRATAPSVRGEDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTGRTAPDPKLTVSTAAAQQLDPQEHLNQGRPHLSPRPPPTGDPGSQPQWGSGVPRAGKQGQHAVSAYLADARRALGSAGCSQLLAALTAYKQDDDLDKVLAVLAALTTAKPEDFPLLHRFSMFVRPHHKQRFSQTCTDLTGRPYPGMEPPGPQEERLAVPPVLTHRAPQPGPSRSEKTGKTQSKISSFLRQRPAGTVGAGGEDAGPSQSSGPPHGPAASEWGEPHGRDIAGQQATGAPGGPLSAGCVCQGCGAEDVVPFQCPACDFQRCQACWQRHLQASRMCPACHTASRKQSVMQVFWPEPQ

SEQ ID NO: 838124 - protein, 294 aa, Homo sapiens
GKKPRLGTRLGDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTENGAGSKLTCQAEPEWTQSPEQEATVARHPKGTWGTQGGLGAPAGKGRPGGTGYAPG

SEQ ID NO: 838125 - protein, 105 aa, Homo sapiens [sequence omitted]

SEQ ID NO: 838126 - protein, 1602 aa, Homo sapiens
MPKIVLNGVTVDFPFQPYKCQQEYMTKVLECLQQKVNGILESPTGTGKTLCLLCTTLAWREHLRDGISARKIAERAQGELFPDRALSSWGNAAAAAGDPIACYTDIPKIIYASRTHSQLTQVINELRNTSYRPKVCVLGSREQLCIHPEVKKQESNHLQIHLCRKKVASRSCHFYNNVEEKSLEQELASPILDIEDLVKSGSKHRVCPYYLSRNLKQQADIIFMPYNYLLDAKSRRAHNIDLKGTVVIFDEAHNVEKMCEESASFDLTPHDLASGLDVIDQVLEEQTKAAQQGEPHPEFSADSPSPGLNMELEDIAKLKMILLRLEGAIDAVELPGDDSGVTKPGSYIFELFAEAQITFQTKGCILDSLDQIIQHLAGRAGVFTNTAGLQKLADIIQIVFSVDPSEGSPGSPAGLGALQSYKVHIHPDAGHRRTAQRSDAWSTTAARKRGKVLSYWCFSPGHSMHELVRQGVRSLILTSGTLAPVSSFALEMQIPFPVCLENPHIIDKHQIWVGVVPRGPDGAQLSSAFDRRFSEECLSSLGKALGNIARVVPYGLLIFFPSYPVMEKSLEFWRARDLARKMEALKPLFVEPRSKGSFSETISAYYARVAAPGSTGATFLAVCRGKASEGLDFSDTNGRGVIVTGLPYPPRMDPRVVLKMQFLDEMKGQGGAGGQFLSGQEWYRQQASRAVNQAIGRVIRHRQDYGAVFLCDHRFAFADARAQLPSWVRPHVRVYDNFGHVIRDVAQFFRVAERTMPAPAPRATAPSVRGEDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTGRTAPDPKLTVSTAAAQQLDPQEHLNQGRPHLSPRPPPTGDPGSQPQWGSGVPRAGKQGQHAVSAYLADARRALGSAGCSQLLAALTAYKQDDDLDKVLAVLAALTTAKPEDFPLLHRFSMFVRPHHKQRFSQTCTDLTGRPYPGMEPPGPQEERLAVPPVLTHRAPQPGPSRSEKTGKTQSKISSFLRQRPAGTVGAGGEDAGPSQSSGPPHGPAASEWGEPHGRDIAGQQATGAPGGPLSAGCVCQAVGQRTWCPSSALPVTSSAAKPAGNGTFRPLGCAQPATPPPGSRASCRSSGQSPTRTMRALEGPGLSLLCLVLALPALLPVPAVRGVAETPTYPWRDAETGERLVCAQCPPGTFVQRPCRRDSPTTCGPCPPRHYTQFWNYLERCRYCNVLCGEREEEARACHATHNRACRCRTGFFAHAGFCLEHASCPPGAGVIAPGTPSQNTQCQPCPPGTFSASSSSSEQCQPHRNCTALGLALNVPGSSSHDTLCTSCTGFPLSTRVPGAEECERAVIDFVAFQDISIKRLQRLLQALEAPEGWGPTPRAGRAALQLKLRRRLTELLGAQDGALLVRLLQALRVARMPGLERSVRERFLPVH

SEQ ID NO: 838127 - protein, 1350 aa, Homo sapiens
MPKIVLNGVTVDFPFQPYKCQQEYMTKVLECLQQKVNGILESPTGTGKTLCLLCTTLAWREHLRDGISARKIAERAQGELFPDRALSSWGNAAAAAGDPIACYTDIPKIIYASRTHSQLTQVINELRNTSYRSLLRPGHVSVMLTSSDRRGSCVSPYSSRCRATLWVLETAPPRPTVLSPTRPKVCVLGSREQLCIHPEVKKQESNHLQIHLCRKKVASRSCHFYNNVEEKSLEQELASPILDIEDLVKSGSKHRVCPYYLSRNLKQQADIIFMPYNYLLDAKSRRAHNIDLKGTVVIFDEAHNVEKMCEESASFDLTPHDLASGLDVIDQVLEEQTKAAQQGEPHPEFSADSPSPGLNMELEDIAKLKMILLRLEGAIDAVELPGDDSGVTKPGSYIFELFAEAQITFQTKGCILDSLDQIIQHLAGRAGVFTNTAGLQKLADIIQIVFSVDPSEGSPGSPAGLGALQSYKVHIHPDAGHRRTAQRSDAWSTTAARKRGKVLSYWCFSPGHSMHELVRQGVRSLILTSGTLAPVSSFALEMQIPFPVCLENPHIIDKHQIWVGVVPRGPDGAQLSSAFDRRFSEECLSSLGKALGNIARVVPYGLLIFFPSYPVMEKSLEFWRARDLARKMEALKPLFVEPRSKGSFSETISAYYARVAAPGSTGATFLAVCRGKASEGLDFSDTNGRGVIVTGLPYPPRMDPRVVLKMQFLDEMKGQGGAGGQFLSGQEWYRQQASRAVNQAIGRVIRHRQDYGAVFLCDHRFAFADARAQLPSWVRPHVRVYDNFGHVIRDVAQFFRVAERTMPAPAPRATAPSVRGEDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTGRTAPDPKLTVSTAAAQQLDPQEHLNQGRPHLSPRPPPTGDPGSQPQWGSGVPRAGKQGQHAVSAYLADARRALGSAGCSQLLAALTAYKQDDDLDKVLAVLAALTTAKPEDFPLLHRFSMFVRPHHKQRFSQTCTDLTGRPYPGMEPPGPQEERLAVPPVLTHRAPQPGPSRSEKTGKTQSKISSFLRQRPAGTVGAGGEDAGPSQSSGPPHGPAASEWGEPHGRDIAGQQATGAPGGPLSAGCVCQGCGAEDVVPFQCPACDFQRCQACWQRHLQASRMCPACHTASRKQSVMQVFWPEPQ

SEQ ID NO: 838128 - protein, 837 aa, Homo sapiens
MHELVRQGVRSLILTSGTLAPVSSFALEMQIPFPVCLENPHIIDKHQIWVGVVPRGPDGAQLSSAFDRRFSEECLSSLGKALGNIARVVPYGLLIFFPSYPVMEKSLEFWRARDLARKMEALKPLFVEPRSKGSFSETISAYYARVAAPGSTGATFLAVCRGKASEGLDFSDTNGRGVIVTGLPYPPRMDPRVVLKMQFLDEMKGQGGAGGQFLSGQEWYRQQASRAVNQAIGRVIRHRQDYGAVFLCDHRFAFADARAQLPSWVRPHVRVYDNFGHVIRDVAQFFRVAERTMPAPAPRATAPSVRGEDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTGRTAPDPKLTVSTAAAQQLDPQEHLNQGRPHLSPRPPPTGDPGSQPQWGSGVPRAGKQGQHAVSAYLADARRALGSAGCSQLLAALTAYKQDDDLDKVLAVLAALTTAKPEDFPLLHRFSMFVRPHHKQRFSQTCTDLTGRPYPGMEPPGPQEERLAVPPVLTHRAPQPGPSRSEKTGKTQSKISSFLRQRPAGTVGAGGEDAGPSQSSGPPHGPAASEWGEPHGRDIAGQQATGAPGGPLSAGCVCQGCGAEDVVPFQCPACDFQRCQACWQRHLQASRMCPACHTASRKQSVMQVFWPEPQ

SEQ ID NO: 838129 - protein, 540 aa, Homo sapiens
GKKPRLGTRLGDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTGRTAPDPKLTVSTAAAQQLDPQEHLNQGRPHLSPRPPPTGDPGSQPQWGSGVPRAGKQGQHAVSAYLADARRALGSAGCSQLLAALTAYKQDDDLDKVLAVLAALTTAKPEDFPLLHRFSMFVRPHHKQRFSQTCTDLTGRPYPGMEPPGPQEERLAVPPVLTHRAPQPGPSRSEKTGKTQSKISSFLRQRPAGTVGAGGEDAGPSQSSGPPHGPAASEWGEPHGRDIAGQQATGAPGGPLSAGCVCQGCGAEDVVPFQCPACDFQRCQACWQRHLQASRMCPACHTASRKQSVMQVFWPEPQ

SEQ ID NO: 838130 - protein, 1300 aa, Homo sapiens
MPKIVLNGVTVDFPFQPYKCQQEYMTKVLECLQQKVNGILESPTGTGKTLCLLCTTLAWREHLRDGISARKIAERAQGELFPDRALSSWGNAAAAAGDPIACYTDIPKIIYASRTHSQLTQVINELRNTSYRPKVCVLGSREQLCIHPEVKKQESNHLQIHLCRKKVASRSCHFYNNVEEKSLEQELASPILDIEDLVKSGSKHRVCPYYLSRNLKQQADIIFMPYNYLLDAKSRRAHNIDLKGTVVIFDEAHNVEKMCEESASFDLTPHDLASGLDVIDQVLEEQTKAAQQGEPHPEFSADSPSPGLNMELEDIAKLKMILLRLEGAIDAVELPGDDSGVTKPGSYIFELFAEAQITFQTKGCILDSLDQIIQHLAGRAGVFTNTAGLQKLADIIQIVFSVDPSEGSPGSPAGLGALQSYKVHIHPDAGHRRTAQRSDAWSTTAARKRGKVLSYWCFSPGHSMHELVRQGVRSLILTSGTLAPVSSFALEMQIPFPVCLENPHIIDKHQIWVGVVPRGPDGAQLSSAFDRRFSEECLSSLGKALGNIARVVPYGLLIFFPSYPVMEKSLEFWRARDLARKMEALKPLFVEPRSKGSFSETISAYYARVAAPGSTGATFLAVCRGKASEGLDFSDTNGRGVIVTGLPYPPRMDPRVVLKMQFLDEMKGQGGAGGQFLSGQEWYRQQASRAVNQAIGRVIRHRQDYGAVFLCDHRFAFADARAQLPSWVRPHVRVYDNFGHVIRDVAQFFRVAERTMPAPAPRATAPSVRGEDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTGRTAPDPKLTVSTAAAQQLDPQEHLNQGRPHLSPRPPPTGDPGSQPQWGSGVPRAGKQGQHAVSAYLADARRALGSAGCSQLLAALTAYKQDDDLDKVLAVLAALTTAKPEDFPLLHRFSMFVRPHHKQRFSQTCTDLTGRPYPGMEPPGPQEERLAVPPVLTHRAPQPGPSRSEKTGKTQSKISSFLRQRPAGTVGAGGEDAGPSQSSGPPHGPAASEWGEPHGRDIAGQQATGAPGGPLSAGCVCQGCGAEDVVPFQCPACDFQRCQACWQRHLQASRMCPACHTASRKQSVMQVFWPEPQ

SEQ ID NO: 838131 - protein, 1219 aa, Homo sapiens
MPKIVLNGVTVDFPFQPYKCQQEYMTKVLECLQQKVNGILESPTGTGKTLCLLCTTLAWREHLRDGISARKIAERAQGELFPDRALSSWGNAAAAAGDPIACYTDIPKIIYASRTHSQLTQVINELRNTSYRPKVCVLGSREQLCIHPEVKKQESNHLQIHLCRKKVASRSCHFYNNVEEKSLEQELASPILDIEDLVKSGSKHRVCPYYLSRNLKQQADIIFMPYNYLLDAKSRRAHNIDLKGTVVIFDEAHNVEKMCEESASFDLTPHDLASGLDVIDQVLEEQTKAAQQGEPHPEFSADSPSPGLNMELEDIAKLKMILLRLEGAIDAVELPGDDSGVTKPGSYIFELFAEAQITFQTKGCILDSLDQIIQHLAGRAGVFTNTAGLQKLADIIQIVFSVDPSEGSPGSPAGLGALQSYKVHIHPDAGHRRTAQRSDAWSTTAARKRGKVLSYWCFSPGHSMHELVRQGVRSLILTSGTLAPVSSFALEMQIPFPVCLENPHIIDKHQIWVGVVPRGPDGAQLSSAFDRRFSEECLSSLGKALGNIARVVPYGLLIFFPSYPVMEKSLEFWRARDLARKMEALKPLFVEPRSKGSFSETISAYYARVAAPGSTGATFLAVCRGKASEGLDFSDTNGRGVIVTGLPYPPRMDPRVVLKMQFLDEMKGQGGAGGQFLSGQEWYRQQASRAVNQAIGRVIRHRQDYGAVFLCDHRFAFADARAQLPSWVRPHVRVYDNFGHVIRDVAQFFRVAERTMPAPAPRATAPSVRGEDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTGRTAPDPKLTVSTAAAQQLDPQEHLNQGRPHLSPRPPPTGDPGSQPQWGSGVPRAGKQGQHAVSAYLADARRALGSAGCSQLLAALTAYKQDDDLDKVLAVLAALTTAKPEDFPLLHRFSMFVRPHHKQRFSQTCTDLTGRPYPGMEPPGPQEERLAVPPVLTHRAPQPGPSRSEKTGKTQSKISSFLRQRPAGTVGAGGEDAGPSQSSGPPHGPAASEWGL

SEQ ID NO: 838132 - protein, 1300 aa, Homo sapiens; identical to SEQ ID NO: 838130

SEQ ID NO: 838133 - protein, 1054 aa, Homo sapiens
MPKIVLNGVTVDFPFQPYKCQQEYMTKVLECLQQKVNGILESPTGTGKTLCLLCTTLAWREHLRDGISARKIAERAQGELFPDRALSSWGNAAAAAGDPIACYTDIPKIIYASRTHSQLTQVINELRNTSYRPKVCVLGSREQLCIHPEVKKQESNHLQIHLCRKKVASRSCHFYNNVEEKSLEQELASPILDIEDLVKSGSKHRVCPYYLSRNLKQQADIIFMPYNYLLDAKSRRAHNIDLKGTVVIFDEAHNVEKMCEESASFDLTPHDLASGLDVIDQVLEEQTKAAQQGEPHPEFSADSPSPGLNMELEDIAKLKMILLRLEGAIDAVELPGDDSGVTKPGSYIFELFAEAQITFQTKGCILDSLDQIIQHLAGRAGVFTNTAGLQKLADIIQIVFSVDPSEGSPGSPAGLGALQSYKVHIHPDAGHRRTAQRSDAWSTTAARKRGKVLSYWCFSPGHSMHELVRQGVRSLILTSGTLAPVSSFALEMQIPFPVCLENPHIIDKHQIWVGVVPRGPDGAQLSSAFDRRFSEECLSSLGKALGNIARVVPYGLLIFFPSYPVMEKSLEFWRARDLARKMEALKPLFVEPRSKGSFSETISAYYARVAAPGSTGATFLAVCRGKASEGLDFSDTNGRGVIVTGLPYPPRMDPRVVLKMQFLDEMKGQGGAGGQFLSGQEWYRQQASRAVNQAIGRVIRHRQDYGAVFLCDHRFAFADARAQLPSWVRPHVRVYDNFGHVIRDVAQFFRVAERTMPAPAPRATAPSVRGEDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTENGAGSKLTCQGEPEWTQSPEQEATVARHPKGTWGTQGGLGAPAGKGRPGGTGYAPG

SEQ ID NO: 838134 - protein, 261 aa, Homo sapiens
MPKIVLNGVTVDFPFQPYKCQQEYMTKVLECLQQKVNGILESPTGTGKTLCLLCTTLAWREHLRDGISARKIAERAQGELFPDRALSSWGNAAAAAGDPIACYTDIPKIIYASRTHSQLTQVINELRNTSYRSLLRPGHVSVMLTSSDRRGSCVSPYSSRCRATLWVLETAPPRPTVLSPTRPKVCVLGSREQLCIHPEVKKQESNHLQIHLCRKKVASRSCHFYNNVEGTSSWVGPGSGWSVCSLSGWSSVVSQPGCACP

SEQ ID NO: 838135 - protein, 1219 aa, Homo sapiens; identical to SEQ ID NO: 838131

SEQ ID NO: 838136 - protein, 456 aa, Homo sapiens
MPKIVLNGVTVDFPFQPYKCQQEYMTKVLECLQQKVNGILESPTGTGKTLCLLCTTLAWREHLRDGISARKIAERAQGELFPDRALSSWGNAAAAAGDPIACYTDIPKIIYASRTHSQLTQVINELRNTSYRSLLRPGHVSVMLTSSDRRGSCVSPYSSRCRATLWVLETAPPRPTVLSPTRPKVCVLGSREQLCIHPEVKKQESNHLQIHLCRKKVASRSCHFYNNVEEKSLEQELASPILDIEDLVKSGSKHRVCPYYLSRNLKQQADIIFMPYNYLLDAKSRRAHNIDLKGTVVIFDEAHNVEKMCEESASFDLTPHDLASGLDVIDQVLEEQTKAAQQGEPHPEFSADSPSPGVRNVASVCLQIGYPTVASVPHSIINGYKRVLALSVETDYTFPLAEKVKAFLADPSAFVAAAPVAAATTAAPAAAAAPAKVEAKEESEESDEDMGFGLFD

SEQ ID NO: 838137 - protein, 40 aa, Homo sapiens
MPQARHMPSRGSPAPMGLATFSISRPIQSILLTVPLKIGV

SEQ ID NO: 838138 - protein, 1300 aa, Homo sapiens; identical to SEQ ID NO: 838130

SEQ ID NO: 838139 - protein, 1043 aa, Homo sapiens
MCEESASFDLTPHDLASGLDVIDQVLEEQTKAAQQGEPHPEFSADSPSPGLNMELEDIAKLKMILLRLEGAIDAVELPGDDSGVTKPGSYIFELFAEAQITFQTKGCILDSLDQIIQHLAGRAGVFTNTAGLQKLADIIQIVFSVDPSEGSPGSPAGLGALQSYKVHIHPDAGHRRTAQRSDAWSTTAARKRGKVLSYWCFSPGHSMHELVRQGVRSLILTSGTLAPVSSFALEMQIPFPVCLENPHIIDKHQIWVGVVPRGPDGAQLSSAFDRRFSEECLSSLGKALGNIARVVPYGLLIFFPSYPVMEKSLEFWRARDLARKMEALKPLFVEPRSKGSFSETISAYYARVAAPGSTGATFLAVCRGKASEGLDFSDTNGRGVIVTGLPYPPRMDPRVVLKMQFLDEMKGQGGAGGQFLSGQEWYRQQASRAVNQAIGRVIRHRQDYGAVFLCDHRFAFADARAQLPSWVRPHVRVYDNFGHVIRDVAQFFRVAERTMPAPAPRATAPSVRGEDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTGRTAPDPKLTVSTAAAQQLDPQEHLNQGRPHLSPRPPPTGDPGSQPQWGSGVPRAGKQGQHAVSAYLADARRALGSAGCSQLLAALTAYKQDDDLDKVLAVLAALTTAKPEDFPLLHRFSMFVRPHHKQRFSQTCTDLTGRPYPGMEPPGPQEERLAVPPVLTHRAPQPGPSRSEKTGKTQSKISSFLRQRPAGTVGAGGEDAGPSQSSGPPHGPAASEWGEPHGRDIAGQQATGAPGGPLSAGCVCQGCGAEDVVPFQCPACDFQRCQACWQRHLQASRMCPACHTASRKQSVMQVFWPEPQ

SEQ ID NO: 838140 - protein, 545 aa, Homo sapiens; identical to SEQ ID NO: 838123

SEQ ID NO: 838141 - protein, 1219 aa, Homo sapiens; identical to SEQ ID NO: 838131

SEQ ID NO: 838142 - protein, 1318 aa, Homo sapiens
MPKIVLNGVTVDFPFQPYKCQQEYMTKVLECLQQKVNGILESPTGTGKTLCLLCTTLAWREHLRDGISARKIAERAQGELFPDRALSSWGNAAAAAGDPIACYTDIPKIIYASRTHSQLTQVINELRNTSYRPKVCVLGSREQLCIHPEVKKQESNHLQIHLCRKKVASRSCHFYNNVEEKSLEQELASPILDIEDLVKSGSKHRVCPYYLSRNLKQQADIIFMPYNYLLDAKSRRAHNIDLKGTVVIFDEAHNVEKMCEESASFDLTPHDLASGLDVIDQVLEEQTKAAQQGEPHPEFSADSPSPGLNMELEDIAKLKMILLRLEGAIDAVELPGDDSGVTKPGSYIFELFAEAQITFQTKGCILDSLDQIIQHLAGRAGVFTNTAGLQKLADIIQIVFSVDPSEGSPGSPAGLGALQSYKVHIHPDAGHRRTAQRSDAWSTTAARKRGKVLSYWCFSPGHSMHELVRQGVRSLILTSGTLAPVSSFALEMQIPFPVCLENPHIIDKHQIWVGVVPRGPDGAQLSSAFDRRFSEECLSSLGKALGNIARVVPYGLLIFFPSYPVMEKSLEFWRARDLARKMEALKPLFVEPRSKGSFSETISAYYARVAAPGSTGATFLAVCRGKASEGLDFSDTNGRGVIVTGLPYPPRMDPRVVLKMQFLDEMKGQGGAGGQFLSGQEWYRQQASRAVNQAIGRVIRHRQDYGAVFLCDHRFAFADARAQLPSWVRPHVRVYDNFGHVIRDVAQFFRVAERTMPAPAPRATAPSVRGEDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTGNFPDALDQLLWLYISSSGRTAPDPKLTVSTAAAQQLDPQEHLNQGRPHLSPRPPPTGDPGSQPQWGSGVPRAGKQGQHAVSAYLADARRALGSAGCSQLLAALTAYKQDDDLDKVLAVLAALTTAKPEDFPLLHRFSMFVRPHHKQRFSQTCTDLTGRPYPGMEPPGPQEERLAVPPVLTHRAPQPGPSRSEKTGKTQSKISSFLRQRPAGTVGAGGEDAGPSQSSGPPHGPAASEWGEPHGRDIAGQQATGAPGGPLSAGCVCQGCGAEDVVPFQCPACDFQRCQACWQRHLQASRMCPACHTASRKQSVMQVFWPEPQ

SEQ ID NO: 838143 - protein, 727 aa, Homo sapiens
MPKIVLNGVTVDFPFQPYKCQQEYMTKVLECLQQKVNGILESPTGTGKTLCLLCTTLAWREHLRDGISARKIAERAQGELFPDRALSSWGNAAAAAGDPIACYTDIPKIIYASRTHSQLTQVINELRNTSYRPKVCVLGSREQLCIHPEVKKQESNHLQIHLCRKKVASRSCHFYNNVEEKSLEQELASPILDIEDLVKSGSKHRVCPYYLSRNLKQQADIIFMPYNYLLDAKSRRAHNIDLKGTVVIFDEAHNVEKMCEESASFDLTPHDLASGLDVIDQVLEEQTKAAQQGEPHPEFSADSPSPGLNMELEDIAKLKMILLRLEGAIDAVELPGDDSGVTKPGSYIFELFAEAQITFQTKGCILDSLDQIIQHLAGRAGVFTNTAGLQKLADIIQIVFSVDPSEGSPGSPAGLGALQSYKVHIHPDAGHRRTAQRSDAWSTTAARKRGKVLSYWCFSPGHSMHELVRQGVRSLILTSGTLAPVSSFALEMQMYGPPLPGPEHRDTSDISGVEVVGVPMSRVLGVSGLEGYRGAGALPHCLLPLATLSPFPVCLENPHIIDKHQIWVGVVPRGPDGAQLSSAFDRRFSEECLSSLGKALGNIARVVPYGLLIFFPSYPVMEKSLEFWRARDLARKMEALKPLFVEPRSKGSFSEVGTWPGLWACCPLVPPLPLTASPRLTTGPDHGLRRLPLPLQGSCVSFLALSVASYLTKPPAPGGCGNSGPPV

SEQ ID NO: 838144 - protein, 111 aa, Homo sapiens
MSRWCDLDRTKLWHCHRGVLCPPPPTSILAQGSLGPSSLCVQVLWDPRVCGWGLCVVVSCVLLRPTAAPPCPSCLRRGRQKNREEGGRRSGWSATRCVSCPCTCADHHRHA

SEQ ID NO: 838145 - protein, 367 aa, Homo sapiens
MASELCKTISVARLEKHKNLFLNYRNLHHFPLELLKDEGLQYLERLYMKRNSLTSLPENLAQKLPNLVELYLHSNNIVVVPEAIGSLVKLQCLDLSDNALEIVCPEIGRLRALRHLRLANNQLQFLPPEVGDLKELQTLDISTNRLLTLPERLHMCLSLQYLTVDRNRLWYVPRHLCQLPSLNELSMAGNRLAFLPLDLGRSRELQYVYVDNNIHLKGLPSYLYNKVIGCSGCGAPIQVSEVKLLSFSSGQRTVFLPAEVKAIGTEHDHVLPLQELAMRGLYHTYHSLLKDLNFLSPISLPRSLLELLHCPLGHCHRCSEPMFTIVYPKLFPLRETPMAGLHQWKTTVSFVAYCCSTQCLQTFDLLS

SEQ ID NO: 838146 - protein, 353 aa, Homo sapiens
SGTVRNSRDALALLALRNGPILTRYSAAACLMGYIQSWRPNFPENLAQKLPNLVELYLHSNNIVVVPEAIGSLVKLQCLDLSDNALEIVCPEIGRLRALRHLRLANNQLQFLPPEVGDLKELQTLDISTNRLLTLPERLHMCLSLQYLTVDRNRLWYVPRHLCQLPSLNELSMAGNRLAFLPLDLGRSRELQYVYVDNNIHLKGLPSYLYNKVIGCSGCGAPIQVSEVKLLSFSSGQRTVFLPAEVKAIGTEHDHVLPLQELAMRGLYHTYHSLLKDLNFLSPISLPRSLLELLHCPLGHCHRCSEPMFTIVYPKLFPLRETPMAGLHQWKTTVSFVAYCCSTQCLQTFDLLS

SEQ ID NO: 838147 - protein, 213 aa, Homo sapiens
MCLSLQYLTVDRNRLWYVPRHLCQLPSLNELSMAGNRLAFLPLDLGRSRELQYVYVDNNIHLKGLPSYLYNKVIGCSGCGAPIQVSEVKLLSFSSGQRTVFLPAEVKAIGTEHDHVLPLQELAMRGLYHTYHSLLKDLNFLSPISLPRSLLELLHCPLGHCHRCSEPMFTIVYPKLFPLRETPMAGLHQWKTTVSFVAYCCSTQCLQTFDLLS

SEQ ID NO: 838148 - protein, 151 aa, Homo sapiens
MASELCKTISVARLEKHKNLFLNYRNLHHFPLELLKDEGLQYLERLYMKRNSLTSLPENLAQKLPNLVELYLHSNNIVVVPEAIGSLVKLQCLDLSDNALEIVCPEIGRLRALRHLRLANNQLQFLPPVPHCGPKSSMVCAAPSLPAAQPQ

SEQ ID NO: 838149 - protein, 312 aa, Homo sapiens
MASELCKTISVARLEKHKNLFLNYRNLHHFPLELLKDEGLQYLERLYMKRNSLTSLPENLAQKLPNLVELYLHSNNIVVVPEAIGSLVKLQCLDLSDNALEIVCPEIGRLRALRHLRLANNQLQFLPPEVGDLKELQTLDISTNRLLTLPERLHMCLSLQYLTVDRNRLWYVPRHLCQLPSLNELSMAGNRLAFLPLDLGRSRELQYVYVDNNIHLKGLPSYLYNKVIGCSGCGAPIQVSEVKLLSFSSGQRTVFLPAEVKAIGTEHDHVLPLQELAMRGLYHTYHSLLKGRQLLVLWLTAAPPSVCRLLTC

SEQ ID NO: 838150 - protein, 247 aa, Homo sapiens
MASELCKTISVARLEKHKNLFLNYRNLHHFPLELLKDEGLQYLERLYMKRNSLTSLPENLAQKLPNLVELYLHSNNIVVVPEAIGSLVKLQCLDLSDNALEIVCPEIGRLRALRHLRLANNQLQFLPPEVGDLKELQTLDISTNRLLTLPERLHMCLSLQYLTVDRNRLWYVPRHLCQLPSLNELSMAGNRLAFLPLDLGRSRELQYVYVDNNIHLKGLPSYLYNKVIGCSGSTLFTVGGDYMESDH

SEQ ID NO: 838151 - protein, 367 aa, Homo sapiens; identical to SEQ ID NO: 838145

SEQ ID NO: 838152 - protein, 373 aa, Homo sapiens
MASELCKTISVARLEKHKNLFLNYRNLHHFPLELLKDEGLQYLERLYMKRNSLTSLPENLAQKLPNLVELWVCLFKYLHSNNIVVVPEAIGSLVKLQCLDLSDNALEIVCPEIGRLRALRHLRLANNQLQFLPPEVGDLKELQTLDISTNRLLTLPERLHMCLSLQYLTVDRNRLWYVPRHLCQLPSLNELSMAGNRLAFLPLDLGRSRELQYVYVDNNIHLKGLPSYLYNKVIGCSGCGAPIQVSEVKLLSFSSGQRTVFLPAEVKAIGTEHDHVLPLQELAMRGLYHTYHSLLKDLNFLSPISLPRSLLELLHCPLGHCHRCSEPMFTIVYPKLFPLRETPMAGLHQWKTTVSFVAYCCSTQCLQTFDLLS

SEQ ID NO: 838153 - protein, 263 aa, Homo sapiens
MASELCKTISVARLEKHKNLFLNYRNLHHFPLELLKDEGLQYLERLYMKRNSLTSLYLTVDRNRLWYVPRHLCQLPSLNELSMAGNRLAFLPLDLGRSRELQYVYVDNNIHLKGLPSYLYNKVIGCSGCGAPIQVSEVKLLSFSSGQRTVFLPAEVKAIGTEHDHVLPLQELAMRGLYHTYHSLLKDLNFLSPISLPRSLLELLHCPLGHCHRCSEPMFTIVYPKLFPLRETPMAGLHQWKTTVSFVAYCCSTQCLQTFDLLS

SEQ ID NO: 838154 - protein, 289 aa, Homo sapiens
MASELCKTISVARLEKHKNLFLNYRNLHHFPLELLKDEGLQYLERLYMKRNSLTSLPENLAQKLPNLVELYLHSNNIVVVPEAIGSLVKLQCLDLSDNALEIVCPEIGRLRALRHLRLANNQLQFLPPEVGDLKELQTLDISTNRLLTLPERLHMCLSLQYLTVDRNRLWYVPRHLCQLPSLNELSMAGNRLAFLPLDLGRSRELQYVYVDNNIHLKGLPSYLYNKVIGCSGCGAPIQVSEVKLLSFSSGIGYERAVSYLPQLAERKTTVSFVAYCCSTQCLQTFDLLS

SEQ ID NO: 838155 - protein, 473 aa, Homo sapiens
MRAGPGPTVTLALVLAVAWAMELKPTAPPIFTGRPFVVAWDVPTQDCGPRLKVPLDLNAFDVQASPNEGFVNQNITIFYRDRLGLYPRFDSAGRSVHGGVPQNVSLWAHRKMLQKRVEHYIRTQESAGLAVIDWEDWRPVWVRNWQDKDVYRRLSRQLVASRHPDWPPDRIVKQAQYEFEFAAQQFMLETLRYVKAVRPRHLWGFYLFPDCYNHDYVQNWESYTGRCPDVEVARNDQLAWLWAESTALFPSVYLDETLASSRHGRNFVSFRVQEALRVARTHHANHALPVYVFTRPTYSRRLTGLSEMDLISTIGESAALGAAGVILWGDAGYTTSTETCQYLKDYLTRLLVPYVVNVSWATQYCSRAQCHGHGRCVRRNPSASTFLHLSTNSFRLVPGHAPGEPQLRPVGELSWADIDHLQTHFRCQCYLGWSGEQCQWDHRQAAGGASEAWAGSHLTSLLALAALAFTWTL

SEQ ID NO: 838156 - protein, 520 aa, Homo sapiens
GGVPVRRIRVARRASSLSWCQVQGNTLRGEAHQAVLGHGRRAANCVSIEALAARSADTWRTLRGLNVTIKRTSPYFTGRRFTSRGVTVPIVSCCSQSYQVPLDLNAFDVQASPNEGFVNQNITIFYRDRLGLYPRFDSAGRSVHGGVPQNVSLWAHRKMLQKRVEHYIRTQESAGLAVIDWEDWRPVWVRNWQDKDVYRRLSRQLVASRHPDWPPDRIVKQAQYEFEFAAQQFMLETLRYVKAVRPRHLWGFYLFPDCYNHDYVQNWESYTGRCPDVEVARNDQLAWLWAESTALFPSVYLDETLASSRHGRNFVSFRVQEALRVARTHHANHALPVYVFTRPTYSRRLTGLSEMDLISTIGESAALGAAGVILWGDAGYTTSTETCQYLKDYLTRLLVPYVVNVSWATQYCSRAQCHGHGRCVRRNPSASTFLHLSTNSFRLVPGHAPGEPQLRPVGELSWADIDHLQTHFRCQCYLGWSGEQCQWDHRQAAGGASEAWAGSHLTSLLALAALAFTWTL

SEQ ID NO: 838157 - protein, 382 aa, Homo sapiens
MRAGPGPTVTLALVLAVAWAMELKPTAPPIFTGRPFVVAWDVPTQDCGPRLKVPLDLNAFDVQASPNEGFVNQNITIFYRDRLGLYPRFDSAGRSVHGGVPQNVSLWAHRKMLQKRVEHYIRTQESAGLAVIDWEDWRPVWVRNWQDKDVYRRLSRQLVASRHPDWPPDRIVKQAQYEFEFAAQQFMLETLRYVKAVRPRHLWGFYLFPDCYNHDYVQNWESYTGRCPDVEVARNDQLAWLWAESTETCQYLKDYLTRLLVPYVVNVSWATQYCSRAQCHGHGRCVRRNPSASTFLHLSTNSFRLVPGHAPGEPQLRPVGELSWADIDHLQTHFRCQCYLGWSGEQCQWDHRQAAGGASEAWAGSHLTSLLALAALAFTWTL

SEQ ID NO: 838158 - protein, 473 aa, Homo sapiens; identical to SEQ ID NO: 838155

SEQ ID NO: 838159 - protein, 473 aa, Homo sapiens; identical to SEQ ID NO: 838155

SEQ ID NO: 838160 - protein, 277 aa, Homo sapiens
MRAGPGPTVTLALVLAVAWAMELKPTAPPIFTGRPFVVAWDVPTQDCGPRLKVPLDLNAFDVQASPNEGFVNQNITIFYRDRLGLYPRFDSAGRSVHGGVPQNVSLWAHRKMLQKRVEHYIRTQESAGLAVIDWEDWRPVWVRNWQDKDVYRRLSRQLVASRHPDWPPDRIVKQAQYEFEFAAQQFMLETLRYVKAVRPRHLWGFYLFPDCYNHDYVQNWESYTGRCPDVEVARNDQLAWLWAESTALFPSVYLDETLASSRHGLYLDLVGVSCLAA

SEQ ID NO: 838161 - protein, 473 aa, Homo sapiens; identical to SEQ ID NO: 838155

SEQ ID NO: 838162 - protein, 499 aa, Homo sapiens
MRAGPGPTVTLALVLAVAWAMELKPTAPPIFTGRPFVVAWDVPTQDCGPRLKVPLDLNAFDVQASPNEGFVNQNITIFYRDRLGLYPRFDSAGRSVHGGVPQNVSLWAHRKMLQKRVEHYIRTQESAGLAVIDWEDWRPVWVPLDLNAFDVQASPNEGFVNQNITIFYRNWQDKDVYRRLSRQLVASRHPDWPPDRIVKQAQYEFEFAAQQFMLETLRYVKAVRPRHLWGFYLFPDCYNHDYVQNWESYTGRCPDVEVARNDQLAWLWAESTALFPSVYLDETLASSRHGRNFVSFRVQEALRVARTHHANHALPVYVFTRPTYSRRLTGLSEMDLISTIGESAALGAAGVILWGDAGYTTSTETCQYLKDYLTRLLVPYVVNVSWATQYCSRAQCHGHGRCVRRNPSASTFLHLSTNSFRLVPGHAPGEPQLRPVGELSWADIDHLQTHFRCQCYLGWSGEQCQWDHRQAAGGASEAWAGSHLTSLLALAALAFTWTL

SEQ ID NO: 838163 - protein, 293 aa, Homo sapiens
LIRRVRGWVVMRYVKAVRPRHLWGFYLFPDCYNHDYVQNWESYTGRCPDVEVARNDQLAWLWAESTALFPSVYLDETLASSRHGRNFVSFRVQEALRVARTHHANHALPVYVFTRPTYSRRLTGLSEMDLISTIGESAALGAAGVILWGDAGYTTSTETCQYLKDYLTRLLVPYVVNVSWATQYCSRAQCHGHGRCVRRNPSASTFLHLSTNSFRLVPGHAPGEPQLRPVGELSWADIDHLQTHFRCQCYLGWSGEQCQWDHRQAAGGASEAWAGSHLTSLLALAALAFTWTL

SEQ ID NO: 838164 - protein, 473 aa, Homo sapiens; identical to SEQ ID NO: 838155

SEQ ID NO: 838165 - protein, 78 aa, Homo sapiens
MKSLKNNRGGADGEPESEKGNSGKSGYKRKPGARNQGERTLHQINKRPGGTTESSRKKFKREPQEQQGTTKGSQGGRN

SEQ ID NO: 838166 - protein, 189 aa, Homo sapiens
GKSATGNSILGSLVFTSRLRAQPVTKTSQSGRRTWDGQEVVVVDTPSFNQMLDVEKDPSRLEEEVKRCLSCCEKGDTFFVLVFQLGRFTEEDKTAVAKLEAIFGADFTKYAIMLFTRKEDLGAGNLEDFMKNSDNKALRRIFKKCGRRVCAFNNKETGQAQETQVKALLTKVNDLRKESGWSGYPHTQE

SEQ ID NO: 838167 - protein, 309 aa, Homo sapiens
MDEKVFTKELDQWIEQLNECKQLSESQVKSLCEKAKEILTKESNVQEVRCPVTVCGDVHGQFHDLMELFRIGGKSPDTNYLFMGDYVDRGYYSVETVTLLVALKVRYRERITILRGNHESRQITQVYGFYDECLRKYGNANVWKYFTDLFDYLPLTALVDGQIFCLHGGLSPSIDTLDHIRALDRLQEVPHEGPMCDLLWSDPDDRGGWGISPRGAGYTFGQDISETFNHANGLTLVSRAHQLVMEGYNWCHDRNVVTIFSAPNYCYRCGNQAAIMELDDTLKYSFLQFDPAPRRGEPHVTRRTPDYFL

SEQ ID NO: 838168 - protein, 309 aa, Homo sapiens; identical to SEQ ID NO: 838167

SEQ ID NO: 838169 - protein, 309 aa, Homo sapiens; identical to SEQ ID NO: 838167

SEQ ID NO: 838170 - protein, 309 aa, Homo sapiens; identical to SEQ ID NO: 838167

SEQ ID NO: 838171 - protein, 454 aa, Homo sapiens
SILPFPHHPALREPRPKSQGASVTSRLRRACALTPSLRPNSGRAAARGGLCSCAACSPALFPSAPRRLLTPGVTSPRPAAAITESRALEPQRAEEEAQRPTAEYCGESQRASASLNSRQKYTRNRRRRVRVGPCAGGGAGGARSGSRLGRVASWTRRCSPRSWTSGSLSESQVKSLCEKAKEILTKESNVQEVRCPVTVCGDVHGQFHDLMELFRIGGKSPDTNYLFMGDYVDRGYYSVETVTLLVALKVRYRERITILRGNHESRQITQVYGFYDECLRKYGNANVWKYFTDLFDYLPLTALVDGQIFCLHGGLSPSIDTLDHIRALDRLQEVPHEGPMCDLLWSDPDDRGGWGISPRGAGYTFGQDISETFNHANGLTLVSRAHQLVMEGYNWCHDRNVVTIFSAPNYCYRCGNQAAIMELDDTLKYSFLQFDPAPRRGEPHVTRRTPDYFL

SEQ ID NO: 838172 - protein, 292 aa, Homo sapiens
EIPEAWAGSQVKSLCEKAKEILTKESNVQEVRCPVTVCGDVHGQFHDLMELFRIGGKSPDTNYLFMGDYVDRGYYSVETVTLLVALKVRYRERITILRGNHESRQITQVYGFYDECLRKYGNANVWKYFTDLFDYLPLTALVDGQIFCLHGGLSPSIDTLDHIRALDRLQEVPHEGPMCDLLWSDPDDRGGWGISPRGAGYTFGQDISETFNHANGLTLVSRAHQLVMEGYNWCHDRNVVTIFSAPNYCYRCGNQAAIMELDDTLKYSFLQFDPAPRRGEPHVTRRTPDYFL

SEQ ID NO: 838173 - protein, 244 aa, Homo sapiens
MELFRIGGKSPDTNYLFMGDYVDRGYYSVETVTLLVALKVRYRERITILRGNHESRQITQVYGFYDECLRKYGNANVWKYFTDLFDYLPLTALVDGQIFCLHGGLSPSIDTLDHIRALDRLQEVPHEGPMCDLLWSDPDDRGGWGISPRGAGYTFGQDISETFNHANGLTLVSRAHQLVMEGYNWCHDRNVVTIFSAPNYCYRCGNQAAIMELDDTLKYSFLQFDPAPRRGEPHVTRRTPDYFL

SEQ ID NO: 838174 - protein, 309 aa, Homo sapiens; identical to SEQ ID NO: 838167

SEQ ID NO: 838175 - protein, 309 aa, Homo sapiens; identical to SEQ ID NO: 838167

SEQ ID NO: 838176 - protein, 286 aa, Homo sapiens
MDEKVFTKELDQWIEQLNECKQLSESQVKSLCEKAKEILTKESNVQEVRCPVTVCGDVHGQFHDLMELFRIGGKSPDTNYLFMGDYVDRGYYSVETVTLLVALKVRYRERITILRGNHESRQITQVYGFYDECLRKYGNANVWKYFTDLFDYLPLTALVDGQIFCLHGGLSPSIDTLDHIRALDRLQEVPHEGPMCDLLWSDPDDRGGWGISPRGAGYTFGQDISETFNHANGLTLVSRAHQLVMEGYNWCHDRNVVTIFSAPNYCYRCGNQAANSNWGKTFGTIL

SEQ ID NO: 838177 - protein, 309 aa, Homo sapiens; identical to SEQ ID NO: 838167

SEQ ID NO: 838178 - protein, 309 aa, Homo sapiens; identical to SEQ ID NO: 838167

SEQ ID NO: 838179 - protein, 473 aa, Homo sapiens
SILPFPHHPALREPRPKSQGASVTSRLRRACALTPSLRPNSGRAAARGGLCSCAACSPALFPSAPRRLLTPGVTSPRPAAAITESRALEPQRAEEEAQRPTAEYCGESQRASASLNSRQKYTRNRRRRVRVGPCAGGGAGGARSGSRLGRVASWTRRCSPRSWTSGSHSEPGWEKPGKGLGPKGQAVSESQVKSLCEKAKEILTKESNVQEVRCPVTVCGDVHGQFHDLMELFRIGGKSPDTNYLFMGDYVDRGYYSVETVTLLVALKVRYRERITILRGNHESRQITQVYGFYDECLRKYGNANVWKYFTDLFDYLPLTALVDGQIFCLHGGLSPSIDTLDHIRALDRLQEVPHEGPMCDLLWSDPDDRGGWGISPRGAGYTFGQDISETFNHANGLTLVSRAHQLVMEGYNWCHDRNVVTIFSAPNYCYRCGNQAAIMELDDTLKYSFLQFDPAPRRGEPHVTRRTPDYFL

SEQ ID NO: 838180 - protein, 309 aa, Homo sapiens; identical to SEQ ID NO: 838167

SEQ ID NO: 838181 - protein, 309 aa, Homo sapiens; identical to SEQ ID NO: 838167

SEQ ID NO: 838182 - protein, 219 aa, Homo sapiens
FFLAAAELTQLLQIHSSSTSRFRSSLRSYFTVTFPYSVWGISEIPHTEYIVEEDSYEKDYGCGCLREEILDGIFCLHGGLSPSIDTLDHIRALDRLQEVPHEGPMCDLLWSDPDDRGGWGISPRGAGYTFGQDISETFNHANGLTLVSRAHQLVMEGYNWCHDRNVVTIFSAPNYCYRCGNQAAIMELDDTLKYSFLQFDPAPRRGEPHVTRRTPDYFL

SEQ ID NO: 838183 - protein, 139 aa, Homo sapiens
AVRLERREIADHGVATCKPTLAGPMCDLLWSDPDDRGGWGISPRGAGYTFGQDISETFNHANGLTLVSRAHQLVMEGYNWCHDRNVVTIFSAPNYCYRCGNQAAIMELDDTLKYSFLQFDPAPRRGEPHVTRRTPDYFL

SEQ ID NO: 838184 - protein, 251 aa, Homo sapiens
MDEKVFTKELDQWIEQLNECKQLSESQVKSLCEKAKEILTKESNVQEVRCPVTVCGDVHGQFHDLMELFRIGGKSPDTNYLFMGDYVDRGYYSVETVTLLVALKVRYRERITILRGNHESRQITQVYGFYDECLRKYGNANVWKYFTDLFDYLPLTALVDGQIFCLHGGLSPSIDTLDHIRALDRLQEVPHEGPMCDLLWSDPDDRGGWGISPRGAGYTFGQDISETFNHANGLTLVSRAHQLVMEVCCVL

SEQ ID NO: 838185 - protein, 104 aa, Homo sapiens
NRNCDQIKENHIKQIQKNLLPQCSSLVFYNVALLYFIFMENHRGLGGVAGGSSPSSQLFFFPSNPTLSLLTPASRFHSLTATFSHPYQHLLTPPPSTQPPPLLR

SEQ ID NO: 838186 - protein, 746 aa, Homo sapiens
MQAKKRYFILLSAGSCLALLFYFGGLQFRASRSHSRREEHSGRNGLHHPSPDHFWPRFPDALRPFVPWDQLENEDSSVHISPRQKRDANSSIYKGKKCRMESCFDFTLCKKNGFKVYVYPQQKGEKIAESYQNILAAIEGSRFYTSDPSQACLFVLSLDTLDRDQLSPQYVHNLRSKVQSLHLWNNGRNHLIFNLYSGTWPDYTEDVGFDIGQAMLAKASISTENFRPNFDVSIPLFSKDHPRTGGERGFLKFNTIPPLRKYMLVFKGKRYLTGIGSDTRNALYHVHNGEDVVLLTTCKHGKDWQKHKDSRCDRDNTEYEKYDYREMLHNATFCLVPRGRRLGSFRFLEALQAACVPVMLSNGWELPFSEVINWNQAAVIGDERLLLQIPSTIRSIHQDKILALRQQTQFLWEAYFSSVEKIVLTTLEIIQDRIFKHISRNSLIWNKHPGGLFVLPQYSSYLGDFPYYYANLGLKPPSKFTAVIHAVTPLVSQSQPVLKLLVAAAKSQYCAQIIVLWNCDKPLPAKHRWPATAVPVVVIEGESKVMSSRFLPYDNIITDAVLSLDEDTVLSTTEVDFAFTVWQSFPERIVGYPARSHFWDNSKERWGYTSKWTNDYSMVLTGAAIYHKYYHYLYSHYLPASLKNMVDQLANCEDILMNFLVSAVTKLPPIKVTQKKQYKETMMGQTSRASRWADPDHFAQRQSCMNTFASWFGYMPLIHSQMRLDPVLFKDQVSILRKKYRDIERL

SEQ ID NO: 838187 - protein, 323 aa, Homo sapiens
MQAKKRYFILLSAGSCLALLFYFGGLQFRASRSHSRREEHSGRNGLHHPSPDHFWPRFPDALRPFVPWDQLENEDSSVHISPRQKRDANSSIYKGKKCRMESCFDFTLCKKNGFKVYVYPQQKGEKIAESYQNILAAIEGSRFYTSDPSQACLFVLSLDTLDRDQLSPQYVHNLRSKVQSLHLWNNGRNHLIFNLYSGTWPDYTEDVGFDIGQAMLAKASISTENFRPNFDVSIPLFSKDHPRTGGERGFLKFNTIPPLRKYMLVFKGKRYLTGIGSDTRNALYHVHNGEDVVLLTTCKHGKDWQKHKDSRCGLQNKAPLESA

SEQ ID NO: 838188 - protein, 746 aa, Homo sapiens; identical to SEQ ID NO: 838186

SEQ ID NO: 838189 - protein, 501 aa, Homo sapiens
MNLEQERPSVCSAPGCSQRFPTEDHLMIHRHKHEMTLKFPSIKTDNMLSDQTPTPTRFLKNCEEVGLFSELDCSLEHEFRKAQEEESSKRNISMHNAVGGAMTGPGTHQLSSARLPNHDTNVVIQQAMPSPQSSSVITQAPSTNRQIGPVPGSLSSLLHLHNRQRQPMPASMPGTLPNPTMPGSSAVLMPMERQMSVNSSIMGMQGPNLSNPCASPQVQPMHSEAKMRLKAALTHHPAAMSNGNMNTMGHMMEMMGSRQDQTPHHHMHSHPHQHQTLPPHHPYPHQHQHPAHHPHPQPHHQQNHPHHHSHSHLHAHPAHHQTSPHPPLHTGNQAQVSPATQQMQPTQTIQPPQPTGGRRRRVVDEDPDERRRKFLERNRAAATRCRQKRKVWVMSLEKKAEELTQTNMQLQNEVSMLKNEVAQLKQLLLTHKDCPITAMQKESQGYLSPESSPPASPVPACSQQQVIQHNTITTSSSVSEVVGSSTLSQLTTHRTDLNPIL

SEQ ID NO: 838190 - protein, 357 aa, Homo sapiens
MSMRPVPGSLSSLLHLHNRQRQPMPASMPGTLPNPTMPGSSAVLMPMERQMSVNSSIMGMQGPNLSNPCASPQVQPMHSEAKMRLKAALTHHPAAMSNGNMNTMGHMMEMMGSRQDQTPHHHMHSHPHQHQTLPPHHPYPHQHQHPAHHPHPQPHHQQNHPHHHSHSHLHAHPAHHQTSPHPPLHTGNQAQVSPATQQMQPTQTIQPPQPTGGRRRRVVDEDPDERRRKFLERNRAAATRCRQKRKVWVMSLEKKAEELTQTNMQLQNEVSMLKNEVAQLKQLLLTHKDCPITAMQKESQGYLSPESSPPASPVPACSQQQVIQHNTITTSSSVSEVVGSSTLSQLTTHRTDLNPIL

SEQ ID NO: 838191 - protein, 475 aa, Homo sapiens
MIHRHKHEMTLKFPSIKTDNMLSDQTPTPTRFLKNCEEVGLFSELDCSLEHEFRKAQEEESSKRNISMHNAVGGAMTGPGTHQLSSARLPNHDTNVVIQQAMPSPQSSSVITQAPSTNRQIGPVPGSLSSLLHLHNRQRQPMPASMPGTLPNPTMPGSSAVLMPMERQMSVNSSIMGMQGPNLSNPCASPQVQPMHSEAKMRLKAALTHHPAAMSNGNMNTMGHMMEMMGSRQDQTPHHHMHSHPHQHQTLPPHHPYPHQHQHPAHHPHPQPHHQQNHPHHHSHSHLHAHPAHHQTSPHPPLHTGNQAQVSPATQQMQPTQTIQPPQPTGGRRRRVVDEDPDERRRKFLERNRAAATRCRQKRKVWVMSLEKKAEELTQTNMQLQNEVSMLKNEVAQLKQLLLTHKDCPITAMQKESQGYLSPESSPPASPVPACSQQQVIQHNTITTSSSVSEVVGSSTLSQLTTHRTDLNPIL

SEQ ID NO: 838192 - protein, 334 aa, Homo sapiens
MPASMPGTLPNPTMPGSSAVLMPMERQMSVNSSIMGMQGPNLSNPCASPQVQPMHSEAKMRLKAALTHHPAAMSNGNMNTMGHMMEMMGSRQDQTPHHHMHSHPHQHQTLPPHHPYPHQHQHPAHHPHPQPHHQQNHPHHHSHSHLHAHPAHHQTSPHPPLHTGNQAQVSPATQQMQPTQTIQPPQPTGGRRRRVVDEDPDERRRKFLERNRAAATRCRQKRKVWVMSLEKKAEELTQTNMQLQNEVSMLKNEVAQLKQLLLTHKDCPITAMQKESQGYLSPESSPPASPVPACSQQQVIQHNTITTSSSVSEVVGSSTLSQLTTHRTDLNPIL

SEQ ID NO: 838193 - protein, 508 aa, Homo sapiens
MIYEESKMNLEQERPSVCSAPGCSQRFPTEDHLMIHRHKHEMTLKFPSIKTDNMLSDQTPTPTRFLKNCEEVGLFSELDCSLEHEFRKAQEEESSKRNISMHNAVGGAMTGPGTHQLSSARLPNHDTNVVIQQAMPSPQSSSVITQAPSTNRQIGPVPGSLSSLLHLHNRQRQPMPASMPGTLPNPTMPGSSAVLMPMERQMSVNSSIMGMQGPNLSNPCASPQVQPMHSEAKMRLKAALTHHPAAMSNGNMNTMGHMMEMMGSRQDQTPHHHMHSHPHQHQTLPPHHPYPHQHQHPAHHPHPQPHHQQNHPHHHSHSHLHAHPAHHQTSPHPPLHTGNQAQVSPATQQMQPTQTIQPPQPTGGRRRRVVDEDPDERRRKFLERNRAAATRCRQKRKVWVMSLEKKAEELTQTNMQLQNEVSMLKNEVAQLKQLLLTHKDCPITAMQKESQGYLSPESSPPASPVPACSQQQVIQHNTITTSSSVSEVVGSSTLSQLTTHRTDLNPIL

SEQ ID NO: 838194 - protein, 334 aa, Homo sapiens; identical to SEQ ID NO: 838192

SEQ ID NO: 838195 - protein, 131 aa, Homo sapiens
MDFQQLADVAEKWCSNTPFELIATEETERRMDFYADPGVSFYVLCPDNGCGDNFHVWSESEDCLPFLQLAQDYISSCGKKTLHEVLEKVFKSFRPLLGLPDADDDAFEEYSADVEEEEPEADHPQMGVSQQ

SEQ ID NO: 838196 - protein, 79 aa, Homo sapiens
QARLTSQLKELEKQEQTYSKASRRQEITKITAELKEIETQKALQQISESRSWFFEKINKIDRLGLPGVNLVVLTSTPLT

SEQ ID NO: 838197 - protein, 84 aa, Homo sapiens
ALPVVLVVIRVGSSIESQAPAMAHSRARGCVVDAAVTTHPHLHVLTIPGELPQTVFLVRSTWPGDLTKPSHFSQFSDNRYDTRS

SEQ ID NO: 838198 - protein, 131 aa, Homo sapiens; identical to SEQ ID NO: 838195

SEQ ID NO: 838199 - protein, 736 aa, Homo sapiens
IQQLSPKEQRAFELKLKEIKEQHKNFEDFYSFMIMKTNFNKEYIENVVRNILKGQNIFTKEAKLFSFLALLNSYVPDTTISLSQCEKFLGIGNKKAFWGTEKFEDKMGTYSTILIKTEVIECGNYCGVRIIHSLIAEFSLEELKKSYHLNKSQIMLDMLTENLFFDTGMGKSKFLQDMHTLLLTRHRDEHEGETGNWFSPFIEALHKDEGNEAVEAVLLESIHRFNPNAFICQALARHFYIKKKDFGNALNWAKQAKIIEPDNSYISDTLGQVYKSKIRWWIEENGGNGNISVDDLIALLDLAEHASSAFKESQQQSEDREYEVKERLYPKSKRRYDTYNIAGYQGEIEVGLYTIQILQLIPFFDNKNELSKRYMVNFVSGSSDIPGDPNNEYKLALKNYIPYLTKLKFSLKKSFDFFDEYFVLLKPRNNIKQNEEAKTRRKVAGYFKKYVDIFCLLEESQNNTGLGSKFSEPLQVERCRRNLVALKADKFSGLLEYLIKSQEDAISTMKCIVNEYTFLLEQCTVKIQSKEKLNFILANIILSCIQPTSRLVKPVEKLKDQLREVLQPIGLTYQFSEPYFLASLLFWPENQQLDQHSEQMKEYAQALKNSFKGQYKHMHRTKQPIAYFFLGKGKRLERLVHKGKIDQCFKKTPDINSLWQSGDVWKEEKVQELLLRLQGRAENNCLYIEYGINEKITIPITPAFLGQLRSGRSIEKVSFYLGFSIGGPLAYDIEIV

SEQ ID NO: 838200 - protein, 736 aa, Homo sapiens; identical to SEQ ID NO: 838199

SEQ ID NO: 838201 - protein, 736 aa, Homo sapiens; identical to SEQ ID NO: 838199

SEQ ID NO: 838202 - protein, 278 aa, Homo sapiens
VCVSWSRGCSERASGVSRALLQSAPGTPATVGISVGELWPFARCCSHSYVRSLRGLSVSTHLLCFTIYIMNPSMKQKQEEIKENIKNSSVPRRTLKMIQPSASGSLVGRENELSAGLSKRKHRNDHLTSTTSSPGVIVPESSENKNLGGVTQESFDLMIKENPSSQYWKEVAEKRRKALYEALKENEKLHKEIEQKDNEIARLKKENKELAEVAEHVQYMAELIERLNGEPLDNFESLDNQEFDSEEETVEDSLVEDSEIGTCAEGTVSSSTDAKPCI

SEQ ID NO: 838203 - protein, 209 aa, Homo sapiens
MNPSMKQKQEEIKENIKNSSVPRRTLKMIQPSASGSLVGRENELSAGLSKRKHRNDHLTSTTSSPGVIVPESSENKNLGGVTQESFDLMIKENPSSQYWKEVAEKRRKALYEALKENEKLHKEIEQKDNEIARLKKENKELAEVAEHVQYMAELIERLNGEPLDNFESLDNQEFDSEEETVEDSLVEDSEIGTCAEGTVSSSTDAKPCI

SEQ ID NO: 838204 - protein, 209 aa, Homo sapiens; identical to SEQ ID NO: 838203

SEQ ID NO: 838205 - protein, 216 aa, Homo sapiens
GQSDRGSPSACKCQKQEEIKENIKNSSVPRRTLKMIQPSASGSLVGRENELSAGLSKRKHRNDHLTSTTSSPGVIVPESSENKNLGGVTQESFDLMIKENPSSQYWKEVAEKRRKALYEALKENEKLHKEIEQKDNEIARLKKENKELAEVAEHVQYMAELIERLNGEPLDNFESLDNQEFDSEEETVEDSLVEDSEIGTCAEGTVSSSTDAKPCI

SEQ ID NO: 838206 - protein, 241 aa, Homo sapiens
VCVSWSRGCSERASGVSRALLQSAPGTPATVGISVGELWPFARCCSHSYVRSLRGLSVSTHLLCFTIYIMNPSMKQKQEEIKENIKNSSVPRRTLKMIQPSASGSLVGRENELSAGLSKRKHRNDHLTSTTSSPGVIVPESSENKNLGGVTQESFDLMIKENPSSQYWKEVAEKRRKALYEALKENEKRLNGEPLDNFESLDNQEFDSEEETVEDSLVEDSEIGTCAEGTVSSSTDAKPCI

SEQ ID NO: 838207 - protein, 190 aa, Homo sapiens
PPPPPPTSSGNGRVYSAQEALLQSAPGTPATVGISVGELWPFARCCSHSYVRSLRGLSVSTHLLCFTIYIMNPSMKQKQEEIKENIKTKKKRKTLLCGRGLGAPGKEVFLRHPSGCGRAAGAPRRGSGVRPWAHTEGVPKGENPGAHRQDRVVREFSSTNKKKPPGRGATPRGGFLGPKPPKGGRSGRGH

SEQ ID NO: 838208 - protein, 209 aa, Homo sapiens; identical to SEQ ID NO: 838203

SEQ ID NO: 838209 - protein, 209 aa, Homo sapiens; identical to SEQ ID NO: 838203

SEQ ID NO: 838210 - protein, 261 aa, Homo sapiens
VCVSWSRGCSERASGVSRALLQSAPGTPATVGISVGELWPFARCCSHSYVRSLRGLSVSTHLLCFTIYIMNPSMKQKQEEIKENIKNSSVPRRTLKMIQPSASGSLVGRENELSAGLSKRKHRNDHLTSTTSSPGVIVPESSENKNLGGVTQESFDLMIKENPSSQYWKEVAEKRRKALYEALKENEKENKELAEVAEHVQYMAELIERLNGEPLDNFESLDNQEFDSEEETVEDSLVEDSEIGTCAEGTVSSSTDAKPCI

SEQ ID NO: 838211 - protein, 195 aa, Homo sapiens
MGSQSSKAPRGDVTAEEAAGASPAKANGQENGHVKSNGDLSPKGEGESPPVNGTDEAAGATGDAIEPAPPSQGAEAKGEVPPKETPKKKKKFSFKKPFKLSGLSFKRNRKEGGGDSSASSPTEEEQEQGEIGACSDEGTAQEGKAAATPESQEPQAKGAEASAASEEEAGPQATEPSTPSGPESGPTPASAEQNE

SEQ ID NO: 838212 - protein, 230 aa, Homo sapiens
RSGAAAGAASGPTPPYYPLRREPGAAPSAPQQTPIMGSQSSKAPRGDVTAEEAAGASPAKANGQENGHVKSNGDLSPKGEGESPPVNGTDEAAGATGDAIEPAPPSQGAEAKGEVPPKETPKKKKKFSFKKPFKLSGLSFKRNRKEGGGDSSASSPTEEEQEQGEIGACSDEGTAQEGKAAATPESQEPQAKGAEASAASEEEAGPQATEPSTPSGPESGPTPASAEQNE

SEQ ID NO: 838213 - protein, 225 aa, Homo sapiens
GFYKRTEPRGVATNWMWENPQEGEEERERVLGGGNSPFLSGHRKVAILLAASPAKANGQENGHVKSNGDLSPKGEGESPPVNGTDEAAGATGDAIEPAPPSQGAEAKGEVPPKETPKKKKKFSFKKPFKLSGLSFKRNRKEGGGDSSASSPTEEEQEQGEIGACSDEGTAQEGKAAATPESQEPQAKGAEASAASEEEAGPQATEPSTPSGPESGPTPASAEQNE

SEQ ID NO: 838214 - protein, 195 aa, Homo sapiens; identical to SEQ ID NO: 838211

SEQ ID NO: 838215 - protein, 195 aa, Homo sapiens; identical to SEQ ID NO: 838211

SEQ ID NO: 838216 - protein, 195 aa, Homo sapiens; identical to SEQ ID NO: 838211

SEQ ID NO: 838217 - protein, 195 aa, Homo sapiens; identical to SEQ ID NO: 838211

SEQ ID NO: 838218 - protein, 195 aa, Homo sapiens; identical to SEQ ID NO: 838211

SEQ ID NO: 838219 - protein, 228 aa, Homo sapiens
GAERRRAQLAGRPRSGGAARLPPAPLPLGAAPPRRDPPISPGGRRLQSAPPARTPHPVGKSRSCQRVSTRGRTVDLPEVRAEKAAIPRARGPTEPGKTWAHRRTIVKCGGTLFAAKRAWHRRHVSPQLVQARQQDSKARHRRATQEANDQIVKAQAVSLSPGVARRAQRRAGSPPQRVERPEGKKTAKIALCKKAFSKHLRRACSFQGGHSRRKRCGGWILYMALRLT

SEQ ID NO: 838220 - protein, 200 aa, Homo sapiens
MALRGDLSCRWRRSARRSLSSHMRSMALSEKLAMFECALGEELSRGIGMYRESPPVNGTDEAAGATGDAIEPAPPSQGAEAKGEVPPKETPKKKKKFSFKKPFKLSGLSFKRNRKEGGGDSSASSPTEEEQEQGEIGACSDEGTAQEGKAAATPESQEPQAKGAEASAASEEEAGPQATEPSTPSGPESGPTPASAEQNE

SEQ ID NO: 838221 - protein, 111 aa, Homo sapiens
TEEVDSTEEVDSTEEVDSWTAQRRWTAGQHRGGGQLDSTEEVDSKGWGRWVISKLQKLCCPCEVTAWTWCPGCLPVPRKEGAIASSQPRSLSSSPSCGFSHQPSGSPLKAS

SEQ ID NO: 838222 - protein, 195 aa, Homo sapiens; identical to SEQ ID NO: 838211

SEQ ID NO: 838223 - protein, 705 aa, Homo sapiens
DLIFQVFAGVVWLQNRNENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTGENPIYKSAVTTVVNPKYEGK

SEQ ID NO: 838224 - protein, 774 aa, Homo sapiens
DLIFQVFAGVVWLQNRNENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTGENPIYKSAVTTVVNPKYEGK

SEQ ID NO: 838225 - protein, 287 aa, Homo sapiens
MDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTGENPIYKSAVTTVVNPKYEGK

SEQ ID NO: 838226 - protein, 783 aa, Homo sapiens
DLIFQVFAGVVWLQNRNENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTVSYKTSKKQSGL

SEQ ID NO: 838227 - protein, 691 aa, Homo sapiens
DLIFQVFAGVVWLQNRNENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTGENPIYKSAVTTVVNPKYEGK

SEQ ID NO: 838228 - protein, 813 aa, Homo sapiens
DLIFQVFAGVVWLQNRNENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTPGVQWCDISSLQPLTSRFQQFSCLSLPSTWDYRVKILFIRVP

SEQ ID NO: 838229 - protein, 792 aa, Homo sapiens
DLIFQVFAGVVWLQNRNENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTGENPIYKSAVTTVVNPKYEGK

SEQ ID NO: 838230 - protein, 792 aa, Homo sapiens; identical to SEQ ID NO: 838229

SEQ ID NO: 838231 - protein, 792 aa, Homo sapiens; identical to SEQ ID NO: 838229

SEQ ID NO: 838232 - protein, 792 aa, Homo sapiens; identical to SEQ ID NO: 838229

SEQ ID NO: 838233 - protein, 792 aa, Homo sapiens; identical to SEQ ID NO: 838229

SEQ ID NO: 838234 - protein, 792 aa, Homo sapiens; identical to SEQ ID NO: 838229

SEQ ID NO: 838235 - protein, 783 aa, Homo sapiens; identical to SEQ ID NO: 838226

SEQ ID NO: 838236 - protein, 594 aa, Homo sapiens
DLIFQVFAGVVWLQNRNENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGKWGFAKCPCVVKCKPPNNWANAMVDWFLWN

SEQ ID NO: 838237 - protein, 315 aa, Homo sapiens
DLIFQVFAGVVWLQNRNENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYVSAWFLT

SEQ ID NO: 838238 - protein, 309 aa, Homo sapiens
DLIFQVFAGVVWLQNRNENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENYFFPIELIFE

SEQ ID NO: 838239 - protein, 279 aa, Homo sapiens
DLIFQVFAGVVWLQNRNENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPLLCKEPMRVGSLQRQEDEEDKPRQVEVHQEPGAAVPRGQEAPEGKGRETGENRAPLALDPVLRAPGGRPGPSQELNQRS

SEQ ID NO: 838240 - protein, 792 aa, Homo sapiens; identical to SEQ ID NO: 838229

SEQ ID NO: 838241 - protein, 758 aa, Homo sapiens
HEQPFFFKASKSSHRAEVGIPSCKNVEFVHHPQFGPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTGENPIYKSAVTTVVNPKYEGK

SEQ ID NO: 838242 - protein, 774 aa, Homo sapiens
DLIFQVFAGVVWLQNRNENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTGENPIYKSAVTTVVNPKYEGK

SEQ ID NO: 838243 - protein, 792 aa, Homo sapiens; identical to SEQ ID NO: 838229

SEQ ID NO: 838244 - protein, 795 aa, Homo sapiens
DLIFQVFAGVVWLQNRNENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTQENPIYKSPINNFKNPNYGRKAGL

SEQ ID NO: 838245 - protein, 792 aa, Homo sapiens; identical to SEQ ID NO: 838229

SEQ ID NO: 838246 - protein, 792 aa, Homo sapiens; identical to SEQ ID NO: 838229

SEQ ID NO: 838247 - protein, 792 aa, Homo sapiens; identical to SEQ ID NO: 838229

SEQ ID NO: 838248 - protein, 792 aa, Homo sapiens; identical to SEQ ID NO: 838229

SEQ ID NO: 838249 - protein, 761 aa, Homo sapiens
DLIFQVFAGVVWLQNRNENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRRWFLNTF

SEQ ID NO: 838250 - protein, 419 aa, Homo sapiens
DLIFQVFAGVVWLQNRNENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDESI

SEQ ID NO: 838251 - protein, 223 aa, Homo sapiens
DLIFQVFAGVVWLQNRNENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLILTI

SEQ ID NO: 838252 - protein, 48 aa, Homo sapiens
AKSLETRLLSLSLEKNTWDSEEAVPGPQSDRAGSLHTGALQGKAHIFC

SEQ ID NO: 838253 - protein, 75 aa, Homo sapiens
TFTNVSLCLDSSLPEASPETSPREGQVDPQVTGDATAVGWATLSSSFCRQRCVPLITLHQDPPQTVLWPLSGTQL

SEQ ID NO: 838254 - protein, 75 aa, Homo sapiens
WGVWGREKWRQGSPRVTSRGQPHCGEEGPPNNSMDNVDFTAPPPERPHRATGLNDTSLDPLEAWLVRVGGSPRES

SEQ ID NO: 838255 - protein, 120 aa, Homo sapiens
RTTRYMKQTLIELKGKLTTTTTTTTTTTKTRPRNFNTSLSVMNRTIRQKINKGAGLEQHYRPIGRDRYIYRTLHLTTEEYILFSSAHETLSKIDHIVSLNTLKKTEIIQSIFSDHSEINK

SEQ ID NO: 838256 - protein, 588 aa, Homo sapiens
MSSGLRAADFPRWKRHISEQLRRRDRLQRQAFEEIILQYNKLLEKSDLHSVLAQKLQAEKHDVPNRHEISPGHDGTWNDNQLQEMAQLRIKHQEELTELHKKRGELAQLVIDLNNQMQRKDREMQMNEAKIAECLQTISDLETECLDLRTKLCDLERANQTLKDEYDALQITFTALEGKLRKTTEENQELVTRWMAEKAQEANRLNAENEKDSRRRQARLQKELAEAAKEPLPVEQDDDIEVIVDETSDHTEETSPVRAISRAATRRSVSSFPVPQDNVDTHPGSGKEVRVPATALCVFDAHDGEVNAVQFSPGSRLLATGGMDRRVKLWEVFGEKCEFKGSLSGSNAGITSIEFDSAGSYLLAASNDFASRIWTVDDYRLRHTLTGHSGKVLSAKFLLDNARIVSGSHDRTLKLWDLRSKVCIKTVFAGSSCNDIVCTEQCVMSGHFDKKIRFWDIRSESIVREMELLGKITALDLNPERTELLSCSRDDLLKVIDLRTNAIKQTFSAPGFKCGSDWTRVVFSPDGSYVAAGSAEGSLYIWSVLTGKVEKVLSKQHSSSINAVAWSPSGSHVVSVDKGCKAVLWAQY

SEQ ID NO: 838257 - protein, 607 aa, Homo sapiens
MSSGLRAADFPRWKRHISEQLRRRDRLQRQAFEEIILQYNKLLEKSDLHSVLAQKLQAEKHDVPNRHEISPGHDGTWNDNQLQEMAQLRIKHQEELTELHKKRGELAQLVIDLNNQMQRKDREMQMNEAKIAECLQTISDLETECLDLRTKLCDLERANQTLKDEYDALQITFTALEGKLRKTTEENQELVTRWMAEKAQEANRLNAENEKDSRRRQARLQKELAEAAKEPLPVEQDDDIEVIVDETSDHTEETSPVRAISRAATKRLSQPAGGLLDSITNIFGRRSVSSFPVPQDNVDTHPGSGKEVRVPATALCVFDAHDGEVNAVQFSPGSRLLATGGMDRRVKLWEVFGEKCEFKGSLSGSNAGITSIEFDSAGSYLLAASNDFASRIWTVDDYRLRHTLTGHSGKVLSAKFLLDNARIVSGSHDRTLKLWDLRSKVCIKTVFAGSSCNDIVCTEQCVMSGHFDKKIRFWDIRSESIVREMELLGKITALDLNPERTELLSCSRDDLLKVIDLRTNAIKQTFSAPGFKCGSDWTRVVFSPDGSYVAAGSAEGSLYIWSVLTGKVEKVLSKQHSSSINAVAWSPSGSHVVSVDKGCKAVLWAQY

SEQ ID NO: 838258 - protein, 262 aa, Homo sapiens
MSSGLRAADFPRWKRHISEQLRRRDRLQRQAFEEIILQYNKLLEKSDLHSVLAQKLQAEKHDVPNRHEISPGHDGTWNDNQLQEMAQLRIKHQEELTELHKKRGELAQLVIDLNNQMQRKDREMQMNEAKIAECLQTISDLETECLDLRTKLCDLERANQTLKDEYDALQITFTALEGKLRKTTEENQELVTRWMAEKAQEANRLNAENEKDSSEAGMPGCRKSSQEPPKDPLPVEQDDAIGGIVEEPFDTTNCWSASGIYN

SEQ ID NO: 838259 - protein, 216 aa, Homo sapiens
MSSGLRAADFPRWKRHISEQLRRRDRLQRQAFEEIILQYNKLLEKSDLHSVLAQKLQAEKHDVPNRHEISPGHDGTWNDNQLQEMAQLRIKHQEELTELHKKRGELAQLVIDLNNQMQRKDREMQMNEAKKSLQKQQRNLYQSNRMMTLRSLWMKLLITQKRPLLCEPSAEQPLSDSRSLLEAFWILSLISLGDALSLPSQSPRTMWILILVLVKK

SEQ ID NO: 838260 - protein, 607 aa, Homo sapiens; identical to SEQ ID NO: 838257

SEQ ID NO: 838261 - protein, 607 aa, Homo sapiens; identical to SEQ ID NO: 838257

SEQ ID NO: 838262 - protein, 265 aa, Homo sapiens [sequence omitted]

SEQ ID NO: 838263 - protein, 216 aa, Homo sapiens; identical to SEQ ID NO: 838259

SEQ ID NO: 838264 - protein, 265 aa, Homo sapiens [sequence omitted]

SEQ ID NO: 838265 - protein, 343 aa, Homo sapiens
MSSGLRAADFPRWKRHISEQLRRRDRLQRQAFEEIILQYNKLLEKSDLHSVLAQKLQAEKHDVPNRHEIRRRQARLQKELAEAAKEPLPVEQDDDIEVIVDETSDHTEETSPVRAISRAATKRLSQPAGGLLDSITNIFGLSESPLLGHHSSSDAARRRSVSSFPVPQDNVDTHPGSGKEVRVPATALCVFDAHDGEVNAVQFSPGSRLLATGGMDRRVKLWEVFGEKCEFKGSLSGSNAGITSIEFDSAGSYLLAASNDFASRIWTVDDYRLRHTLTGHSGKVLSAKFLLDNARIVSGSHDRTLKLWDLRSKVCEEIQSLCLCICLDVSVEVCVCTSEPAFM

SEQ ID NO: 838266 - protein, 607 aa, Homo sapiens; identical to SEQ ID NO: 838257

SEQ ID NO: 838267 - protein, 68 aa, Homo sapiens
APRRHSVSPCPGGGSGSSTGRRSQLERRGGPPVVEGVSCGAMAVVLPAVVEELLSEMAAAVQESARDS

SEQ ID NO: 838268 - protein, 68 aa, Homo sapiens; identical to SEQ ID NO: 838267

SEQ ID NO: 838269 - protein, 68 aa, Homo sapiens; identical to SEQ ID NO: 838267

SEQ ID NO: 838270 - protein, 134 aa, Homo sapiens
APRRHSVSPCPGGGSGSSTVPDEYLLSLKFLFGSSATQALDLVDRQSITLISSPSGRRVYQVLGSSSKTYTCLASCHYCSCPAFAFSVLRKSDSILCKHLLAVYLSQVMRTCQQLSVSDKQLTDILLMEKKQEA

SEQ ID NO: 838271 - protein, 68 aa, Homo sapiens; identical to SEQ ID NO: 838267

SEQ ID NO: 838272 - protein, 68 aa, Homo sapiens; identical to SEQ ID NO: 838267

SEQ ID NO: 838273 - protein, 131 aa, Homo sapiens
RSSLSKMPPPVQKSARIPDEYLLSLKFLFGSSATQALDLVDRQSITLISSPSGRRVYQVLGSSSKTYTCLASCHYCSCPAFAFSVLRKSDSILCKHLLAVYLSQVMRTCQQLSVSDKQLTDILLMEKKQEA

SEQ ID NO: 838274 - protein, 68 aa, Homo sapiens; identical to SEQ ID NO: 838267

SEQ ID NO: 838275 - protein, 68 aa, Homo sapiens; identical to SEQ ID NO: 838267

SEQ ID NO: 838276 - protein, 135 aa, Homo sapiens
SLITRGTGSFPLLSSFSHSEASHLRVKPRGQSGCTLKSISTFMQRPPFPPAASSQCLSMGGTRLRGSTGSPMALLKLSQHHTPVENVPPPPAFPPPQGSANSANSLQLPAPFSLAGVSPSKSLVLLILSWHLFFG

SEQ ID NO: 838277 - protein, 115 aa, Homo sapiens
MKMYFSKCRGQSGCTLKSISTFMQRPPFPPAASSQCLSMGGTRLRGSTGSPMALLKLSQHHTPVENVPPPPAFPPPQGSANSANSLQLPAPFSLAGVSPSKSLVLLILSWHLFFG

SEQ ID NO: 838278 - protein, 71 aa, Homo sapiens
MRRKEELRPFGEPRPKSSPNQGCDTLFGALGFLMSPSFRVPLRSPVPTVEATVVCLIQMQPHREPVPGYAR

SEQ ID NO: 838279 - protein, 70 aa, Homo sapiens
LAVHLALVPTEAELGKVNVHLGAGTLLIIGQRAEGGQPVSWPDEMLPQWLWEGVLCHSQFLSSSHHQAEQ

SEQ ID NO: 838280 - protein, 124 aa, Homo sapiens
MPACRLGPLAAALLLSLLLFGFTLVSGTGAEKTGVCPELQADQNCTQECVSDSECADNLKCCSAGCATFCSLPNDKEGSCPQVNINFPQLGLCRDQCQVDSQCPGQMKCCRNGCGKVSCVTPNF

SEQ ID NO: 838281 - protein, 109 aa, Homo sapiens
VLVQPGARGTRQSSLLLCLRLVVNAEQQQAVGGGRRLAGLGDNLKCCSAGCATFCSLPNDKEGSCPQVNINFPQLGLCRDQCQVDSQCPGQMKCCRNGCGKVSCVTPNF

SEQ ID NO: 838282 - protein, 124 aa, Homo sapiens; identical to SEQ ID NO: 838280

SEQ ID NO: 838283 - protein, 124 aa, Homo sapiens; identical to SEQ ID NO: 838280

SEQ ID NO: 838284 - protein, 264 aa, Homo sapiens
MTSIPFPGDRLLQVDGVILCGLTHKQAVQCLKGPGQVARLVLERRVPRSTQQCPSANDSMGDERTAVSLVTALPGRPSSCVSVTDGPKFEVKLKKNANGLGFSFVQMEKESCSHLKSDLVRIKRLFPGQPAEENGAIAAGDIILAVNGRSTEGLIFQEVLHLLRGAPQEVTLLLCRPPPGALPEMEQEWQTPELSADKEFTRATCTDSCTSPILDQEDSWRDSASPDAGEGLGLRPESSQKAIREAQWGQNRERPLGQFLDTFS

SEQ ID NO: 838285 - protein, 1017 aa, Homo sapiens
SGRARRRLRGSGCSRRGAAQGTLDRGRAAGKGGSGENPERRGVLQLLLLLLAAAEATARARARARAGATAPPAMAFANFRRILRLSTFEKRKSREYEHVRRDLDPNEVWEIVGELGDGAFGKVYKAKNKETGALAAAKVIETKSEEELEDYIVEIEILATCDHPYIVKLLGAYYHDGKLWIMIEFCPGGAVDAIMLELDRGLTEPQIQVVCRQMLEALNFLHSKRIIHRDLKAGNVLMTLEGDIRLGMAPEVVMCETMKDTPYDYKADIWSLGITLIEMAQIEPPHHELNPMRVLLKIAKSDPPTLLTPSKWSVEFRDFLKIALDKNPETRPSAAQLLEHPFVSSITSNKALRELVAEAKAEVMEEIEDGRDEGEEEDAVDAASTLENHTQNSSEVSPPSLNADKPLEESPSTPLAPSQSQDSVNEPCSQPSGDRSLQTTSPPVVAPGNENGLAVPVPLRKSRPVSMDARIQVAQEKQVAEQGGDLSPAANRSQKASQSRPNSSALETLGGEKLANGSLEPPAQAAPGPSKRDSDCSSLCTSESMDYGTNLSTDLSLNKEMGSLSIKDPKLYKKTLKRTRKFVVDGVEVSITTSKIISEDEKKDEEMRFLRRQELRELRLLQKEEHRNQTQLSNKHELQLEQMHKRFEQEINAKKKFFDTELENLERQQKQQVEKMEQDHAVRRREEARRIRLEQDRDYTRFQEQLKLMKKEVKNEVEKLPRQQRKESMKQKMEEHTQKKQLLDRDFVAKQKEDLELAMKRLTTDNRREICDKERECLMKKQELLRDREAALWEMEEHQLQERHQLVKQQLKDQYFLQRHELLRKHEKEREQMQRYNQRMIEQLKVRQQQEKARLPKIQRSEGKTRMAMYKKSLHINGGGSAAEQREKIKQFSQQEEKRQKSERLQQQQKHENQMRDMLAQCESNMSELQQLQNEKCHLLVEHETQKLKALDESHNQNLKEWRDKLRPRKKALEEDLNQKKREQEMFFKLSEEAECPNPSTPSKAAKFFPYSSADAS

SEQ ID NO: 838286 - protein, 1203 aa, Homo sapiens
SGRARRRLRGSGCSRRGAAQGTLDRGRAAGKGGSGENPERRGVLQLLLLLLAAAEATARARARARAGATAPPAMAFANFRRILRLSTFEKRKSREYEHVRRDLDPNEVWEIVGELGDGAFGKVYKAKNKETGALAAAKVIETKSEEELEDYIVEIEILATCDHPYIVKLLGAYYHDGKLWIMIEFCPGGAVDAIMLELDRGLTEPQIQVVCRQMLEALNFLHSKRIIHRDLKAGNVLMTLEGDIRLADFGVSAKNLKTLQKRDSFIGTPYWMAPEVVMCETMKDTPYDYKADIWSLGITLIEMAQIEPPHHELNPMRVLLKIAKSDPPTLLTPSKWSVEFRDFLKIALDKNPETRPSAAQLLEHPFVSSITSNKALRELVAEAKAEVMEEIEDGRDEGEEEDAVDAASTLENHTQNSSEVSPPSLNADKPLEESPSTPLAPSQSQDSVNEPCSQPSGDRSLQTTSPPVVAPGNENGLAVPVPLRKSRPVSMDARIQVAQEKQVAEQGGDLSPAANRSQKASQSRPNSSALETLGGEKLANGSLEPPAQAAPGPSKRDSDCSSLCTSESMDYGTNLSTDLSLNKEMGSLSIKMKQMEAQRSEEPAQGQVGVGRWTDPRLQTLNLPSGSHGLLLRELEGADSFPGLPDKSRGVTKLTMGHLTLYPKLILEEILYDFVFPSQMYLVKNTQRDSNIFAKQRGVTGAATANQLEAGKGSTVPTGHRDKHAQQLLPVSSVFLRTGILPLLFLKTLSEKKDPKLYKKTLKRTRKFVVDGVEVSITTSKIISEDEKKDEEMRFLRRQELRELRLLQKEEHRNQTQLSNKHELQLEQMHKRFEQEINAKKKFFDTELENLERQQKQQVEKMEQDHAVRRREEARRIRLEQDRDYTRFQEQLKLMKKEVKNEVEKLPRQQRKESMKQKMEEHTQKKQLLDRDFVAKQKEDLELAMKRLTTDNRREICDKERECLMKKQELLRDREAALWEMEEHQLQERHQLVKQQLKDQYFLQRHELLRKHEKEREQMQRYNQRMIEQLKVRQQQEKARLPKIQRSEGKTRMAMYKKSLHINGGGSAAEQREKIKQFSQQEEKRQKSERLQQQQKHENQMRDMLAQCESNMSELQQLQNEKCHLLVEHETQKLKALDESHNQNLKEWRDKLRPRKKALEEDLNQKKREQEMFFKLSEEAECPNPSTPSKAAKFFPYSSADAS

SEQ ID NO: 838287 - protein, 238 aa, Homo sapiens
LGGMSSADREAALWEMEEHQLQERHQLVKQQLKDQYFLQRHELLRKHEKEREQMQRYNQRMIEQLKVRQQQEKARLPKIQRSEGKTRMAMYKKSLHINGGGSAAEQREKIKQFSQQEEKRQKSERLQQQQKHENQMRDMLAQCESNMSELQQLQNEKCHLLVEHETQKLKALDESHNQNLKEWRDKLRPRKKALEEDLNQKKREQEMFFKLSEEAECPNPSTPSKAAKFFPYSSADAS

SEQ ID NO: 838288 - protein, 1041 aa, Homo sapiens
SGRARRRLRGSGCSRRGAAQGTLDRGRAAGKGGSGENPERRGVLQLLLLLLAAAEATARARARARAGATAPPAMAFANFRRILRLSTFEKRKSREYEHVRRDLDPNEVWEIVGELGDGAFGKVYKAKNKETGALAAAKVIETKSEEELEDYIVEIEILATCDHPYIVKLLGAYYHDGKLWIMIEFCPGGAVDAIMLELDRGLTEPQIQVVCRQMLEALNFLHSKRIIHRDLKAGNVLMTLEGDIRLADFGVSAKNLKTLQKRDSFIGTPYWMAPEVVMCETMKDTPYDYKADIWSLGITLIEMAQIEPPHHELNPMRVLLKIAKSDPPTLLTPSKWSVEFRDFLKIALDKNPETRPSAAQLLEHPFVSSITSNKALRELVAEAKAEVMEEIEDGRDEGEEEDAVDAASTLENHTQNSSEVSPPSLNADKPLEESPSTPLAPSQSQDSVNEPCSQPSGDRSLQTTSPPVVAPGNENGLAVPVPLRKSRPVSMDARIQVAQEKQVAEQGGDLSPAANRSQKASQSRPNSSALETLGGEKLANGSLEPPAQAAPGPSKRDSDCSSLCTSESMDYGTNLSTDLSLNKEMGSLSIKDPKLYKKTLKRTRKFVVDGVEVSITTSKIISEDEKKDEEMRFLRRQELRELRLLQKEEHRNQTQLSNKHELQLEQMHKRFEQEINAKKKFFDTELENLERQQKQQVEKMEQDHAVRRREEARRIRLEQDRDYTRFQEQLKLMKKEVKNEVEKLPRQQRKESMKQKMEEHTQKKQLLDRDFVAKQKEDLELAMKRLTTDNRREICDKERECLMKKQELLRDREAALWEMEEHQLQERHQLVKQQLKDQYFLQRHELLRKHEKEREQMQRYNQRMIEQLKVRQQQEKARLPKIQRSEGKTRMAMYKKSLHINGGGSAAEQREKIKQFSQQEEKRQKSERLQQQQKHENQMRDMLAQCESNMSELQQLQNEKCHLLVEHETQKLKALDESHNQNLKEWRDKLRPRKKALEEDLNQKKREQEMFFKLSEEAECPNPSTPSKAAKFFPYSSADAS

SEQ ID NO: 838289 - protein, 567 aa, Homo sapiens
SGRARRRLRGSGCSRRGAAQGTLDRGRAAGKGGSGENPERRGVLQLLLLLLAAAEATARARARARAGATAPPAMAFANFRRILRLSTFEKRKSREYEHVRRDLDPNEVWEIVGELGDGAFGKVYKAKNKETGALAAAKVIETKSEEELEDYIVEIEILATCDHPYIVKLLGAYYHDGKLWIMIEFCPGGAVDAIMLELDRGLTEPQIQVVCRQMLEALNFLHSKRIIHRDLKAGNVLMTLEGDIRLADFGVSAKNLKTLQKRDSFIGTPYWMAPEVVMCETMKDTPYDYKADIWSLGITLIEMAQIEPPHHELNPMRVLLKIAKSDPPTLLTPSKWSVEFRDFLKIALDKNPETRPSAAQLLEHPFVSSITSNKALRELVAEAKAEVMEEIEDGRDEGEEEDAVDAASTLENHTQNSSEVSPPSLNADKPLEESPSTPLAPSQSQDSVNEPCSQPSGDRSLQTTSPPVVAPGNENGLAVPVPLRKSRPVSMDARIQVAQEKQLAFQTWAGSLLDFSSGRKSIRGKWNAPAPGTWQKHRFCTSDGLLLGLRGLSWLPPDSDSTAAECI

SEQ ID NO: 838290 - protein, 199 aa, Homo sapiens
SGRARRRLRGSGCSRRGAAQGTLDRGRAAGKGGSGENPERRGVLQLLLLLLAAAEATARARARARAGATAPPAMAFANFRRILRLSTFEKRKSREYEHVRRDLDPNEVWEIVGELGDGAFGKVYKAKNKETGALAAAKVIETKSEEELEDYIVEIEILATCDHPYIVKLLGAYYHDGKLWVRLPPCLSQLSPHGLVLWS

SEQ ID NO: 838291 - protein, 127 aa, Homo sapiens
MVFPGQDPKLYKKTLKRTRKFVVDGVEVSITTSKIISEDEKKDEEMRFLRQAWEGPPMVVTGWGYGKRSGHWSFGERAVCLQHEVGESRRQKETHFACDPALPHLPNRSPIYPLIHSFIHPSIHLLT

SEQ ID NO: 838292 - protein, 1041 aa, Homo sapiens; identical to SEQ ID NO: 838288

SEQ ID NO: 838293 - protein, 60 aa, Homo sapiens
MVFPGQDPKLYKKTLKRTRKFVVDGVEVSITTSKIISEDEKKDEEMRFLRRQELRESPSN

SEQ ID NO: 838294 - protein, 464 aa, Homo sapiens
MLPLLFLKTLSEKKDPKLYKKTLKRTRKFVVDGVEVSITTSKIISEDEKKDEEMRFLRRQELRELRLLQKEEHRNQTQLSNKHELQLEQMHKRFEQEINAKKKFFDTELENLERQQKQQVEKMEQDHAVRRREEARRIRLEQDRDYTRFQEQLKLMKKEVKNEVEKLPRQQRKESMKQKMEEHTQKKQLLDRDFVAKQKEDLELAMKRLTTDNRREICDKERECLMKKQELLRDREAALWEMEEHQLQERHQLVKQQLKDQYFLQRHELLRKHEKEREQMQRYNQRMIEQLKVRQQQEKARLPKIQRSEGKTRMAMYKKSLHINGGGSAAEQREKIKQFSQQEEKRQKSERLQQQQKHENQMRDMLAQCESNMSELQQLQNEKCHLLVEHETQKLKALDESHNQNLKEWRDKLRPRKKALEEDLNQKKREQEMFFKLSEEAECPNPSTPSKAAKFFPYSSADAS

SEQ ID NO: 838295 - protein, 1041 aa, Homo sapiens; identical to SEQ ID NO: 838288

SEQ ID NO: 838296 - protein, 373 aa, Homo sapiens
SGRARRRLRGSGCSRRGAAQGTLDRGRAAGKGGSGENPERRGVLQLLLLLLAAAEATARARARARAGATAPPAMAFANFRRILRLSTFEKRKSREYEHVRRDLDPNEVWEIVGELGDGAFGKVYKAKNKETGALAAAKVIETKSEEELEDYIVEIEILATCDHPYIVKLLGAYYHDGKLWIMIEFCPGGAVDAIMLELDRGLTEPQIQVVCRQMLEALNFLHSKRIIHRDLKAGNVLMTLEGDIRLADFGVSAKNLKTLQKRDSFIGTPYWMAPEVVMCETMKDTPYDYKADIWSLGITLIEMAQIEPPHHELNPMRVLLKIAKSDPPTLLTPSKWSVEFRDFLKIALDKNPETRPSAAQLLEVSGFPSHSAP

SEQ ID NO: 838297 - protein, 125 aa, Homo sapiens
ARARARARAGATAPPAMAFANFRRILRLSTFEKRKSREYEHVRRDLDPNEVWEIVGELGDGAFGKVYKVRALRWVAGRASRGSGRKGCLSRTRPAWLRLRGLPGAEFGVPGPHPDDSCFLGGTSL

SEQ ID NO: 838298 - protein, 327 aa, Homo sapiens
MNFRQLLLHLPRYLGASGSPRRLWWSPSLDTISSVGSWRGRSSKSPAHWNQVVSEAEKIVGYPTSFMSLRCLLSDELSNIAMQVRKLVGTQHPLLTTARILRGDSMLAVLRALACSRHLPCLGSHFGGFEEPFSPPTALWEPLSGLAKAGAHSLSLQGGVEGEAPAGTGTACSACGPAGVPGGRGLGGPRTRSSQPALLAPGNGGLSTRASGCGGCTESPSSAGPLALCSISRRALAAFPRGRAGDLQPAMPEPPTHSMGSCAARTSPTSTTPYSTAPSPIDHPRAEECERTAQDWQAAPPAAPVRDPLGEASWAPESGGDVESLYI

SEQ ID NO: 838299 - protein, 348 aa, Homo sapiens
MNFRQLLLHLPRYLGASGSPRRLWWSPSLDTISSVGSWRGRSSKSPAHWNQVVSEAEKIVGYPTSFMSLRCLLSDELSNIAMQVRKLVGTQHPLLTTARGLVHDSWNSLQLRGLVVLLISKAAGPSSVNTSCQNYDMVSGIYSCQRSLAEITELIHIALLVHRGIVNLNELQSSDGPLKDMQFGNKIAILSGDFLLANACNGLALLQNTKVVELLASALMDLVQGVYHENSTSKESYITDDIGISTWKEQTFLSHGALLAKSCQAAMELAKHDAEVQNMAFQYGKHMAMSHKINSDVQPFIKEKTSDSMTFNLNSAPVVLHQEFLGRDLWIKQIGEAQEKGRLDYAKR

SEQ ID NO: 838300 - protein, 282 aa, Homo sapiens
MSLRCLLSDELSNIAMQVRKLVGTQHPLLTTARGLVHDSWNSLQLRGLVVLLISKAAGPSSVNTSCQNYDMVSGIYSCQRSLAEITELIHIALLVHRGIVNLNELQSSDGPLKDMQFGNKIAILSGDFLLANACNGLALLQNTKVVELLASALMDLVQGVYHENSTSKESYITDDIGISTWKEQTFLSHGALLAKSCQAAMELAKHDAEVQNMAFQYGKHMAMSHKINSDVQPFIKEKTSDSMTFNLNSAPVVLHQEFLGRDLWIKQIGEAQEKGRLDYAKR

SEQ ID NO: 838301 - protein, 143 aa, Homo sapiens
MNFRQLLLHLPRYLGASGSPRRLWWSPSLDTISSVGSWRGRSSKSPAHWNQVVSEAEKIVGYPTSFMSLRCLLSDELSNIAMQVRKLVGTQHPLLTTARGLVHDSWNSLQLRGLVVLLISKAAGPSSVNTSCQNYDMVSGIYS

SEQ ID NO: 838302 - protein, 359 aa, Homo sapiens
MNFRQLLLHLPRYLGASGSPRRLWWSPSLDTISSVGSWRGRSSKSPAHWNQVVSEAEKIVGYPTSFMSLRCLLSDELSNIAMQVRKLVGTQHPLLTTARGLVHDSWNSLQLRGLVVLLISKAAGPSSVNTSCQNYDMVSGIYSCQRSLAEITELIHIALLVHRGIVNLNELQSSDGPLKDMQFGNKIAILSGDFLLANACNGLALLQNTKVVELLASALMDLVQGVYHENSTSKESYITDDIGISTWKEQTFLSHGALLAKSCQAAMELAKHDAEVQNMAFQYGKHMAMSHKINSDVQPFIKEKTSDSMTFNLNSAPVVLHQEFLGRDLWIKQIGESSSTEVQLSNFQQMLLSTLLSTA

SEQ ID NO: 838303 - protein, 399 aa, Homo sapiens
MNFRQLLLHLPRYLGASGSPRRLWWSPSLDTISSVGSWRGRSSKSPAHWNQVVSEAEKIVGYPTSFMSLRCLLSDELSNIAMQVRKLVGTQHPLLTTARGLVHDSWNSLQLRGLVVLLISKAAGPSSVNTSCQNYDMVSGIYSCQRSLAEITELIHIALLVHRGIVNLNELQSSDGPLKDMQFGNKIAILSGDFLLANACNGLALLQNTKVVELLASALMDLVQGVYHENSTSKESYITDDIGISTWKEQTFLSHGALLAKSCQAAMELAKHDAEVQNMAFQYGKHMAMSHKINSDVQPFIKEKTSDSMTFNLNSAPVVLHQEFLGRDLWIKQIGEAQEKGRLDYAKLRERIKAGKGVTSAIDLCRYHGNKALEALESFPPSEARSALENIVFAVTRFS

SEQ ID NO: 838304 - protein, 220 aa, Homo sapiens
SGVSLLAAEDVSGCHGGLVHDSWNSLQLRGLVVLLISKAAGPSSVNTSCQNYDMVSGIYSCQRSLAEITELIHIALLVHRGIVNLNELQSSDGPLKDMQFGNKIAILSGDFLLANACNGLALLQNTKVVELLASALMDLVQGVYHENSTSKESYITDDIGISTWKEQTFLSHGALLAKSCQAAMELAKHDAEVQNMAFQYGKHMAMSHKAQEKGRLDYAK

SEQ ID NO: 838305 - protein, 212 aa, Homo sapiens
MVSGIYSCQRSLAEITELIHIALLVHRGIVNLNELQSSDGPLKDMQFGNKIAILSGDFLLANACNGLALLQNTKVVELLASALMDLVQGVYHENSTSKESYITDDIGISTWKEQTFLSHGALLAKSCQAAMELAKHDAEVQNMAFQYGKHMAMSHKINSDVQPFIKEKTSDSMTFNLNSAPVVLHQEFLGRDLWIKQIGEAQEKGRLDYAKR

SEQ ID NO: 838306 - protein, 240 aa, Homo sapiens
MNFRQLLLHLPRYLGASGSPRRLWWSPSLDTISSVGSWRGRSSKSPAHWNQVVSEAEKIVGYPTSFMSLRCLLSDELSNIAMQVRKLVGTQHPLLTTARGLVHDSWNSLQLRGLVVLLISKAAGPSSVNTSCQNYDMVSGIYSCQRSLAEITELIHIALLVHRGIVNLNELQSSDGPLKDMQFGNKIAILSGDFLLANACNGLALLQNTKSFSFNGPIAIYQMGDCESAWILSKHPRALS

SEQ ID NO: 838307 - protein, 365 aa, Homo sapiens
RATRTHARDRTSSLVERLKMAASQAVEEMRSRVVLGEFGVRNVHTTDFPGNYSGYDDAWDQDRFEKNFRVDVVHMDENSLEFDMVGIDAAIANAFRRILLAEVPTMAVEKVLVYNNTSIVQDEILAHRLGLIPIHADPRLFEYRNQGDEEGTEIDTLQFRLQVRCTRNPHAAKDSSDPNELYVNHKVYTRHMTWIPLGNQADLFPEGTIRPVHDDILIAQLRPGQEIDLLMHCVKGIGKDHAKFSPVATASYRLLPDITLLEPVEGEAAEELSRCFSPGVIEVQEVQGKKVARVANPRLDTFSREIFRNEKLKKVVRLARVRDHYIFSVESTGVLPPDVLVSEAIKVLMGKCRRFLDELDAVQMD

SEQ ID NO: 838308 - protein, 333 aa, Homo sapiens
RATRTHARDRTSSLVERLKMAASQAVEEMRSRVVLGEFGVRNVHTTDFPGNYSGYDDAWDQDRFEKNFRVDVVHMDENSLEFDMVGIDAAIANAFRRILLAEVPTMAVEKVLVYNNTSIVQDEILAHRLGLIPIHADPRLFEYRNQGDEEGTEIDTLQFRLQVRCTRNPHAAKDSSDPNELYVNHKVYTRHMTWIPLGNQADLFPEGTIRPVHDDILIAQLRPGQEIDLLMHCVKGIGKDHAKFSPVATASYRLLPDITLLEPVEGEAAEELSRCFSPGVIEVQEVQGKKVARVANPRLDTFSREIFRNEKLKKVVRLARVRDHYICEYEVVR

SEQ ID NO: 838309 - protein, 292 aa, Homo sapiens
RATRTHARDRTSSLVERLKMAASQAVEEMRSRVVLGEFGVRNVHTTDFPGNYSGYDDAWDQDRFEKNFRVDVVHMDENSLEFDMVGIDAAIANAFRRILLAEVPTMAVEKVLVYNNTSIVQDEILAHRLGLIPIHADPRLFEYRNQGDEEGTEIDTLQFRLQVRCTRNPHAAKDSSDPNELYVNHKVYTRHMTWIPLGNQADLFPEGTIRPVHDDILIAQLRPGQEIDLLMHCVKGIGKDHAKFSPVATASYRLLPDITLLEPVEGEAAEELSRCFSPGVIEVQEVQAGMRS

SEQ ID NO: 838310 - protein, 169 aa, Homo sapiens
RATRTHARDRTSSLVERLKMAASQAVEEMRSRVVLGEFGVRNVHTTDFPGNYSGYDDAWDQDRFEKNFRVDVVHMDENSLEFDMVGIDAAIANAFRRILLAEVPTMAVEKVLVYNNTSIVQDEILAHRLGLIPIHADPRLFEYRNQGEKMKFWEKWTIWVQILVDCDVG

SEQ ID NO: 838311 - protein, 291 aa, Homo sapiens
MDENSLEFDMVGIDAAIANAFRRILLAEVPTMAVEKVLVYNNTSIVQDEILAHRLGLIPIHADPRLFEYRNQGDEEGTEIDTLQFRLQVRCTRNPHAAKDSSDPNELYVNHKVYTRHMTWIPLGNQADLFPEGTIRPVHDDILIAQLRPGQEIDLLMHCVKGIGKDHAKFSPVATASYRLLPDITLLEPVEGEAAEELSRCFSPGVIEVQEVQGKKVARVANPRLDTFSREIFRNEKLKKVVRLARVRDHYIFSVESTGVLPPDVLVSEAIKVLMGKCRRFLDELDAVQMD

SEQ ID NO: 838312 - protein, 260 aa, Homo sapiens [sequence omitted]

SEQ ID NO: 838313 - protein, 315 aa, Homo sapiens
RATRTHARDRTSSLVERLKMAASQAVEEMRSRVVLGEFGVRNVHTTDFPGNYSGYDDAWDQDRFEKNFRVDVVHMDENSLEFDMVGIDAAIANAFRRILLAEVPTMAVEKVLVYNNTSIVQDEILAHRLGLIPIHADPRLFEYRNQGDEEGTEIDTLQFRLQVRCTRNPHAAKDSSDPNELYVNHKVYTRHMTWIPLGNQADLFPEGTIRPVHDDILIAQLRPGQEIDLLMHCVKGIGKKVARVANPRLDTFSREIFRNEKLKKVVRLARVRDHYIFSVESTGVLPPDVLVSEAIKVLMGKCRRFLDELDAVQMD

SEQ ID NO: 838314 - protein, 361 aa, Homo sapiens
RATRTHARDRTSSLVERLKMAASQAVEEMRSRVVLGEFGVRNVHTTDFPGNYSGYDDAWDQDRFEKNFRVDVVHMDENSLEFDMVGIDAAIANAFRRILLAEVPTMAVEKVLVYNNTSIVQDEILAHRLGLIPIHADPRLFEYRNQGDEEGTEIDTLQFRLQVRCTRNPHAAKDSSDPNELYVNHKVYTRHMTWIPLGNQADLFPEGTIRPVHDDILIAQLRPGQEIDLLMHCVKGIGKDHAKFSPVATASYRLLPDITLLEPVEGEAAEELSRCFSPGVIEVQEVQGKKVARVANPRLDTFSREIFRNEKLKKVVRLARVRDHYICKKDLLAAVAHTCNPSTLGGQGEWITGSRERDHPG

SEQ ID NO: 838315 - protein, 328 aa, Homo sapiens
RATRTHARDRTSSLVERLKMAASQAVEEMRSRVVLGEFGVRNVHTTDFPGNYSGYDDAWDQDRFEKNFRVDVVHMDENSLEFDMVGIDAAIANAFRRILLAEVPTMAVEKVLVYNNTSIVQDEILAHRLGLIPIHADPRLFEYRNQGDEEGTEIDTLQFRLQVRCTRNPHAAKDSSDPNELYVNHKVYTRHMTWIPLGNQADLFPEGTIRPVHDDILIAQLRPGQEIDLLMHCVKGIGKDHAKFSPVATASYRLLPDITLLEPVEGEAAEELSRCFSPGVIEVQEVQGKKVARVANPRLDTFSREIFRNEKLKKCRRFLDELDAVQMD

SEQ ID NO: 838316 - protein, 306 aa, Homo sapiens
RATRTHARDRTSSLVERLKMAASQAVEEMRSRVVLGEFGVRNVHTTDFPGNYSGYDDAWDQDRFEKNFRVDVVHMDENSLEFDMVGIDAAIANAFRRILLAEVPTMAVEKVLVYNNTSIVQDEILAHRLGLIPIHADPRLFEYRNQGDEEGTEIDTLQFRLQVRCTRNPHAAKDSSDPNELYVNHKVYTRHMTWIPLGNQADLFPEGTIRPVHDDILIAQLRPGQEIDLLMHCVKGIGKDHAKFSPVATASYRLLPDITLLEPVEGEAAEELSRCFSPGVIEVQEVQGMVFGMLFKLGPKLYFLSR

SEQ ID NO: 838317 - protein, 169 aa, Homo sapiens; identical to SEQ ID NO: 838310

SEQ ID NO: 838318 - protein, 118 aa, Homo sapiens
RATRTHARDRTSSLVERLKMAASQAVEEMRSRVVLGEFGVRNVHTTDFPGNYSGYDDAWDQDRFEKNFRVDVVHMDENSLEFDMVGIDAAIANAFRRILLAEVLAGMVTRLELLWELH

SEQ ID NO: 838319 - protein, 87 aa, Homo sapiens
MAKHLKFIARTVMVQEGNVESAYRTLNRILTMDGLIEDIKHRRYYEKPCRRRQRESYERCRRIYNMEMARKINFLMRKNRADPWQGC

SEQ ID NO: 838320 - protein, 75 aa, Homo sapiens
MVQEGNVESAYRTLNRILTMDGLIEDIKHRRYYEKPCRRRQRESYERCRRIYNMEMARKINFLMRKNRADPWQGC

SEQ ID NO: 838321 - protein, 75 aa, Homo sapiens; identical to SEQ ID NO: 838320

SEQ ID NO: 838322 - protein, 75 aa, Homo sapiens; identical to SEQ ID NO: 838320

SEQ ID NO: 838323 - protein, 75 aa, Homo sapiens; identical to SEQ ID NO: 838320

SEQ ID NO: 838324 - protein, 87 aa, Homo sapiens; identical to SEQ ID NO: 838319

SEQ ID NO: 838325 - protein, 160 aa, Homo sapiens
MLSPKPQQLNQQNCSPEHYEPQLKTQKDLAVLHIPLEEPVLYIDKPQINLTTSCSAYIPPSSANPDEGYKVSASTHVKTLGQGVAHEVEEMGYIFYPSPKEILTMDGLIEDIKHRRYYEKPCRRRQRESYERCRRIYNMEMARKINFLMRKNRADPWQGC

SEQ ID NO: 838326 - protein, 83 aa, Homo sapiens
LALHLHDNGGERLSAETLFIIPATILTMDGLIEDIKHRRYYEKPCRRRQRESYERCRRIYNMEMARKINFLMRKNRADPWQGC

SEQ ID NO: 838327 - protein, 75 aa, Homo sapiens; identical to SEQ ID NO: 838320

SEQ ID NO: 838328 - protein, 87 aa, Homo sapiens; identical to SEQ ID NO: 838319

SEQ ID NO: 838329 - protein, 279 aa, Homo sapiens
MHITGPENGDPVRPGVAMTDLATGLYAYGAIMAGLIQKYKTGKGLFIDCNLLSSQVACLSHIAANYLIGQKEAKRWGTAHGSIVPYQAFKTKDGYIVVGAGNNQQFATVCKILDLPELIDNSKYKTNHLRVHNRKELIKILSERFEEELTSKWLYLFEGSGVPYGPINNMKNVFAEPQNAVSGFQSLLHSLAHGPFLHLQGSARVLHNGLVMEMEHPTVGKISVPGPAVRYSKFKMSEARPPPLLGQHTTHILKEVLRYDDRAIGELLSAGVVDQHETH

SEQ ID NO: 838330 - protein, 149 aa, Homo sapiens
QFRHRCQILDLPELIDNSKYKTNHLRVHNRKELIKILSERFEEELTSKWLYLFEGSGVPYGPINNMKNVFAEPQVLHNGLVMEMEHPTVGKISVPGPAVRYSKFKMSEARPPPLLGQHTTHILKEVLRYDDRAIGELLSAGVVDQHETH

SEQ ID NO: 838331 - protein, 330 aa, Homo sapiens
HETESTYYLSVNRNKKSIAVNIKDPQGGVIELAAVCDVFVDEIAPHIIYCSITGYGQTGPISQRAGYDAVASAVSGLMHITGPENGDPVRPGVAMTDLATGLYAYGAIMAGLIQKYKTGKGLFIDCNLLSSQVACLSHIAANYLIGQKEAKRWGTAHGSIVPYQAFKTKDGYIVVGAGNNQQFATVCKILDLPELIDNSKYKTNHLRVHNRKELIKILSERFEEELTSKWLYLFEGSGVPYGPINNMKNVFAEPQVLHNGLVMEMEHPTVGKISVPGPAVRYSKFKMSEARPPPLLGQHTTHILKEVLRYDDRAIGELLSAGVVDQHETH

SEQ ID NO: 838332 - protein, 445 aa, Homo sapiens
MPSETHAMLATLARVAALRRTCLFSGRGGGRGLWTGRPQSDMNNIKPLEGVKILDLTRVLAGPFATMNLGDLGAEVIKVERPGAGDDTRTWGPPFVGTESTYYLSVNRNKKSIAVNIKDPKGVKIIKELAAVCDVFVENYVPGKLSAMGLGYEDIDEIAPHIIYCSITGYGQTGPISQRAGYDAVASAVSGLMHITGPENGDPVRPGVAMTDLATGLYAYGAIMAGLIQKYKTGKGLFIDCNLLSSQVACLSHIAANYLIGQKEAKRWGTAHGSIVPYQAFKTKDGYIVVGAGNNQQFATVCKILDLPELIDNSKYKTNHLRVHNRKELIKILSERFEEELTSKWLYLFEGSGVPYGPINNMKNVFAEPQVLHNGLVMEMEHPTVGKISVPGPAVRYSKFKMSEARPPPLLGQHTTHILKEVLRYDDRAIGELLSAGVVDQHETH

SEQ ID NO: 838333 - protein, 445 aa, Homo sapiens; identical to SEQ ID NO: 838332

SEQ ID NO: 838334 - protein, 361 aa, Homo sapiens
MPSETHAMLATLARVAALRRTCLFSGRGGGRGLWTGRPQSDMNNIKPLEGVKILDLTRVLAGPFATMNLGDLGAEVIKVERPGAGDDTRTWGPPFVGTESTYYLSVNRNKKSIAVNIKDPKGVKIIKELAAVCDVFVENYVPGKLSAMGLGYEDIDEIAPHIIYCSITGYGQTGPISQRAGYDAVASAVSGLMHITGPENGDPVRPGVAMTDLATGLYAYGAIMAGLIQKYKTGKGLFIDCNLLSSQVACLSHIAANYLIGQKEAKRWGTAHGSIVPYQAFKTKDGYIVVGAGNNQQFATVCKILDLPELIDNSKYKTNHLRVHNRKELIKILSERFEEELTSKWLYLFEGTAQRWSGGPT

SEQ ID NO: 838335 - protein, 318 aa, Homo sapiens
MPSETHAMLATLARVAALRRTCLFSGRGGGRGLWTGRPQSDMNNIKPLEGVKILDLTRVLAGPFATMNLGDLGAEVIKVERPGAGDDTRTWGPPFVGTESTYYLSVNRNKKSIAVNIKDPKGVKIIKELAAVCDVFVENYVPGKLSAMGLGYEDIDEIAPHIIYCSITGYGQTGPISQRAGYDAVASAVSGLMHITGPENGDPVRPGVAMTDLATGLYAYGAIMAGLIQKYKTGKGLFIDCNLLSSQVACLSHIAANYLIGQKEAKRWGTAHGSIVPYQLKPRMAIEVEQVPQSCQPLQDLELACVNDNSVSTTLRDP

SEQ ID NO: 838336 - protein, 68 aa, Homo sapiens
LLLRSQRSNCCYFIGPAVRYSKFKMSEARPPPLLGQHTTHILKEVLRYDDRAIGELLSAGVVDQHETH

SEQ ID NO: 838337 - protein, 445 aa, Homo sapiens; identical to SEQ ID NO: 838332

SEQ ID NO: 838338 - protein, 423 aa, Homo sapiens
MPSETHAMLATLARVAALRRTCLFSGRGGGRGLWTGRPQSDMNNIKPLEGVKILDLTRVLAGPFATMNLGDLGAEVIKVERPGAGDDTRTWGPPFVGTESTYYLSVNRNKKSIAVNIKDPKGVKIIKELAAVCDVFVENYVPGKLSAMGLGYEDIDEIAPHIIYCSITGYGQTGPISQRAGYDAVASAVSGLMHITGPEVACLSHIAANYLIGQKEAKRWGTAHGSIVPYQAFKTKDGYIVVGAGNNQQFATVCKILDLPELIDNSKYKTNHLRVHNRKELIKILSERFEEELTSKWLYLFEGSGVPYGPINNMKNVFAEPQNAVSGFQSLLHSLAHGPFLHLQGSARVLHNGLVMEMEHPTVGKISVPGPAVRYSKFKMSEARPPPLLGQHTTHILKEVLRYDDRAIGELLSAGVVDQHETH

SEQ ID NO: 838339 - protein, 445 aa, Homo sapiens; identical to SEQ ID NO: 838332

SEQ ID NO: 838340 - protein, 296 aa, Homo sapiens
MPSETHAMLATLARVAALRRTCLFSGRGGGRGLWTGRPQSDMNNIKPLEGVKILDLTRVLAGPFATMNLGDLGAEVIKVERPGAGDDTRTWGPPFVGTESTYYLSVNRNKKSIAVNIKDPKGVKIIKELAAVCDVFVENYVPGKLSAMGLGYEDIDEIAPHIIYCSITGYGQTGPISQRAGYDAVASAVSGLMHITGPENGDPVRPGVAMTDLATGLYAYGAIMAGLIQKYKTGKGLFIDCNLLSSQVACLSHIAANYLIGQKEAKRWGTAHGSIVPYQMRKRVCYFPEETQPVSG

SEQ ID NO: 838341 - protein, 190 aa, Homo sapiens; identical to SEQ ID NO: 738227

SEQ ID NO: 838342 - protein, 190 aa, Homo sapiens; identical to SEQ ID NO: 738227

SEQ ID NO: 838343 - protein, 190 aa, Homo sapiens; identical to SEQ ID NO: 738227

SEQ ID NO: 838344 - protein, 190 aa, Homo sapiens; identical to SEQ ID NO: 738227

SEQ ID NO: 838345 - protein, 195 aa, Homo sapiens
MKASQCCCCLSHLLASVLLLLLLPELSGPLAVLLQAAEAAPGLGPPDPRPRTLPPLPPGPTPAQQPGRGLAEAAGPRGSEGGNGSNPVAGLETDDHGGKAGEGSVGGGLAVSPNPGDKPMTQRALTVLMVVSGAVLVYFVVRTVRMRRRNRKTRRYGVLDTNIENMELTPLEQDDEDDDNTLFDANHPRRLLWNS

SEQ ID NO: 838346 - protein, 190 aa, Homo sapiens; identical to SEQ ID NO: 738227

SEQ ID NO: 838347 - protein, 107 aa, Homo sapiens
MLHGWGSGVVREGWRISEPSQISGQKCGGMGAAWPRPCCKGQGGRPSSLLSGLPLQGASRMTASSSGLGCSPPTSWRNGLPGRTTCFSMCAGSWRTPAAKAVQTGGR

SEQ ID NO: 838348 - protein, 387 aa, Homo sapiens
MWGYGRSLAKAMLQGPGWPSFLTPVWPPSAGCFKDDRIVFWTWMFSTYFMEKWAPRQDDMLFYVRRKLAYSGSESGADGRKAAEPEVEVEVYRRDSKKLPGLGDPDIDWEESVCLNLILQKQVFASPSKHPMDSKGEESKISYPNIFFMIDSFEEVFSDMTVGEGEMVCVELVASDKTNTFQGVIFQGSIRYEALKKVYDNRVSVAARMAQKMSFGFYKYSNMEFVRMKGPQGKGHAEMAVSRVSTGDTSPCGTEEDSSPASPMHERVTSFSTPPTPERNNRPAFFSPSLKRKVPRNRIAEMKKSHSANDSEEFFREDDGGADLHNATNLRSRSLSGTGRSLVGSWLKLNRADGNFLLYAHLTYVTLPLHRILTDILEVRQKPILMT

SEQ ID NO: 838349 - protein, 451 aa, Homo sapiens
FPASSPDTSQPVAFLAPRDFPFPPKLLIHPQAGVRLSCGAGSMGSQAAAEWRNWASWEVSSSLSGCSMGCFKDDRIVFWTWMFSTYFMEKWAPRQDDMLFYVRRKLAYSGSESGADGRKAAEPEVEVEVYRRDSKKLPGLGDPDIDWEESVCLNLILQKLDYMVTCAVCTRADGGDIHIHKKKSQQVFASPSKHPMDSKGEESKISYPNIFFMIDSFEEVFSDMTVGEGEMVCVELVASDKTNTFQGVIFQGSIRYEALKKVYDNRVSVAARMAQKMSFGFYKYSNMEFVRMKGPQGKGHAEMAVSRVSTGDTSPCGTEEDSSPASPMHERVTSFSTPPTPERNNRPAFFSPSLKRKVPRNRIAEMKKSHSANDSEEFFREDDGGADLHNATNLRSRSLSGTGRSLVGSWLKLNRADGNFLLYAHLTYVTLPLHRILTDILEVRQKPILMT

SEQ ID NO: 838350 - protein, 434 aa, Homo sapiens
GLRAGPPALPAAAAPEPAGGAEAEERSLQHMLRAIAEERGRLSLRREVCGLGCFKDDRIVFWTWMFSTYFMEKWAPRQDDMLFYVRRKLAYSGSESGADGRKAAEPEVEVEVYRRDSKKLPGLGDPDIDWEESVCLNLILQKLDYMVTCAVCTRADGGDIHIHKKKSQQVFASPSKHPMDSKGEESKISYPNIFFMIDSFEEVFSDMTVGEGEMVCVELVASDKTNTFQGVIFQGSIRYEALKKVYDNRVSVAARMAQKMSFGFYKYSNMEFVRMKGPQGKGHAEMAVSRVSTGDTSPCGTEEDSSPASPMHERVTSFSTPPTPERNNRPAFFSPSLKRKVPRNRIAEMKKSHSANDSEEFFREDDGGADLHNATNLRSRSLSGTGRSLVGSWLKLNRADGNFLLYAHLTYVTLPLHRILTDILEVRQKPILMT

SEQ ID NO: 838351 - protein, 343 aa, Homo sapiens
VIFFSPSLKRKVPRNRIAEMKKSHSSKKLPGLGDPDIDWEESVCLNLILQKLDYMVTCAVCTRADGGDIHIHKKKSQQVFASPSKHPMDSKGEESKISYPNIFFMIDSFEEVFSDMTVGEGEMVCVELVASDKTNTFQGVIFQGSIRYEALKKVYDNRVSVAARMAQKMSFGFYKYSNMEFVRMKGPQGKGHAEMAVSRVSTGDTSPCGTEEDSSPASPMHERVTSFSTPPTPERNNRPAFFSPSLKRKVPRNRIAEMKKSHSANDSEEFFREDDGGADLHNATNLRSRSLSGTGRSLVGSWLKLNRADGNFLLYAHLTYVTLPLHRILTDILEVRQKPILMT

SEQ ID NO: 838352 - protein, 151 aa, Homo sapiens
QSQAESTEPVGRRDWLGTQARPWRLPGWTCWVTSFSTPPTPERNNRPAFFSPSLKRKVPRNRIAEMKKSHSANDSEEFFREDDGGADLHNATNLRSRSLSGTGRSLVGSWLKLNRADGNFLLYAHLTYVTLPLHRILTDILEVRQKPILMT

SEQ ID NO: 838353 - protein, 451 aa, Homo sapiens; identical to SEQ ID NO: 838349

SEQ ID NO: 838354 - protein, 203 aa, Homo sapiens
GLRAGPPALPAAAAPEPAGGAEAEERSLQHMLRAIAEERGRLSLRREVCGLGCFKDDRIVFWTWMFSTYFMEKWAPRQDDMLFYVRRKLAYSGSESGADGRKAAEPEVEVEVYRRDSKKLPGLGDPDIDWEESVCLNLILQKLDYMVTCAVCTRADGGDIHIHKKKSQQVFASPSKHPMDSKGEESKISYPNIFFMIDSFEEL

SEQ ID NO: 838355 - protein, 352 aa, Homo sapiens
FPASSPDTSQPVAFLAPRDFPFPPKLLIHPQAGVRLSCGAGSMGSQAAAEWRNWASWEVSSSLSGCSMGCFKDDRIVFWTWMFSTYFMEKWAPRQDDMLFYVRRKLAYSGSESGADGRKAAEPEVEVEVYRRDSKKLPGLGDPDIDWEESVCLNLILQKLDYMVTCAVCTRADGGDIHIHKKKSQQVFASPSKHPMDSKGEESKISYPNIFFMIDSFEEVFSDMTVGEGEMVCVELVASDKTNTFQGVIFQGSIRYEALKKVYDNRVSVAARMAQKMSFGFYKYSNMEFVRMKGPQGKGHAEMAVSRVSTGDTSPCGTEEDSSPASPMHERDLLQHNPTPQFYDFHFAIVEL

SEQ ID NO: 838356 - protein, 338 aa, Homo sapiens
FPASSPDTSQPVAFLAPRDFPFPPKLLIHPQAGVRLSCGAGSMGSQAAAEWRNWASWEVSSSLSGCSMGCFKDDRIVFWTWMFSTYFMEKWAPRQDDMLFYVRRKLAYSGSESGADGRKAAEPEVEVEVYRRDSKKLPGLGDPDIDWEESVCLNLILQKLDYMVTCAVCTRADGGDIHIHKKKSQQVFASPSKHPMDSKGEESKISYPNIFFMIDSFEEVFSDMTVGEGEMVCVELVASDKTNTFQGVIFQGSIRYEALKKVYDNRVSVAARMAQKMSFGFYKYSNMEFVRMKGPQGKGHAEMAVSRVSTGDTSPCGTEEDSSPASPMHERDLLQHTP

SEQ ID NO: 838357 - protein, 408 aa, Homo sapiens
GLRAGPPALPAAAAPEPAGGAEAEERSLQHMLRAIAEERGRLSLRREVCGLGCFKDDRIVFWTWMFSTYFMEKWAPRQDDMLFYVRRKLAYSGSESGADGRKAAEPEVEVEVYRRDSKKLPGLGDPDIDWEESVCLNLILQKQVFASPSKHPMDSKGEESKISYPNIFFMIDSFEEVFSDMTVGEGEMVCVELVASDKTNTFQGVIFQGSIRYEALKKVYDNRVSVAARMAQKMSFGFYKYSNMEFVRMKGPQGKGHAEMAVSRVSTGDTSPCGTEEDSSPASPMHERVTSFSTPPTPERNNRPAFFSPSLKRKVPRNRIAEMKKSHSANDSEEFFREDDGGADLHNATNLRSRSLSGTGRSLVGSWLKLNRADGNFLLYAHLTYVTLPLHRILTDILEVRQKPILMT

SEQ ID NO: 838358 - protein, 413 aa, Homo sapiens
MWGYGRSLAKAMLQGPGWPSFLTPVWPPSAGCFKDDRIVFWTWMFSTYFMEKWAPRQDDMLFYVRRKLAYSGSESGADGRKAAEPEVEVEVYRRDSKKLPGLGDPDIDWEESVCLNLILQKLDYMVTCAVCTRADGGDIHIHKKKSQQVFASPSKHPMDSKGEESKISYPNIFFMIDSFEEVFSDMTVGEGEMVCVELVASDKTNTFQGVIFQGSIRYEALKKVYDNRVSVAARMAQKMSFGFYKYSNMEFVRMKGPQGKGHAEMAVSRVSTGDTSPCGTEEDSSPASPMHERVTSFSTPPTPERNNRPAFFSPSLKRKVPRNRIAEMKKSHSANDSEEFFREDDGGADLHNATNLRSRSLSGTGRSLVGSWLKLNRADGNFLLYAHLTYVTLPLHRILTDILEVRQKPILMT

SEQ ID NO: 838359 - protein, 413 aa, Homo sapiens; identical to SEQ ID NO: 838358

SEQ ID NO: 838360 - protein, 451 aa, Homo sapiens; identical to SEQ ID NO: 838349

SEQ ID NO: 838361 - protein, 451 aa, Homo sapiens; identical to SEQ ID NO: 838349

SEQ ID NO: 838362 - protein, 466 aa, Homo sapiens
FPASSPDTSQPVAFLAPRDFPFPPKLLIHPQAGVRLSCGAGSMGSQAAAEWRNWASWEVSSSLSGCSMGCFKDDRIVFWTWMFSTYFMEKWAPRQDDMLFYVRRKLAYSGSESGADGRKAAEPEVEVEVYRRDSKKLPGLGDPDIDWEESVCLNLILQKLDYMVTCAVCTRADGGDIHIHKKKSQQVFASPSKHPMDSKGEESKISYPNIFFMIDSFEEVFSDMTVGEGEMVCVELVASDKTNTFQGVIFQGSIRYEALKKVYDNRVSVAARMAQKMSFGFYKYSNMEFVRMKGPQGKGHAEMAVSRVSTGDTSPCGTEEDSSPASPMHERVTSFSTPPTPERNNRPAFFSPSLKRKVPRNRIAEMKKSHSANDSEEFFREDDGGADLQCNQTEGSACGGPDGPVGRLSERAKKLLLKDNNQSSAGVGLTTPELGNSNKGGSGNRGHPRADTAARVSLKTEHTGQP

SEQ ID NO: 838363 - protein, 203 aa, Homo sapiens; identical to SEQ ID NO: 838354

SEQ ID NO: 838364 - protein, 164 aa, Homo sapiens
MSEPAGDVRQNPCGSKACRRLFGPVDSEQLSRDCDALMAGCIQEARERWNFDFVTETPLEGDFAWERVRGLGLPKLYLPTGPRRGRDELGGGRRPGTSPALLQGTAEEDHVDLSLSCTLVPRSGEQAEGSPGGPGDSQGRKRRQTSMTDFYHSKRRLIFSKRKP

SEQ ID NO: 838365 - protein, 164 aa, Homo sapiens; identical to SEQ ID NO: 838364

SEQ ID NO: 838366 - protein, 164 aa, Homo sapiens; identical to SEQ ID NO: 838364

SEQ ID NO: 838367 - protein, 190 aa, Homo sapiens
EGDGRRQETSKDPSCCNHRDFFCSGAMSEPAGDVRQNPCGSKACRRLFGPVDSEQLSRDCDALMAGCIQEARERWNFDFVTETPLEGDFAWERVRGLGLPKLYLPTGPRRGRDELGGGRRPGTSPALLQGTAEEDHVDLSLSCTLVPRSGEQAEGSPGGPGDSQGRKRRQTSMTDFYHSKRRLIFSKRKP

SEQ ID NO: 838368 - protein, 164 aa, Homo sapiens; identical to SEQ ID NO: 838364

SEQ ID NO: 838369 - protein, 164 aa, Homo sapiens; identical to SEQ ID NO: 838364

SEQ ID NO: 838370 - protein, 181 aa, Homo sapiens
MSEPAGDVRQNPCGSKACRRLFGPVDSEQLSRDCDALMAGCIQEARERWNFDFVTETPLEGDFAWERVRGLGLPKLYLPTGPRRGRDELGGGRRPGTSPALLQGTAEEDHVDLSLSCTLVPRSGEQAEGSPGGPGDSQGRKRRQTSMTGRRGGKILREAALLRIAFAENIPASTKPFRANS

SEQ ID NO: 838371 - protein, 164 aa, Homo sapiens; identical to SEQ ID NO: 838364

SEQ ID NO: 838372 - protein, 94 aa, Homo sapiens
QRIAKNRHSGGGAGLWLVTAVRNPSRDRVDVPRVLPVLSSRPHWPQGRVSWPPTVFLSWAAPPRPLLLGLADFCCLSSDFYHSKRRLIFSKRKP

SEQ ID NO: 838373 - protein, 164 aa, Homo sapiens; identical to SEQ ID NO: 838364

SEQ ID NO: 838374 - protein, 95 aa, Homo sapiens
QGTAEEDHVDLSLSCTLVPRSGEQAEGSPGGPGDSQGRKRRQTSMTGADMCTEGLCKGPGFSESMVQGLTCLVLVQHAPGRRKQAQRGEATSLRS

SEQ ID NO: 838375 - protein, 164 aa, Homo sapiens; identical to SEQ ID NO: 838364

SEQ ID NO: 838376 - protein, 164 aa, Homo sapiens; identical to SEQ ID NO: 838364

SEQ ID NO: 838377 - protein, 164 aa, Homo sapiens; identical to SEQ ID NO: 838364

SEQ ID NO: 838378 - protein, 182 aa, Homo sapiens
GIEEAGGYLSLGCLFSGAMSEPAGDVRQNPCGSKACRRLFGPVDSEQLSRDCDALMAGCIQEARERWNFDFVTETPLEGDFAWERVRGLGLPKLYLPTGPRRGRDELGGGRRPGTSPALLQGTAEEDHVDLSLSCTLVPRSGEQAEGSPGGPGDSQGRKRRQTSMTDFYHSKRRLIFSKRKP

SEQ ID NO: 838379 - protein, 230 aa, Homo sapiens
RKGMVGDRRPLKTPVRSPDFSEPQFPQQCIRAMWGVFRRQTTHSSNPPLPGQQSCCNHRDFFCSGAMSEPAGDVRQNPCGSKACRRLFGPVDSEQLSRDCDALMAGCIQEARERWNFDFVTETPLEGDFAWERVRGLGLPKLYLPTGPRRGRDELGGGRRPGTSPALLQGTAEEDHVDLSLSCTLVPRSGEQAEGSPGGPGDSQGRKRRQTSMTDFYHSKRRLIFSKRKP

SEQ ID NO: 838380 - protein, 190 aa, Homo sapiens
MSEPAGDVRQNPCGSKACRRLFGPVDSEQLSRDCDALMAGCIQEARERWNFDFVTETPLEGDFAWERVRGLGLPKLYLPTGPRRGRDELGGGRRPGTSPALLQGTAEEDHVDLSLSCTLVPRSGEQAEGSPGGPGDSQGRKRRQTSMTGVLTLLARLECSDTIMAHCSFKLLGSSDLPTSASWVAGKLGL

SEQ ID NO: 838381 - protein, 178 aa, Homo sapiens
MSEPAGDVRQNPCGSKACRRLFGPVDSEQLSRDCDALMAGCIQEARERWNFDFVTETPLEGDFAWERVRGLGLPKLYLPTGPRRGRDELGGGRRPGTSPALLQGTAEEDHVDQPGQHGEISTKNTKIGWAWWCTLVIPATWKAEVGGSLEPRRQRLQSAEIIPLYSSLFQGDSEIHLK

SEQ ID NO: 838382 - protein, 519 aa, Homo sapiens
NNFANSDRPMKATAFPAEVKDLTKRIRTVLMATAQMKEHEKDPEMLIDLQYSLAKSYASTPELRKTWLDSMAKIHVKNGDFSEAAMCYVHVAALVAEFLHRKKLFPNGCSAFKKITPNIDEEGAMKEDAGMMDVHYSEEVLLELLEQCVDGLWKAERYEIISEISKLIVPIYEKRREFEKLTQVYRTLHGAYTKILEVMHTKKRLLGTFFRVAFYGQSFFEEEDGKEYIYKEPKLTGLSEISLRLVKLYGEKFGTENVKIIQDSDKVNAKELDPKYAHIQVTYVKPYFDDKELTERKTEFERNHNISRFVFEAPYTLSGKKQGCIEEQCKRRTILTTSNSFPYVKKRIPINCEQQINLKPIDVATDEIKDKTAELQKLCSSTDVDMIQLQLKLQGCVSVQVNAGPLAYARAFLNDSQASKYPPKKVSELKDMFRKFIQACSIALELNERLIKEDQVEYHEGLKSNFRDMVKELSDIIHEQILQEDTMHSPWMSNTLHVFCAISGTSSDRGYGSPRYAEV

SEQ ID NO: 838383 - protein, 519 aa, Homo sapiens; identical to SEQ ID NO: 838382

SEQ ID NO: 838384 - protein, 244 aa, Homo sapiens
RSGAALRRGGRAGGRSGAGGARRVGLAISRSLRFAISGFVWRLAAPASAAAELRLDCSARRAPRCPRPALPSTRSVSEPGSRGFRGRGVATSGGGADLHAPGQAWRTMPGWIEPAPTAAPPPEPVVPLPFPGCKEQRGFFFFNAEVLVFGFFFKFRMCRSARRGPRGRHRSWTPRSACVRPKPAATLRGMRVGADRSLREAGESWPGSPSLSWENLGESSGAGLWAPPEPPRTPGAPPGTLSAA

SEQ ID NO: 838385 - protein, 764 aa, Homo sapiens
MNGEADCPTDLEMAAPKGQDRWSQEDMLTLLECMKNNLPSNDSSKFKTTESHMDWEKVAFKDFSGDMCKLKWVEISNEVRKFRTLTELILDAQEHVKNPYKGKKLKKHPDFPKKPLTPYFRFFMEKRAKYAKLHPEMSNLDLTKILSKKYKELPEKKKMKYIQDFQREKQEFERNLARFREDHPDLIQNAKKSDIPEKPKTPQQLWYTHEKKVYLKVRPDATTKEVKDSLGKQWSQLSDKKRLKWIHKALEQRKEYEEIMRDYIQKHPELNISEEGITKSTLTKAERQLKDKFDGRPTKPPPNSYSLYCAELMANMKDVPSTERMVLCSQQWKLLSQKEKDAYHKKCDQKKKDYEVELLRFLESLPEEEQQRVLGEEKMLNINKKQATSPASKKPAQEGGKGGSEKPKRPVSAMFIFSEEKRRQLQEERPELSESELTRLLARMWNDLSEKKKAKYKAREAALKAQSERKPGGEREERGKLPESPKRAEEIWQQSVIGDYLARFKNDRVKALKAMEMTWNNMEKKEKLMWIKKAAEDQKRYERELSEMRAPPAATNSSKKMKFQGEPKKPPMNGYQKFSQELLSNGELNHLPLKERMVEIGSRWQRISQSQKEHYKKLAEEQQKQYKVHLDLWVKSLSPQDRAAYKEYISNKRKSMTKLRGPNPKSSRTTLQSKSESEEDDEEDEDDEDEDEEEEDDENGDSSEDGGDSSESSSEDESEDGDENEEDDEDEDDDEDDDEDEDNESEGSSSSSSSSGDSSDSDSN

SEQ ID NO: 838386 - protein, 764 aa, Homo sapiens; identical to SEQ ID NO: 838385

SEQ ID NO: 838387 - protein, 727 aa, Homo sapiens
MNGEADCPTDLEMAAPKGQDRWSQEDMLTLLECMKNNLPSNDSSKFKTTESHMDWEKVAFKDFSGDMCKLKWVEISNEVRKFRTLTELILDAQEHVKNPYKGKKLKKHPDFPKKPLTPYFRFFMEKRAKYAKLHPEMSNLDLTKILSKKYKELPEKKKMKYIQDFQREKQEFERNLARFREDHPDLIQNAKKSDIPEKPKTPQQLWYTHEKKVYLKVRPDEIMRDYIQKHPELNISEEGITKSTLTKAERQLKDKFDGRPTKPPPNSYSLYCAELMANMKDVPSTERMVLCSQQWKLLSQKEKDAYHKKCDQKKKDYEVELLRFLESLPEEEQQRVLGEEKMLNINKKQATSPASKKPAQEGGKGGSEKPKRPVSAMFIFSEEKRRQLQEERPELSESELTRLLARMWNDLSEKKKAKYKAREAALKAQSERKPGGEREERGKLPESPKRAEEIWQQSVIGDYLARFKNDRVKALKAMEMTWNNMEKKEKLMWIKKAAEDQKRYERELSEMRAPPAATNSSKKMKFQGEPKKPPMNGYQKFSQELLSNGELNHLPLKERMVEIGSRWQRISQSQKEHYKKLAEEQQKQYKVHLDLWVKSLSPQDRAAYKEYISNKRKSMTKLRGPNPKSSRTTLQSKSESEEDDEEDEDDEDEDEEEEDDENGDSSEDGGDSSESSSEDESEDGDENEEDDEDEDDDEDDDEDEDNESEGSSSSSSSSGDSSDSDSN

SEQ ID NO: 838388 - protein, 764 aa, Homo sapiens; identical to SEQ ID NO: 838385

SEQ ID NO: 838389 - protein, 727 aa, Homo sapiens; identical to SEQ ID NO: 838387

SEQ ID NO: 838390 - protein, 720 aa, Homo sapiens
MNGEADCPTDLEMAAPKGQDRWSQEDMLTLLECMKNNLPSNDSSKFKTTESHMDWEKVAFKDFSGDMCKLKWVEISNEVRKFRTLTELILDAQEHVKNPYKGKKLKKHPDFPKKPLTPYFRFFMEKRAKYAKLHPEMSNLDLTKILSKKYKELPEKKKMKYIQDFQREKQEFERNLARFREDHPDLIQNAKKSDIPEKPKTPQQLWYTHEKKVYLKVRPDEIMRDYIQKHPELNISEEGITKSTLTKAERQLKDKFDGRPTKPPPNSYSLYCAELMANMKDVPSTERMVLCSQQWKLLSQKEKDAYHKKCDQKKKDYEVELLRFLESLPEEEQQRVLGEEKMLNINKKQATSPASKKPAQEGGKGGSEKPKRPVSAMFIFSEEKRRQLQEERPELSESELTRLLARMWNDLSEKKKAKYKAREAALKAQSERKPGGEREERGKLPESPKRAEEIWQQSVIGDYLARFKNDRVKALKAMEMTWNNMEKKEKLMWIKKAAEDQKRYERELSEMRAPPAATNSSKKMKFQGEPKKPPMNGYQKFSQELLSNGELNHLPLKERMVEIGSRWQRISQSQKEHYKKLAEEQQKQYKVHLDLWVKSLSPQDRAAYKEYISNKRKSMTKLRGPNPKSSRTTLQSKSESEEDDEEDEDDEDEDEEEEDDENGDSSESSSEDESEDGDENEEDDEDEDDDEDDDEDEDNESEGSSSSSSSSGDSSDSDSN

SEQ ID NO: 838391 - protein, 91 aa, Homo sapiens
EDDEDEDDDEDDDEHEDNSEGSSSSSLDSSEDGGDSSESSSEDESEDGDENEEDDEDEDDDEDDDEDEDNESEGSSSSSSSSGDSSDSDSN

SEQ ID NO: 838392 - protein, 727 aa, Homo sapiens; identical to SEQ ID NO: 838387

SEQ ID NO: 838393 - protein, 443 aa, Homo sapiens
MNGEADCPTDLEMAAPKGQDRWSQEDMLTLLECMKNNLPSNDSSKFKTTESHMDWEKVAFKDFSGDMCKLKWVEISNEVRKFRTLTELILDAQEHVKNPYKGKKLKKHPDFPKKPLTPYFRFFMEKRAKYAKLHPEMSNLDLTKILSKKYKELPEKKKMKYIQDFQREKQEFERNLARFREDHPDLIQNAKKSDIPEKPKTPQQLWYTHEKKVYLKVRPDEIMRDYIQKHPELNISEEGITKSTLTKAERQLKDKFDGRPTKPPPNSYSLYCAELMANMKDVPSTERMVLCSQQWKLLSQDSNYQTKPAPDQPGPPHPLLHLRFRHGQWTGEWGWGVPKSLMRPSTPAAQSKVGWKLGEDPFLPRGACHLDPCIGTGGREHGEEEGRCLQENRHCPGGPLPCPLQEGAAWTRSWGRGQKCFLYMCIYFFLSSELSTRRFLPKK

SEQ ID NO: 838394 - protein, 340 aa, Homo sapiens
MNGEADCPTDLEMAAPKGQDRWSQEDMLTLLECMKNNLPSNDSSKFKTTESHMDWEKVAFKDFSGDMCKLKWVEISNEVRKFRTLTELILDAQEHVKNPYKGKKLKKHPDFPKKPLTPYFRFFMEKRAKYAKLHPEMSNLDLTKILSKKYKELPEKKKMKYIQDFQREKQEFERNLARFREDHPDLIQNAKKSDIPEKPKTPQQLWYTHEKKVYLKVRPDEIMRDYIQKHPELNISEEGITKSTLTKAERQLKDKFDGRPTKPPPNSYSLYCAELMANMKDVPSTERMVLCSQQWKLLSQKEKDAYHKKCDQKKKDYEVELLRFLESLPEEEVLAWRLLA

SEQ ID NO: 838395 - protein, 203 aa, Homo sapiens
MNGEADCPTDLEMAAPKGQDRWSQEDMLTLLECMKNNLPSNDSSKFKTTESHMDWEKVAFKDFSGDMCKLKWVEISNEVRKFRTLTELILDAQEHVKNPYKGKKLKKHPDFPKKPLTPYFRFFMEKRAKYAKLHPEMSNLDLTKILSKKYKELPEKKKMKYIQDFQREKQEFERNLARFREDHPDLIQNAHRGKVQTPQKPKK

SEQ ID NO: 838396 - protein, 764 aa, Homo sapiens; identical to SEQ ID NO: 838385

SEQ ID NO: 838397 - protein, 764 aa, Homo sapiens; identical to SEQ ID NO: 838385

SEQ ID NO: 838398 - protein, 727 aa, Homo sapiens; identical to SEQ ID NO: 838387

SEQ ID NO: 838399 - protein, 411 aa, Homo sapiens
EKDAYHKKCDQKKKDYGQRVLGEEKMLNINKKQATSPASKKPAQEGGKGGSEKPKRPVSAMFIFSEEKRRQLQEERPELSESELTRLLARMWNDLSEKKKAKYKAREAALKAQSERKPGGEREERGKLPESPKRAEEIWQQSVIGDYLARFKNDRVKALKAMEMTWNNMEKKEKLMWIKKAAEDQKRYERELSEMRAPPAATNSSKKMKFQGEPKKPPMNGYQKFSQELLSNGELNHLPLKERMVEIGSRWQRISQSQKEHYKKLAEEQQKQYKVHLDLWVKSLSPQDRAAYKEYISNKRKSMTKLRGPNPKSSRTTLQSKSESEEDDEEDEDDEDEDEEEEDDENGDSSEDGGDSSESSSEDESEDGDENEEDDEDEDDDEDDDEDEDNESEGSSSSSSSSGDSSDSDSN

SEQ ID NO: 838400 - protein, 874 aa, Homo sapiens
MNGEADCPTDLEMAAPKGQDRWSQEDMLTLLECMKNNLPSNDSSKFKTTESHMDWEKVAFKDFSGDMCKLKWVEISNEVRKFRTLTELILDAQEHVKNPYKGKKLKKHPDFPKKPLTPYFRFFMEKRAKYAKLHPEMSNLDLTKILSKKYKELPEKKKMKYIQDFQREKQEFERNLARFREDHPDLIQNAKKSDIPEKPKTPQQLWYTHEKKVYLKVRPDEIMRDYIQKHPELNISEEGITKSTLTKAERQLKDKFDGRPTKPPPNSYSLYCAELMANMKDVPSTERMVLCSQQWKLLSQKEKDAYHKKCDQKKKDYEVELLRFLESLPEEEQQRVLGEEKMLNINKKQATSPASKKPAQEGGKGGSEKPKRPVSAMFIFSEEKRRQLQEERPELSESELTRLLARMWNDLSEKKKAKYKAREAALKAQSERKPGGEREERGKLPESPKRAEEIWQQSVIGDYLARFKNDRVKALKAMEMTWNNMEKKEKLMWIKKAAEDQKRYERELSEMRAPPAATNSSKKMKFQGEPKKPPMNGYQKFSQELLSNGELNHLPLKERMVEIGSRWQRISQSQKEHYKKLAEEQQKQYKVHLDLWVKVRGQGTLGRNREASDYASTILAWPIHPLVLAGLIHDFIPCPRNPSGYTVTITLLFLFFFLFFETCTPAWVTEQDPVSKKKKKKKKKLELCSQIPGALCRDPKSREPGRGEDGVMIYKCSAHCLALGQHAQSAVVGYDSNPCRFCLPQSLSPQDRAAYKEYISNKRKSMTKLRGPNPKSSRTTLQSKSESEEDDEEDEDDEDEDEEEEDDENGDSSEDGGDSSESSSEDESEDGDENEEDDEDEDDDEDDDEDEDNESEGSSSSSSSSGDSSDSDSN

SEQ ID NO: 838401 - protein, 381 aa, Homo sapiens
KTGLPGSTHGPRPSAPGQGGSEKPKRPVSAMFIFSEEKRRQLQEERPELSESELTRLLARMWNDLSEKKKAKYKAREAALKAQSERKPGGEREERGKLPESPKRAEEIWQQSVIGDYLARFKNDRVKALKAMEMTWNNMEKKEKLMWIKKAAEDQKRYERELSEMRAPPAATNSSKKMKFQGEPKKPPMNGYQKFSQELLSNGELNHLPLKERMVEIGSRWQRISQSQKEHYKKLAEEQQKQYKVHLDLWVKSLSPQDRAAYKEYISNKRKSMTKLRGPNPKSSRTTLQSKSESEEDDEEDEDDEDEDEEEEDDENGDSSEDGGDSSESSSEDESEDGDENEEDDEDEDDDEDDDEDEDNESEGSSSSSSSSGDSSDSDSN

SEQ ID NO: 838402 - protein, 549 aa, Homo sapiens
MNGEADCPTDLEMAAPKGQDRWSQEDMLTLLECMKNNLPSNDSSKFKTTESHMDWEKVAFKDFSGDMCKLKWVEISNEVRKFRTLTELILDAQEHVKNPYKGKKLKKHPDFPKKPLTPYFRFFMEKRAKYAKLHPEMSNLDLTKILSKKYKELPEKKKMKYIQDFQREKQEFERNLARFREDHPDLIQNAKKSDIPEKPKTPQQLWYTHEKKVYLKVRPDEIMRDYIQKHPELNISEEGITKSTLTKAERQLKDKFDGRPTKPPPNSYSLYCAELMANMKDVPSTERMVLCSQQWKLLSQKEKDAYHKKCDQKKKDYEVELLRFLESLPEEEQQRVLGEEKMLNINKKQATSPASKKPAQEGGKGGSEKPKRPVSAMFIFSEEKRRQLQEERPELSESELTRLLARMWNDLSEKKKAKYKAREAALKAQSERKPGGEREERGKLPESPKRAEEIWQQSVIGDYLARFKNDRVKALKAMEMTWNNMEKKEKLMWIKKAADCPTDLEMAAPKGQDRWSQEDMLTLLECMKNNLPSNDSSSSSGDSSDSDSN

SEQ ID NO: 838403 - protein, 386 aa, Homo sapiens
MNGEADCPTDLEMAAPKGQDRWSQEDMLTLLECMKNNLPSNDSSKFKTTESHMDWEKVAFKDFSGDMCKLKWVEISNEVRKFRTLTELILDAQEHVKNPYKGKKLKKHPDFPKKPLTPYFRFFMEKRAKYAKLHPEMSNLDLTKILSKKYKELPEKKKMKYIQDFQREKQEFERNLARFREDHPDLIQNAKKSDIPEKPKTPQQLWYTHEKKVYLKVRPDATTKEVKDSLGKQWSQLSDKKRLKWIHKALEQRKEYEEIMRDYIQKHPELNISEEGITKSTLTKAERQLKDKFDGRPTKPPPNSYSLYCAELMANMKDVPSTERMVLCSQQWKLLSQKEKDAYHKKCDQCFLYMCIYFFLSSELSTRRFLPISAAVSVVISGRGRV

SEQ ID NO: 838404 - protein, 471 aa, Homo sapiens
MNGEADCPTDLEMAAPKGQDRWSQEDMLTLLECMKNNLPSNDSSKFKTTESHMDWEKVAFKDFSGDMCKLKWVEISNEVRKFRTLTELILDAQEHVKNPYKGKKLKKHPDFPKKPLTPYFRFFMEKRAKYAKLHPEMSNLDLTKILSKKYKELPEKKKMKYIQDFQREKQEFERNLARFREDHPDLIQNAKKSDIPEKPKTPQQLWYTHEKKVYLKVRPDEIMRDYIQKHPELNISEEGITKSTLTKAERQLKDKFDGRPTKPPPNSYSLYCAELMANMKDVPSTERMVLCSQQWKLLSQKEKDAYHKKCDQKKKDYEVELLRFLESLPEEEQQRVLGEEKMLNINKKQATSPASKKPAQEGGKGGSEKPKRPVSAMFIFSEEKRRQLQEERPELSESELTRLLARMWNDLSEKKKARSGPTRRRSSQRKEPGGAENGQAAQSQKPGLHKRTGSGRQIRELNGNRNCRRRG

SEQ ID NO: 838405 - protein, 284 aa, Homo sapiens
MNGEADCPTDLEMAAPKGQDRWSQEDMLTLLECMKNNLPSNDSSKFKTTESHMDWEKVAFKDFSGDMCKLKWVEISNEVRKFRTLTELILDAQEHVKNPYKGKKLKKHPDFPKKPLTPYFRFFMEKRAKYAKLHPEMSNLDLTKILSKKYKELPEKKKMKYIQDFQREKQEFERNLARFREDHPDLIQNAKKSDIPEKPKTPQQLWYTHEKKVYLKVRPDATTKEVKDSLGKQWSQLSDKKRLKWIHKALEQRKEYERSWETTCALLELTQMGREHTWCGKLYG

SEQ ID NO: 838406 - protein, 106 aa, Homo sapiens
MNGEADCPTDLEMAAPKGQDRWSQEDMLTLLECMKNNLPSNDSSKFKTTESHMDWEKVAFKDFSGDMCKLKWVEISNEVRKFRTLTELILDAQEHVILQGNNSRTP

SEQ ID NO: 838407 - protein, 573 aa, Homo sapiens
VAAAAAASGAAGGGARPRAPKMAEKQKHDGRVKIGHYVLGDTLGVGTFGKVKIGEHQLTGHKVAVKILNRQKIRSLDVVGKIKREIQNLKLFRHPHIIKLYQVISTPTDFFMVMEYVSGGELFDYICKHGRVEEMEARRLFQQILSAVDYCHRHMVVHRDLKPENVLLDAHMNAKIADFGLSNMMSDGEFLRTSCGSPNYAAPEVISGRLYAGPEVDIWSCGVILYALLCGTLPFDDEHVPTLFKKIRGGVFYIPEYLNRSVATLLMHMLQVDPLKRATIKDIREHEWFKQGLPSYLFPEDPSYDANVIDDEAVKEVCEKFECTESEVMNSLYSGDPQDQLAVAYHLIIDNRRIMNQASEFYLASSPPSGSFMDDSAMHIPPGLKPHPERMPPLIADSPKARCPLDALNTTKPKSLAVKKAKWHLGIRSQSKPYDIMAEVYRAMKQLDFEWKVVNAYHLRVRRKNPVTGNYVKMSLQLYLVDNRSYLLDFKSIDDEVVEQRSGSSTPQRSCSAAGLHRPRSSFDSTTAESHSLSGSLTGSLTGSTLSSVSPRLGSHTMDFFEMCASLITTLAR

SEQ ID NO: 838408 - protein, 510 aa, Homo sapiens
VAAAAAASGAAGGGARPRAPKMAEKQKHDGRVKIGHYVLGDTLGVGTFGKVKIGEHQLTGHKVAVKILNRQKIRSLDVVGKIKREIQNLKLFRHPHIIKLYQVISTPTDFFMVMEYVSGGELFDYICKHGRVEEMEARRLFQQILSAVDYCHRHMVVHRDLKPENVLLDAHMNAKIADFGLSNMMSDGEFLRTSCGSPNYAAPEVISGRLYAGPEVDIWSCGVILYALLCGTLPFDDEHVPTLFKKIRGGVFYIPEYLNRSVATLLMHMLQVDPLKRATIKDIREHEWFKQGLPSYLFPEDPSYDANVIDDEAVKEVCEKFECTESEVMNSLYSGDPQDQLAVAYHLIIDNRRIMNQASEFYLASSPPSGSFMDDSAMHIPPGLKPHPERMPPLIADSPKARCPLDALNTTKPKSLAVKKAKWHLGIRSQSKPYDIMAEVYRAMKQLDFEWKVVNAYHLRVRRKNPVTGNYVKMSLQLYLVDNRSYLLDFKSIDGKEAMHAGPTHRMSSR

SEQ ID NO: 838409 - protein, 573 aa, Homo sapiens; identical to SEQ ID NO: 838407

SEQ ID NO: 838410 - protein, 1544 aa, Homo sapiens
PRAQPGGAGKAGRAMVDPVGFAEAWKAQFPDSEPPRMELRSVGDIEQELERCKASIRRLEQEVNEERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDAEALQRPVASDFEPQGLSEAARWNSKENLLAGPSENDPNLFVALYDFVASGDNTLSITKGEKLRVLGYNHNGEWCEAQTKNGQGWVPSNYITPVNSLEKHSWYHGPVSRNAAEYLLSSGINGSFLVRESESSPGQRSISLRYEGRVYHYRINTASDGKLYVSSESRFNTLAELVHHHSTVADGLITTLHYPAPKRNKPTVYGVSPNYDKWEMERTDITMKHKLGGGQYGEVYEGVWKKYSLTVAVKTLKEDTMEVEEFLKEAAVMKEIKHPNLVQLLGVCTREPPFYIITEFMTYGNLLDYLRECNRQEVNAVVLLYMATQISSAMEYLEKKNFIHRDLAARNCLVGENHLVKVADFGLSRLMTGDTYTAHAGAKFPIKWTAPESLAYNKFSIKSDVWAFGVLLWEIATYGMSPYPGIDLSQVYELLEKDYRMERPEGCPEKVYELMRACWQWNPSDRPSFAEIHQAFETMFQESSISDEVEKELGKQGVRGAVSTLLQAPELPTKTRTSRRAAEHRDTTDVPEMPHSKGQGESDPLDHEPAVSPLLPRKERGPPEGGLNEDERLLPKDKKTNLFSALIKKKKKTAPTPPKRSSSFREMDGQPERRGAGEEEGRDISNGALAFTPLDTADPAKSPKPSNGAGVPNGALRESGGSGFRSPHLWKKSSTLTSSRLATGEEEGGGSSSKRFLRSCSASCVPHGAKDTEWRSVTLPRDLQSTGRQFDSSTFGGHKSEKPALPRKRAGENRSDQVTRGTVTPPPRLVKKNEEAADEVFKDIMESSPGSSPPNLTPKPLRRQVTVAPASGLPHKEEAGKGSALGTPAAAEPVTPTSKAGSGAPGGTSKGPAEESRVRRHKHSSESPGRDKGKLSRLKPAPPPPPAASAGKAGGKPSQSPSQEAAGEAVLGAKTKATSLVDAVNSDAAKPSQPGEGLKKPVLPATPKPQSAKPSGTPISPAPVPSTLPSASSALAGDQPSSTAFIPLISTRVSLRKTRQPPERIASGAITKGVVLDSTEALCLAISRNSEQMASHSAVLEAGKNLYTFCVSYVDSIQQMRNKFAFREAINKLENNLRELQICPATAGSGPAATQDFSKLLSSVKEISDIVQR

SEQ ID NO: 838411 - protein, 1128 aa, Homo sapiens
ENKTNFFSQFSLPFSFFCSPLSLPEALQRPVASDFEPQGLSEAARWNSKENLLAGPSENDPNLFVALYDFVASGDNTLSITKGEKLRVLGYNHNGEWCEAQTKNGQGWVPSNYITPVNSLEKHSWYHGPVSRNAAEYLLSSGINGSFLVRESESSPGQRSISLRYEGRVYHYRINTASDGKLYVSSESRFNTLAELVHHHSTVADGLITTLHYPAPKRNKPTVYGVSPNYDKWEMERTDITMKHKLGGGQYGEVYEGVWKKYSLTVAVKTLKEDTMEVEEFLKEAAVMKEIKHPNLVQLLGVCTREPPFYIITEFMTYGNLLDYLRECNRQEVNAVVLLYMATQISSAMEYLEKKNFIHRDLAARNCLVGENHLVKVADFGLSRLMTGDTYTAHAGAKFPIKWTAPESLAYNKFSIKSDVWAFGVLLWEIATYGMSPYPGIDLSQVYELLEKDYRMERPEGCPEKVYELMRACWQWNPSDRPSFAEIHQAFETMFQESSISDEVEKELGKQGVRGAVSTLLQAPELPTKTRTSRRAAEHRDTTDVPEMPHSKGQGESDPLDHEPAVSPLLPRKERGPPEGGLNEDERLLPKDKKTNLFSALIKKKKKTAPTPPKRSSSFREMDGQPERRGAGEEEGRDISNGALAFTPLDTADPAKSPKPSNGAGVPNGALRESGGSGFRSPHLWKKSSTLTSSRLATGEEEGGGSSSKRFLRSCSASCVPHGAKDTEWRSVTLPRDLQSTGRQFDSSTFGGHKSEKPALPRKRAGENRSDQVTRGTVTPPPRLVKKNEEAADEVFKDIMESSPGSSPPNLTPKPLRRQVTVAPASGLPHKEEAGKGSALGTPAAAEPVTPTSKAGSGAPGGTSKGPAEESRVRRHKHSSESPGRDKGKLSRLKPAPPPPPAASAGKAGGKPSQSPSQEAAGEAVLGAKTKATSLVDAVNSDAAKPSQPGEGLKKPVLPATPKPQSAKPSGTPISPAPVPSTLPSASSALAGDQPSSTAFIPLISTRVSLRKTRQPPERIASGAITKGVVLDSTEALCLAISRNSEQMASHSAVLEAGKNLYTFCVSYVDSIQQMRNKFAFREAINKLENNLRELQICPATAGSGPAATQDFSKLLSSVKEISDIVQR

SEQ ID NO: 838412 - protein, 999 aa, Homo sapiens
SRSDLLNTLSCVESSLCEILLCSELRLSQTGSRELFELACLCGLKAVPCFLQLYVSSESRFNTLAELVHHHSTVADGLITTLHYPAPKRNKPTVYGVSPNYDKWEMERTDITMKHKLGGGQYGEVYEGVWKKYSLTVAVKTLKEDTMEVEEFLKEAAVMKEIKHPNLVQLLGVCTREPPFYIITEFMTYGNLLDYLRECNRQEVNAVVLLYMATQISSAMEYLEKKNFIHRDLAARNCLVGENHLVKVADFGLSRLMTGDTYTAHAGAKFPIKWTAPESLAYNKFSIKSDVWAFGVLLWEIATYGMSPYPGIDLSQVYELLEKDYRMERPEGCPEKVYELMRACWQWNPSDRPSFAEIHQAFETMFQESSISDEVEKELGKQGVRGAVSTLLQAPELPTKTRTSRRAAEHRDTTDVPEMPHSKGQGESDPLDHEPAVSPLLPRKERGPPEGGLNEDERLLPKDKKTNLFSALIKKKKKTAPTPPKRSSSFREMDGQPERRGAGEEEGRDISNGALAFTPLDTADPAKSPKPSNGAGVPNGALRESGGSGFRSPHLWKKSSTLTSSRLATGEEEGGGSSSKRFLRSCSASCVPHGAKDTEWRSVTLPRDLQSTGRQFDSSTFGGHKSEKPALPRKRAGENRSDQVTRGTVTPPPRLVKKNEEAADEVFKDIMESSPGSSPPNLTPKPLRRQVTVAPASGLPHKEEAGKGSALGTPAAAEPVTPTSKAGSGAPGGTSKGPAEESRVRRHKHSSESPGRDKGKLSRLKPAPPPPPAASAGKAGGKPSQSPSQEAAGEAVLGAKTKATSLVDAVNSDAAKPSQPGEGLKKPVLPATPKPQSAKPSGTPISPAPVPSTLPSASSALAGDQPSSTAFIPLISTRVSLRKTRQPPERIASGAITKGVVLDSTEALCLAISRNSEQMASHSAVLEAGKNLYTFCVSYVDSIQQMRNKFAFREAINKLENNLRELQICPATAGSGPAATQDFSKLLSSVKEISDIVQR

SEQ ID NO: 838413 - protein, 1544 aa, Homo sapiens; identical to SEQ ID NO: 838410

SEQ ID NO: 838414 - protein, 997 aa, Homo sapiens
PRAQPGGAGKAGRAMVDPVGFAEAWKAQFPDSEPPRMELRSVGDIEQELERCKASIRRLEQEVNEERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDAEALQRPVASDFEPQGLSEAARWNSKENLLAGPSENDPNLFVALYDFVASGDNTLSITKGEKLRVLGYNHNGEWCEAQTKNGQGWVPSNYITPVNSLEKHSWYHGPVSRNAAEYLLSSGINGSFLVRESESSPGQRSISLRYEGRVYHYRINTASDGKLYVSSESRFNTLAELVHHHSTVADGLITTLHYPAPKRNKPTVYGVSPNYDKWEMERTDITMKHKLGGGQYGEVYEGVWKKYSLTVAVKTLKEDTMEVEEFLKEAAVMKEIKHPNLVQLLGVCTREPPFYIITEFMTYGNLLDYLRECNRQEVNAVVLLYMATQISSAMEYLEKKNFIHRDLAARNCLVGENHLVKVADFGLSRLMTGDTYTAHAGAKFPIKWTAPESLAYNKFSIKSDVWAFGVLLWEIATYGMSPYPGIDLSQVYELLEKDYRMERPEGCPEKVYELMRACWQWNPSDRPSFAEIHQAFETMFQESSISDEVEKELGKQGVRGAVSTLLQAPELPTKTRTSRRAAEHRDTTDVPEMPHSKGQERAILWTMSLPCLHCSLEKSEVPRRAA

SEQ ID NO: 838415 - protein, 140 aa, Homo sapiens
VESSLCEILLCSELRLSQTGSRELFELACLCGLKAVPCFLQLYVSSESRFNTLAELVHHHSTVADGLITTLHYPAPKRNKPTVYGVSPNYDKWEMERTDITMKHKLGGGQYGEVYEGVWKKYSLTVAVKTLKVGWDCRGC

SEQ ID NO: 838416 - protein, 1130 aa, Homo sapiens; identical to SEQ ID NO: 830562

SEQ ID NO: 838417 - protein, 1149 aa, Homo sapiens
MGQQPGKVLGDQRRPSLPALHFIKGAGKKESSRHGGPHCNVFVEHEALQRPVASDFEPQGLSEAARWNSKENLLAGPSENDPNLFVALYDFVASGDNTLSITKGEKLRVLGYNHNGEWCEAQTKNGQGWVPSNYITPVNSLEKHSWYHGPVSRNAAEYLLSSGINGSFLVRESESSPGQRSISLRYEGRVYHYRINTASDGKLYVSSESRFNTLAELVHHHSTVADGLITTLHYPAPKRNKPTVYGVSPNYDKWEMERTDITMKHKLGGGQYGEVYEGVWKKYSLTVAVKTLKEDTMEVEEFLKEAAVMKEIKHPNLVQLLGVCTREPPFYIITEFMTYGNLLDYLRECNRQEVNAVVLLYMATQISSAMEYLEKKNFIHRDLAARNCLVGENHLVKVADFGLSRLMTGDTYTAHAGAKFPIKWTAPESLAYNKFSIKSDVWAFGVLLWEIATYGMSPYPGIDLSQVYELLEKDYRMERPEGCPEKVYELMRACWQWNPSDRPSFAEIHQAFETMFQESSISDEVEKELGKQGVRGAVSTLLQAPELPTKTRTSRRAAEHRDTTDVPEMPHSKGQGESDPLDHEPAVSPLLPRKERGPPEGGLNEDERLLPKDKKTNLFSALIKKKKKTAPTPPKRSSSFREMDGQPERRGAGEEEGRDISNGALAFTPLDTADPAKSPKPSNGAGVPNGALRESGGSGFRSPHLWKKSSTLTSSRLATGEEEGGGSSSKRFLRSCSASCVPHGAKDTEWRSVTLPRDLQSTGRQFDSSTFGGHKSEKPALPRKRAGENRSDQVTRGTVTPPPRLVKKNEEAADEVFKDIMESSPGSSPPNLTPKPLRRQVTVAPASGLPHKEEAGKGSALGTPAAAEPVTPTSKAGSGAPGGTSKGPAEESRVRRHKHSSESPGRDKGKLSRLKPAPPPPPAASAGKAGGKPSQSPSQEAAGEAVLGAKTKATSLVDAVNSDAAKPSQPGEGLKKPVLPATPKPQSAKPSGTPISPAPVPSTLPSASSALAGDQPSSTAFIPLISTRVSLRKTRQPPERIASGAITKGVVLDSTEALCLAISRNSEQMASHSAVLEAGKNLYTFCVSYVDSIQQMRNKFAFREAINKLENNLRELQICPATAGSGPAATQDFSKLLSSVKEISDIVQR

SEQ ID NO: 838418 - protein, 1544 aa, Homo sapiens; identical to SEQ ID NO: 838410

SEQ ID NO: 838419 - protein, 1486 aa, Homo sapiens
PRAQPGGAGKAGRAMVDPVGFAEAWKAQFPDSEPPRMELRSVGDIEQELERCKASIRRLEQEVNEERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDAGEKLRVLGYNHNGEWCEAQTKNGQGWVPSNYITPVNSLEKHSWYHGPVSRNAAEYLLSSGINGSFLVRESESSPGQRSISLRYEGRVYHYRINTASDGKLYVSSESRFNTLAELVHHHSTVADGLITTLHYPAPKRNKPTVYGVSPNYDKWEMERTDITMKHKLGGGQYGEVYEGVWKKYSLTVAVKTLKEDTMEVEEFLKEAAVMKEIKHPNLVQLLGVCTREPPFYIITEFMTYGNLLDYLRECNRQEVNAVVLLYMATQISSAMEYLEKKNFIHRDLAARNCLVGENHLVKVADFGLSRLMTGDTYTAHAGAKFPIKWTAPESLAYNKFSIKSDVWAFGVLLWEIATYGMSPYPGIDLSQVYELLEKDYRMERPEGCPEKVYELMRACWQWNPSDRPSFAEIHQAFETMFQESSISDEVEKELGKQGVRGAVSTLLQAPELPTKTRTSRRAAEHRDTTDVPEMPHSKGQGESDPLDHEPAVSPLLPRKERGPPEGGLNEDERLLPKDKKTNLFSALIKKKKKTAPTPPKRSSSFREMDGQPERRGAGEEEGRDISNGALAFTPLDTADPAKSPKPSNGAGVPNGALRESGGSGFRSPHLWKKSSTLTSSRLATGEEEGGGSSSKRFLRSCSASCVPHGAKDTEWRSVTLPRDLQSTGRQFDSSTFGGHKSEKPALPRKRAGENRSDQVTRGTVTPPPRLVKKNEEAADEVFKDIMESSPGSSPPNLTPKPLRRQVTVAPASGLPHKEEAGKGSALGTPAAAEPVTPTSKAGSGAPGGTSKGPAEESRVRRHKHSSESPGRDKGKLSRLKPAPPPPPAASAGKAGGKPSQSPSQEAAGEAVLGAKTKATSLVDAVNSDAAKPSQPGEGLKKPVLPATPKPQSAKPSGTPISPAPVPSTLPSASSALAGDQPSSTAFIPLISTRVSLRKTRQPPERIASGAITKGVVLDSTEALCLAISRNSEQMASHSAVLEAGKNLYTFCVSYVDSIQQMRNKFAFREAINKLENNLRELQICPATAGSGPAATQDFSKLLSSVKEISDIVQR

SEQ ID NO: 838420 - protein, 635 aa, Homo sapiens
MFQESSISDEVEKELGKQGVRGAVSTLLQAPELPTKTRTSRRAAEHRDTTDVPEMPHSKGQGESDPLDHEPAVSPLLPRKERGPPEGGLNEDERLLPKDKKTNLFSALIKKKKKTAPTPPKRSSSFREMDGQPERRGAGEEEGRDISNGALAFTPLDTADPAKSPKPSNGAGVPNGALRESGGSGFRSPHLWKKSSTLTSSRLATGEEEGGGSSSKRFLRSCSASCVPHGAKDTEWRSVTLPRDLQSTGRQFDSSTFGGHKSEKPALPRKRAGENRSDQVTRGTVTPPPRLVKKNEEAADEVFKDIMESSPGSSPPNLTPKPLRRQVTVAPASGLPHKEEAGKGSALGTPAAAEPVTPTSKAGSGAPGGTSKGPAEESRVRRHKHSSESPGRDKGKLSRLKPAPPPPPAASAGKAGGKPSQSPSQEAAGEAVLGAKTKATSLVDAVNSDAAKPSQPGEGLKKPVLPATPKPQSAKPSGTPISPAPVPSTLPSASSALAGDQPSSTAFIPLISTRVSLRKTRQPPERIASGAITKGVVLDSTEALCLAISRNSEQMASHSAVLEAGKNLYTFCVSYVDSIQQMRNKFAFREAINKLENNLRELQICPATAGSGPAATQDFSKLLSSVKEISDIVQR

SEQ ID NO: 838421 - protein, 650 aa, Homo sapiens
MVDPVGFAEAWKAQFPDSEPPRMELRSVGDIEQELERCKASIRRLEQEVNEERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDAEALQRPVASDFEPQGLSEAARWNSKENLLAGPSENDPNLFVALYDFVASGDNTLSITKGEKLRVLGYNHNGEWCEAQTKNGQGWVPSNYITPVNSLEKHSWYHGPVSRNAAEYLLSSGINGSFLVRESESSPGQRSISLRYEGRVYHYRINTASDGKLYVSSESRFNTLAELVHHHSTVADGLITTLHYPAPKRNKPTVYGVSPNYDKWEMERTDITISHRQRP

SEQ ID NO: 838422 - protein, 491 aa, Homo sapiens
DDVRAVLVLKSCRGGGGVRSWTGRRVQQVKEEEEPSGRWHRGLTMDEEYDVIVLGTGLTECILSGIMSVNGKKVLHMDRNPYYGGESSSITPLEELYKRFQLLEGPPESMGRGRDWNVDLIPKFLMANGQLVKMLLYTEVTRYLDFKVVEGSFVYKGGKIYKVPSTETEALASNLMGMFEKRRFRKFLVFVANFDENDPKTFEGVDPQTTSMRDVYRKFDLGQDVIDFTGHALALYRTDDYLDQPCLETVNRIKLYSESLARYGKSPYLYPLYGLGELPQGFARLSAIYGGTYMLNKPVDDIIMENGKVVGVKSEGEVARCKQLICDPSYIPDRVRKAGQVIRIICILSHPIKNTNDANSCQIIIPQNQVNRKSDIYVCMISYAHNVAAQGKYIAIASTTVETTDPEKEVEPALELLEPIDQKFVAISDLYEPIDDGCESQVFCSCSYDATTHFETTCNDIKDIYKRMAGTAFDFENMKRKQNDVFGEAEQ

SEQ ID NO: 838423 - protein, 553 aa, Homo sapiens
MDEEYDVIVLGTGLTECILSGIMSVNGKKVLHMDRNPYYGGESSSITPLEELYKRFQLLEGPPESMGRGRDWNVDLIPKFLMANGQLVKMLLYTEVTRYLDFKVVEGSFVYKGGKIYKVPSTETEALASNLMGMFEKRRFRKFLVFVANFDENDPKTFEGVDPQTTSMRDVYRKFDLGQDVIDFTGHALALYRTDDYLDQPCLETVNRIKLYSESLARYGKSPYLYPLYGLGELPQGFARLSAIYGGTYMLNKPVDDIIMENGKVVGVKSEGEVARCKQLICDPSYIPDRVRKAGQVIRIICILSHPIKNTNDANSCQIIIPQNQVNRKSGRPGAGTASSRVFSLGLLFFSSISVGAPCLTSLEKNLSHIVATTTWSPRVWVAWTLSLWEGGGLDAYLLCGAGEGQSGQTCVQPLEPLSAYGQRLWPELTELFLWPDIYVCMISYAHNVAAQGKYIAIASTTVETTDPEKEVEPALELLEPIDQKFVAISDLYEPIDDGCESQVFCSCSYDATTHFETTCNDIKDIYKRMAGTAFDFENMKRKQNDVFGEAEQ

SEQ ID NO: 838424 - protein, 476 aa, Homo sapiens
MDEEYDVIVLGTGLTECILSGIMSVNGKKVLHMDRNPYYGGESSSITPLEELYKRFQLLEGPPESMGRGRDWNVDLIPKFLMANGQLVKMLLYTEVTRYLDFKVVEGSFVYKGGKIYKVPSTETEALASNLMGMFEKRRFRKFLVFVANFDENDPKTFEGVDPQTTSMRDVYRKFDLGQDVIDFTGHALALYRTDDYLDQPCLETVNRIKLYSESLARYGKSPYLYPLYGLGELPQGFARLSAIYGGTYMLNKPVDDIIMENGKVVGVKSEGEVARCKQLICDPSYIPDRVRKAGQVIRIICILSHPIKNTNDANSCQIIIPQNQVNRKSDIYVCMISYAHNVAAQGKYIAIASTTVETTDPEKEVEPALELLEPIDQKFVAISDLYEPIDDGCESQKQLSSPGLLAARPGYLSDSPWALGSGCFQVFCSCSYDATTHFETTCNDIKDIYKRMAGTAFDFENMKRKQNDVFGEAEQ

SEQ ID NO: 838425 - protein, 447 aa, Homo sapiens [sequence omitted]

SEQ ID NO: 838426 - protein, 473 aa, Homo sapiens
AAPVVTVKLREGYIIRYVGVGPTDLNMDEEYDVIVLGTGLTECILSGIMSVNGKKVLHMDRNPYYGGESSSITPLEELYKRFQLLEGPPESMGRGRDWNVDLIPKFLMANGQLVKMLLYTEVTRYLDFKVVEGSFVYKGGKIYKVPSTETEALASNLMGMFEKRRFRKFLVFVANFDENDPKTFEGVDPQTTSMRDVYRKFDLGQDVIDFTGHALALYRTDDYLDQPCLETVNRIKLYSESLARYGKSPYLYPLYGLGELPQGFARLSAIYGGTYMLNKPVDDIIMENGKVVGVKSEGEVARCKQLICDPSYIPDRVRKAGQVIRIICILSHPIKNTNDANSCQIIIPQNQVNRKSDIYVCMISYAHNVAAQGKYIAIASTTVETTDPEKEVEPALELLEPIDQKFVAISDLYEPIDDGCESQVFCSCSYDATTHFETTCNDIKDIYKRMAGTAFDFENMKRKQNDVFGEAEQ

SEQ ID NO: 838427 - protein, 485 aa, Homo sapiens
MDEEYDVIVLGTGLTECILSGIMSVNGKKVLHMDRNPYYGGESSSITPLEELYKRFQLLEGPPESMGRGRDWNVDLIPKFLMANGQLVKMLLYTEVTRYLDFKVVEGSFVYKGGKIYKVPSTETEALASNLMGMFEKRRFRKFLVFVANFDENDPKTFEGVDPQTTSMRDVYRKFDLGQDVIDFTGHALALYRTDELRGSWVVAAPSPGPPPPFPHLPAVPLPRMSLVLSHRLTYLDQPCLETVNRIKLYSESLARYGKSPYLYPLYGLGELPQGFARLSAIYGGTYMLNKPVDDIIMENGKVVGVKSEGEVARCKQLICDPSYIPDRVRKAGQVIRIICILSHPIKNTNDANSCQIIIPQNQVNRKSDIYVCMISYAHNVAAQGKYIAIASTTVETTDPEKEVEPALELLEPIDQKFVAISDLYEPIDDGCESQVFCSCSYDATTHFETTCNDIKDIYKRMAGTAFDFENMKRKQNDVFGEAEQ

SEQ ID NO: 838428 - protein, 447 aa, Homo sapiens [sequence omitted]

SEQ ID NO: 838429 - protein, 447 aa, Homo sapiens [sequence omitted]

SEQ ID NO: 838430 - protein, 196 aa, Homo sapiens
MDEEYDVIVLGTGLTECILSGIMSVNGKKVLHMDRNPYYGGESSSITPLEELYKRFQLLEGPPESMGRGRDWNVDLIPKFLMANGQLVKMLLYTEVTRYLDFKVVEGSFVYKGGKIYKVPSTETEALASNLMGMFEKRRFRKFLVFVANFDENDPKTFEGVDPQTTSMRDVYRKFDLGQDVIDFTGHALALYRTDE

SEQ ID NO: 838431 - protein, 112 aa, Homo sapiens [sequence omitted]

SEQ ID NO: 838432 - protein, 108 aa, Homo sapiens
KGEERRKGGEGGPHYDKTAPSIQSLASSKAARPSPGLLAARPGYLSDSPWALGSGCFQVFCSCSYDATTHFETTCNDIKDIYKRMAGTAFDFENMKRKQNDVFGEAEQ

SEQ ID NO: 838433 - protein, 447 aa, Homo sapiens [sequence omitted]

SEQ ID NO: 838434 - protein, 447 aa, Homo sapiens [sequence omitted]

SEQ ID NO: 838435 - protein, 447 aa, Homo sapiens [sequence omitted]

SEQ ID NO: 838436 - protein, 447 aa, Homo sapiens [sequence omitted]

SEQ ID NO: 838437 - protein, 590 aa, Homo sapiens
MDEEYDVIVLGTGLTECILSGIMSVNGKKVLHMDRNPYYGGESSSITPLEELYKRFQLLEGPPESMGRGRDWNVDLIPKFLMANGQLVKMLLYTEVTRYLDFKVVEGSFVYKGGKIYKVPSTETEALASNLMGMFEKRRFRKFLVFVANFDENDPKTFEGVDPQTTSMRDVYRKFDLGQDVIDFTGHALALYRTDDYLDQPCLETVNRIKLYSESLARYGKSPYLYPLYGLGELPQGFARLSAIYGGTYMLNKPVDDIIMENGKVVGVKSEGEVSPSRACSAVPWLRRGLVTFSVLSSLLLHSPKGLGAGTGGPEVFRVMTVGERSLSEATCHVCGAESVLDHSASGGAGGRAPSPCVKAHLSERQGRAMHSGGAVVMAPRNVLSARAACPCCEQQPHVYLREGCDRGEDFLVPSQVARCKQLICDPSYIPDRVRKAGQVIRIICILSHPIKNTNDANSCQIIIPQNQVNRKSDIYVCMISYAHNVAAQGKYIAIASTTVETTDPEKEVEPALELLEPIDQKFVAISDLYEPIDDGCESQVFCSCSYDATTHFETTCNDIKDIYKRMAGTAFDFENMKRKQNDVFGEAEQ

SEQ ID NO: 838438 - protein, 447 aa, Homo sapiens [sequence omitted]

SEQ ID NO: 838439 - protein, 525 aa, Homo sapiens
MDEEYDVIVLGTGLTECILSGIMSVNGKKVLHMDRNPYYGGESSSITPLEELYKRFQLLEGPPESMGRGRDWNVDLIPKFLMANGQLVKMLLYTEVTRYLDFKVVEGSFVYKGGKIYKVPSTETEALASNLMGMFEKRRFRKFLVFVANFDENDPKTFEGVDPQTTSMRDVYRKFDLGQDVIDFTGHALALYRTDELRGSWVVAAPSPGPPPPFPHLPAVPLPRMSLVLSHRLTYHPFHFPLAFDASSSPGHSGWWEDWPGTWVGVNQGCCYSPYLDQPCLETVNRIKLYSESLARYGKSPYLYPLYGLGELPQGFARLSAIYGGTYMLNKPVDDIIMENGKVVGVKSEGEVARCKQLICDPSYIPDRVRKAGQVIRIICILSHPIKNTNDANSCQIIIPQNQVNRKSDIYVCMISYAHNVAAQGKYIAIASTTVETTDPEKEVEPALELLEPIDQKFVAISDLYEPIDDGCESQVFCSCSYDATTHFETTCNDIKDIYKRMAGTAFDFENMKRKQNDVFGEAEQ

SEQ ID NO: 838440 - protein, 447 aa, Homo sapiens [sequence omitted]

SEQ ID NO: 838441 - protein, 554 aa, Homo sapiens
MDEEYDVIVLGTGLTECILSGIMSVNGKKVLHMDRNPYYGGESSSITPLEELYKRFQLLEGPPESMGRGRDWNVDLIPKFLMANGQLVKMLLYTEVTRYLDFKVVEGSFVYKGGKIYKVPSTETEALASRPPLNPRDIAKCLSQEALRAHPGQSPLHPDLMGMFEKRRFRKFLVFVANFDENDPKTFEGVDPQTTSMRDVYRKFDLGQDVIDFTGHALALYRTDELRGSWVVAAPSPGPPPPFPHLPAVPLPRMSLVLSHRLTYHPFHFPLAFDASSSPGHSGWWEDWPGTWVGVNQGCCYSPYLDQPCLETVNRIKLYSESLARYGKSPYLYPLYGLGELPQGFARLSAIYGGTYMLNKPVDDIIMENGKVVGVKSEGEVARCKQLICDPSYIPDRVRKAGQVIRIICILSHPIKNTNDANSCQIIIPQNQVNRKSDIYVCMISYAHNVAAQGKYIAIASTTVETTDPEKEVEPALELLEPIDQKFVAISDLYEPIDDGCESQVFCSCSYDATTHFETTCNDIKDIYKRMAGTAFDFENMKRKQNDVFGEAEQ

SEQ ID NO: 838442 - protein, 198 aa, Homo sapiens
MLNKPVDDIIMENGKVVGVKSEGEVARCKQLICDPSYIPDRVRKAGQVIRIICILSHPIKNTNDANSCQIIIPQNQVNRKSDIYVCMISYAHNVAAQGKYIAIASTTVETTDPEKEVEPALELLEPIDQKFVAISDLYEPIDDGCESQVFCSCSYDATTHFETTCNDIKDIYKRMAGTAFDFENMKRKQNDVFGEAEQ

SEQ ID NO: 838443 - protein, 447 aa, Homo sapiens [sequence omitted]

SEQ ID NO: 838444 - protein, 352 aa, Homo sapiens
MDEEYDVIVLGTGLTECILSGIMSVNGKKVLHMDRNPYYGGESSSITPLEELYKRFQLLEGPPESMGRGRDWNVDLIPKFLMANGQLVKMLLYTEVTRYLDFKVVEGSFVYKGGKIYKVPSTETEALASNLMGMFEKRRFRKFLVFVANFDENDPKTFEGVDPQTTSMRDVYRKFDLGQDVIDFTGHALALYRTDDYLDQPCLETVNRIKLYSESLARYGKSPYLYPLYGLGELPQGFARLSAIYGGTYMLNKPVDDIIMENGKVVGVKSEGEVARCKQLICDPSYIPDRVRKAGQVIRIICILSHPIKNTNDANSCQIIIPQNQVNRKSGHLTCGMISYGTTTGGAQGARN

SEQ ID NO: 838445 - protein, 163 aa, Homo sapiens
MDEEYDVIVLGTGLTECILSGIMSVNGKKVLHMDRNPYYGGESSSITPLEELYKRFQLLEGPPESMGRGRDWNVDLIPKFLMANGQLVKMLLYTEVTRYLDFKVVEGSFVYKGGKIYKVPSTETEALASNLMGMFEKRRFRKFLVFVANFDENDPKTFEGVDP

SEQ ID NO: 838446 - protein, 167 aa, Homo sapiens
FLGRSTGRRPAPPAPPRASLDSRRAASPAEPRWCCGPGPGSPPGRRAGEAVAPAGCGGAREEAGLFDAAEGSGDGRTRRHLWSSAVAAAAVAAATAAVKEEEEPSGRWHRGLTMDEEYDVIVLGTGLTECILSGIMSVNGKKVLHMDRNPYYGGESSSITPLEEPPP

SEQ ID NO: 838447 - protein, 148 aa, Homo sapiens
MDEEYDVIVLGTGLTECILSGIMSVNGKKVLHMDRNPYYGGESSSITPLEELYKRFQLLEGPPESMGRGRDWNVDLIPKFLMANGQLVKMLLYTEVTRYLDFKVVEGSFVYKGGKIYKVPSTETEALASTNLMGILRTRFRSRRSEIL

SEQ ID NO: 838448 - protein, 34 aa, Homo sapiens
LYLVQVSFIHILLDEDKFILHLCTLIDLILILVL

SEQ ID NO: 838449 - protein, 251 aa, Homo sapiens
LDKELPNPPPSPPVPSPVRPGPPLATRSRGGAEAKHEPRAHHPSWRRGSAAPASPGSSATNGRASGAARSFPARGPGAPLCSGSGRALAEGLASPLLRAGPNPVAAAALRAPIPELPLLSLAQRLPPGRPLLGTMARGGRGRRLGLALGLLLALVLAPRVLRAKPTVRKERVVRPDSELGERPPEDNQSFQYDHEAFLGKEDSKTFDQLTPDESKERLGKIVDRIDNDGDGFVTTEELKTLDQTGAEKIHL

SEQ ID NO: 838450 - protein, 117 aa, Homo sapiens
MARGGRGRRLGLALGLLLALVLAPRVLRAKPTVRKERVVRPDSELGERPPEDNQSFQYDHEAFLGKEDSKTFDQLTPDESKERLGKIVDRIDNDGDGFVTTEELKTLDQTGAEKIHL

SEQ ID NO: 838451 - protein, 117 aa, Homo sapiens; identical to SEQ ID NO: 838450

SEQ ID NO: 838452 - protein, 117 aa, Homo sapiens; identical to SEQ ID NO: 838450

SEQ ID NO: 838453 - protein, 117 aa, Homo sapiens; identical to SEQ ID NO: 838450

SEQ ID NO: 838454 - protein, 117 aa, Homo sapiens; identical to SEQ ID NO: 838450

SEQ ID NO: 838455 - protein, 117 aa, Homo sapiens; identical to SEQ ID NO: 838450

SEQ ID NO: 838456 - protein, 165 aa, Homo sapiens
MLPRDERRFKAADLNGDLTATREEFTAFLHPEEFEHMKEIVVLETLEDIDKNGDGFVDQDEYIADMFSHEENGPEPDWVLSEREQFNEFRDLNKDGKLDKDEIRHWILPQDYDHAQAEARHLVYESDKNKDEKLTKEEILENWNMFVGSQATNYGEDLTKNHDEL

SEQ ID NO: 838457 - protein, 165 aa, Homo sapiens; identical to SEQ ID NO: 838456

SEQ ID NO: 838458 - protein, 165 aa, Homo sapiens; identical to SEQ ID NO: 838456

SEQ ID NO: 838459 - protein, 192 aa, Homo sapiens
MIPLRLLLPRGNPAEFHDSSDHHTFKKMLPRDERRFKAADLNGDLTATREEFTAFLHPEEFEHMKEIVVLETLEDIDKNGDGFVDQDEYIADMFSHEENGPEPDWVLSEREQFNEFRDLNKDGKLDKDEIRHWILPQDYDHAQAEARHLVYESDKNKDEKLTKEEILENWNMFVGSQATNYGEDLTKNHDEL

SEQ ID NO: 838460 - protein, 117 aa, Homo sapiens; identical to SEQ ID NO: 838450

SEQ ID NO: 838461 - protein, 117 aa, Homo sapiens; identical to SEQ ID NO: 838450

SEQ ID NO: 838462 - protein, 117 aa, Homo sapiens; identical to SEQ ID NO: 838450

SEQ ID NO: 838463 - protein, 117 aa, Homo sapiens; identical to SEQ ID NO: 838450

SEQ ID NO: 838464 - protein, 117 aa, Homo sapiens; identical to SEQ ID NO: 838450

SEQ ID NO: 838465 - protein, 108 aa, Homo sapiens
MARGGRGRRLGLALGLLLALVLAPRVLRAKPTVRKERVVRPDSELGERPPEDNQSFQYDHEAFLGKEDSKTFDQLTPDESKERLGKIVDRIDNDGDGFVTTEELKTLL

SEQ ID NO: 838466 - protein, 106 aa, Homo sapiens [sequence omitted]

SEQ ID NO: 838467 - protein, 251 aa, Homo sapiens; identical to SEQ ID NO: 838449

SEQ ID NO: 838468 - protein, 251 aa, Homo sapiens; identical to SEQ ID NO: 838449

SEQ ID NO: 838469 - protein, 117 aa, Homo sapiens; identical to SEQ ID NO: 838450

SEQ ID NO: 838470 - protein, 117 aa, Homo sapiens; identical to SEQ ID NO: 838450

SEQ ID NO: 838471 - protein, 117 aa, Homo sapiens; identical to SEQ ID NO: 838450

SEQ ID NO: 838472 - protein, 165 aa, Homo sapiens; identical to SEQ ID NO: 838456

SEQ ID NO: 838473 - protein, 106 aa, Homo sapiens [sequence omitted]

SEQ ID NO: 838474 - protein, 117 aa, Homo sapiens; identical to SEQ ID NO: 838450

SEQ ID NO: 838475 - protein, 117 aa, Homo sapiens; identical to SEQ ID NO: 838450

SEQ ID NO: 838476 - protein, 106 aa, Homo sapiens [sequence omitted]

SEQ ID NO: 838477 - protein, 117 aa, Homo sapiens; identical to SEQ ID NO: 838450

SEQ ID NO: 838478 - protein, 106 aa, Homo sapiens [sequence omitted]

SEQ ID NO: 838479 - protein, 69 aa, Homo sapiens
ERVYGFVKDVEESQESMGASLPRRDKEMAGSVGTIERVRDSLVKGLGDTGRGRAVKEPCREPYPAAGVS

SEQ ID NO: 838480 - protein, 332 aa, Homo sapiens
YEAPTMVRCDRGLQMLLTTAGAFAAFSLMAIAIGTDYWLYSSAHICNGTNLTMDDGPPPRRARGDLTHSGLWRVCCIEGIYKGHCFRINHFPEDNDYDHDSSEYLLRIVRASSVFPILSTILLLLGGLCIGAGRIYSRKNNIVLSAGILFVAAGLSNIIGIIVYISSNTGDPSDKRDEDKKNHYNYGWSFYFGALSFIVAETVGVLAVNIYIEKNKELRFKTKREFLKASSSSPYARMPSYRYRRRRSRSSSRSTEASPSRDVSPMGLKITGAIPMGELSMYTLSREPLKVTTAASYSPDQEASFLQVHDFFQQDLKEGFHVSMLNRRTTPV

SEQ ID NO: 838481 - protein, 332 aa, Homo sapiens; identical to SEQ ID NO: 838480

SEQ ID NO: 838482 - protein, 332 aa, Homo sapiens; identical to SEQ ID NO: 838480

SEQ ID NO: 838483 - protein, 99 aa, Homo sapiens
CPPVPYTARPTVGLTSASLPPWPRSPLPASLSGLSNIIGIIVYISSNTGDPSDKRDEDKKNHYNYGWSFYFGALSFIVAETVGVLAVNIYIEKNKELRF

SEQ ID NO: 838484 - protein, 332 aa, Homo sapiens; identical to SEQ ID NO: 838480

SEQ ID NO: 838485 - protein, 553 aa, Homo sapiens
MDVDKELGMESVKAGASGKPEMRLGTQEETSEGDANESSLLVLSSNVPLLALEFLEIAQAKEKAFLPMVSHTFHMRTEESDASQEGDDLPKSSANTSHPKQDDSPKSSEETIQPKEGDIPKAPEETIQSKKEDLPKSSEKAIQPKESNIPKSSAKAIQPKLGNIPKASVKPSQPKEGDIPKAPEETIQSKKEDLPKSSEEAIQPKEGDIPKSSAKPIQPKLGNIAKTSVKPSQPKESDIPKSPEETIQPKEGDIPKSSAKPIQPKLGNIPKASVKPSQPKEGDISKSPEEAIQPKEGDLPKSLEEAIQPKEGDIPKSPEEAIQPKEGDIPKSLEEAIQPKEGDIPKSPEETIQPKKGDIPKSPEEAIQPKEGDIPKSPKQAIQPKEGDIPKSLEEAIPPKEIDIPKSPEETIQPKEDDSPKSLEEATPSKEGDILKPEEETMEFPEGDKVKVILSKEDFEASLKEAGERLVAVDFSATWCGPCRTIRPFFHALSVKHEDVVFLEVDADNCEEVVRECAIMCVPTFQFYKKEEKVDELCGALKEKLEAVIAELK

SEQ ID NO: 838486 - protein, 544 aa, Homo sapiens
MKRISLVLLLHFYLIYFILFYFMFFGTESSLLVLSSNVPLLALEFLEIAQAKEKAFLPMVSHTFHMRTEESDASQEGDDLPKSSANTSHPKQDDSPKSSEETIQPKEGDIPKAPEETIQSKKEDLPKSSEKAIQPKESNIPKSSAKAIQPKLGNIPKASVKPSQPKEGDIPKAPEETIQSKKEDLPKSSEEAIQPKEGDIPKSSAKPIQPKLGNIAKTSVKPSQPKESDIPKSPEETIQPKEGDIPKSSAKPIQPKLGNIPKASVKPSQPKEGDISKSPEEAIQPKEGDLPKSLEEAIQPKEGDIPKSPEEAIQPKEGDIPKSLEEAIQPKEGDIPKSPEETIQPKKGDIPKSPEEAIQPKEGDIPKSPKQAIQPKEGDIPKSLEEAIPPKEIDIPKSPEETIQPKEDDSPKSLEEATPSKEGDILKPEEETMEFPEGDKVKVILSKEDFEASLKEAGERLVAVDFSATWCGPCRTIRPFFHALSVKHEDVVFLEVDADNCEEVVRECAIMCVPTFQFYKKEEKVDELCGALKEKLEAVIAELK

SEQ ID NO: 838487 - protein, 486 aa, Homo sapiens
MVSHTFHMRTEESDASQEGDDLPKSSANTSHPKQDDSPKSSEETIQPKEGDIPKAPEETIQSKKEDLPKSSEKAIQPKESNIPKSSAKAIQPKLGNIPKASVKPSQPKEGDIPKAPEETIQSKKEDLPKSSEEAIQPKEGDIPKSSAKPIQPKLGNIAKTSVKPSQPKESDIPKSPEETIQPKEGDIPKSSAKPIQPKLGNIPKASVKPSQPKEGDISKSPEEAIQPKEGDLPKSLEEAIQPKEGDIPKSPEEAIQPKEGDIPKSLEEAIQPKEGDIPKSPEETIQPKKGDIPKSPEEAIQPKEGDIPKSPKQAIQPKEGDIPKSLEEAIPPKEIDIPKSPEETIQPKEDDSPKSLEEATPSKEGDILKPEEETMEFPEGDKVKVILSKEDFEASLKEAGERLVAVDFSATWCGPCRTIRPFFHALSVKHEDVVFLEVDADNCEEVVRECAIMCVPTFQFYKKEEKVDELCGALKEKLEAVIAELK

SEQ ID NO: 838488 - protein, 538 aa, Homo sapiens
MTTFKEAVTFKDVAVVFTEEELGLLDPAQRKLYRDVMLENFRNLLSVGHQPFHQDTCHFLREEKFWMMGTATQREGNSGGKIQTELESVPEAGAHEEWSCQQIWEQIAKDLTRSQDSIINNSQFFENGDVPSQVEAGLPTIHTGQKPSQGGKCKQSFSDVPIFDLPQQLYSEEKSYTCDECGKSICYISALHVHQRVHVGEKLFMCDVCGKEFSQSSHLQTHQRVHTGEKPFKCEQCGKGFSRRSALNVHHKLHTGEKPYICEACGKAFIHDSQLKEHKRIHTGEKPFKCDICGKTFYFRSRLKSHSMVHTGEKPFRCDTCDKSFHQRSALNRHCMVHTGEKPYRCEQCGKGFIGRLDFYKHQVVHTGEKPYNCKECGKSFRWSSCLLNHQRVHSGEKSFKCEECGKGFYTNSQLSSHQRSHSGEKPYKCEECGKGYVTKFNLDLHQRVHTGERPYNCKECGKNFSRASSILNHKRLHCQKKPFKCEDCGKRLVHRTYRKDQPRDYSGENPSKCEDCGRRYKRRLNLDILLSLFLNDT

SEQ ID NO: 838489 - protein, 538 aa, Homo sapiens; identical to SEQ ID NO: 838488

SEQ ID NO: 838490 - protein, 520 aa, Homo sapiens
MTTFKEAVTFKDVAVVFTEEELGLLDPAQRKLYRDVMLENFRNLLSVGHQPFHQDTCHFLREEKFWMMGTATQREGNSGGKIQTELESVPEAGAHEEWSCQQIWEQIAKDLTRSQDSIINNSQFFGQKPSQGGKCKQSFSDVPIFDLPQQLYSEEKSYTCDECGKSICYISALHVHQRVHVGEKLFMCDVCGKEFSQSSHLQTHQRVHTGEKPFKCEQCGKGFSRRSALNVHHKLHTGEKPYICEACGKAFIHDSQLKEHKRIHTGEKPFKCDICGKTFYFRSRLKSHSMVHTGEKPFRCDTCDKSFHQRSALNRHCMVHTGEKPYRCEQCGKGFIGRLDFYKHQVVHTGEKPYNCKECGKSFRWSSCLLNHQRVHSGEKSFKCEECGKGFYTNSQLSSHQRSHSGEKPYKCEECGKGYVTKFNLDLHQRVHTGERPYNCKECGKNFSRASSILNHKRLHCQKKPFKCEDCGKRLVHRTYRKDQPRDYSGENPSKCEDCGRRYKRRLNLDILLSLFLNDT

SEQ ID NO: 838491 - protein, 538 aa, Homo sapiens; identical to SEQ ID NO: 838488

SEQ ID NO: 838492 - protein, 538 aa, Homo sapiens; identical to SEQ ID NO: 838488

SEQ ID NO: 838493 - protein, 107 aa, Homo sapiens
NRLLTATDSIQLWAPPGDDILEEEEEIDNTVPPVLNDWKCVWQCKTSVSVHLMEWSPDGEYFATAGKDDCLLKVWYPMTGWKSSIIPQDHHEVKRRQSSTQFSFVYL

SEQ ID NO: 838494 - protein, 104 aa, Homo sapiens
MACIMALPWLKKKKKKEKRNGGFSRLLWAAARVIATCISLFISSLSYHRLSSVSERAEVPTCTTFLQRGRYVRSHTLKCFERIHFPTDFLIGCFWVKFCSQYFF

SEQ ID NO: 838495 - protein, 331 aa, Homo sapiens
GVFEASRLLNNFLLPFCACLAIQTEQLPSALADTTDSTTDSLDERKIKGVIELRKSLLSALRTYEPYGSLVQQIRILLLGPIGAGKSSFFNSVRSVFQGHVTHQALVGTNTTGISEKYRTYSIRDGKDGKYLPFILCDSLGLSEKEGGLCRDDIFYILNGNIRDRYQFNPMESIKLNHHDYIDSPSLKDRIHCVAFVFDASSIQYFSSQMIVKIKRIRRELVNAGVVHVALLTHVDSMDLITKGDLIEIERCEPVRSKLEEVQRKLGFALSDISVVSNYSSEWELDPVKDVLILSALRRMLWAADDFLEDLPFEQIGNLREEIINCAQGKK

SEQ ID NO: 838496 - protein, 428 aa, Homo sapiens
MAVTTRLTWLHEKILQNHFGGKRLSLLYKGSVHGFRNGVLLDRCCNQGPTLTVIYSEDHIIGAYAEESYQEGKYASIILFALQDTKISEWKLGLCTPETLFCCDVTKYNSPTNFQIDGRNRKVIMDLKTMENLGLAHSLDERKIKGVIELRKSLLSALRTYEPYGSLVQQIRILLLGPIGAGKSSFFNSVRSVFQGHVTHQALVGTNTTGISEKYRTYSIRDGKDGKYLPFILCDSLGLSEKEGGLCRDDIFYILNGNIRDRYQFNPMESIKLNHHDYIDSPSLKDRIHCVAFVFDASSIQYFSSQMIVKIKRIRRELVNAGVVHVALLTHVDSMDLITKGDLIEIERCEPVRSKLEEVQRKLGFALSDISVVSNYSSEWELDPVKDVLILSALRRMLWAADDFLEDLPFEQIGNLREEIINCAQGKK

SEQ ID NO: 838497 - protein, 452 aa, Homo sapiens [sequence omitted]

SEQ ID NO: 838498 - protein, 161 aa, Homo sapiens [sequence omitted]

SEQ ID NO: 838499 - protein, 350 aa, Homo sapiens
MAVTTRLTWLHEKILQNHFGGKRLSLLYKGSVHGFRNGVLLDRCCNQGPTLTVIYSEDHIIGAYAEESYQEGKYASIILFALQDTKISEWKLGLCTPETLFCCDVTKYNSPTNFQIDGRNRKVIMDLKTMENLGLAQNCTISIQDYEVFRCEDSLDERKIKGVIELRKSLLSALRTYEPYGSLVQQIRILLLGPIGAGKSSFFNSVRSVFQGHVTHQALVGTNTTGISEKYRTYSIRDGKDGKYLPFILCDSLGLSEKEGGLCRDDIFYILNGNIRDRYQFNPMESIKLNHHDYIDSPSLKDRIHCVAFVFDASSIQYFSSQMIVKIKRIRRELVNAARGSPKKTWICSF

SEQ ID NO: 838500 - protein, 161 aa, Homo sapiens [sequence omitted]

SEQ ID NO: 838501 - protein, 373 aa, Homo sapiens
MAVTTRLTWLHEKILQNHFGGKRLSLLYKGSVHGFRNGVLLDRCCNQGPTLTVIYSEDHIIGAYAEESYQEGKYASIILFALQDTKISEWKLGLCTPETLFCCDVTKYNSPTNFQIDGRNRKVIMDLKTMENLGLAQNCTISIQDYEVFRCEDSLDERKIKGVIELRKSLLSALRTYEPYGSLVQQIRILLLGPIGAGKSSFFNSVRSVFQGHVTHQALVGTNTTGISEKYRTYSIRDGKDGKYLPFILCDSLGLSEKEGGLCRDDIFYILNGNIRDRYQFNPMESIKLNHHDYIDSPSLKDRIHCVAFVFDASSIQYFSSQMIVKIKRIRRELVNAGVVHVALLTHVDSMDLITKGDLIEIERCEPVRSKGI

SEQ ID NO: 838502 - protein, 444 aa, Homo sapiens
MAVTTRLTWLHEKILQNHFGGKRLSLLYKGSVHGFRNGVLLDRCCNQGPTLTVIYSEDHIIGAYAEESYQEGKYASIILFALQDTKISEWKLGLCTPETLFCCDVTKYNSPTNFQIDGRNRKVIMDLKTMENLGLAQNCTISIQDYEVFRCEDSLDERKIKGVIELRKSLLSALRTYEPYGSLVQQIRILLLGPIGAGKSSFFNSVRSVFQGHVTHQALVGTNTTGISEKYRTYSIRDGKDGKYLPFILCDSLGLSEKEGGLCRDDIFYILNGNIRDRYQFNPMESIKLNHHDYIDSPSLKDRIHCVAFVFDASSIQYFSSQMIVKIKRIRRELVNAGVVHVALLTHVDSMDLITKGDLIEIERCEPVRSKLEEVQRKLGFALSDISVVSNYSSEWELDPVKDVLILSALRRMLWAADDFLEDLPFEQIGNLREEIINCAQGKK

SEQ ID NO: 838503 - protein, 157 aa, Homo sapiens
MAVTTRLTWLHEKILQNHFGGKRLSLLYKGSVHGFRNGVLLDRCCNQGPTLTVIYSEDHIIGAYAEESYQEGKYASIILFALQDTKISEWKLGLCTPETLFCCDVTKYNSPTNFQIDGRNRKVIMDLKTMENLGLAQNCTISIQDYEVFRCEGLENL

SEQ ID NO: 838504 - protein, 396 aa, Homo sapiens
MAVTTRLTWLHEKILQNHFGGKRLSLLYKGSVHGFRNGVLLDRCCNQGPTLTVIYSEDHIIGAYAEESYQEGKYASIILFALQDTKISEWKLGLCTPETLFCCDVTKYNSPTNFQIDGRNRKVIMDLKTMENLGLAQNCTISIQDYEVFRCEDSLDERKIKGVIELRKSLLSALRTYEPYGSLVQQIRILLLGPIGAGKSSFFNSVRSVFQGHVTHQALVGTNTTGISEKYRTYSIRDGKDGKYLPFILCDSLGLSEKEGGLCRDDIFYILNGNIRDRYQFNPMESIKLNHHDYIDSPSLKDRIHCVAFVFDASSIQYFSSQMIVKIKRIRRELVNAGVVHVALLTHVDSMDLITKGDLIEIERCEPVRSKVMNDALRKHIFWARGSPKKTWICSF

SEQ ID NO: 838505 - protein, 352 aa, Homo sapiens
MAVTTRLTWLHEKILQNHFGGKRLSLLYKGSVHGFRNGVLLDRCCNQGPTLTVIYSEDHIIGAYAEESYQEGKYASIILFALQDTKISEWKLGLCTPETLFCCDVTKYNSPTNFQIDGRNRKVIMDLKTMENLGLAQNCTISIQDYEVFRCEDSLDERKIKGVIELRKSLLSALRTYEPYGSLVQQIRILLLGPIGAGKSSFFNSVRSVFQGHVTHQALVGTNTTGISEKYRTYSIRDGKDGKYLPFILCDSLGLSEKEGGLCRDDIFYILNGNIRDRYQFNPMESIKLNHHDYIDSPSLKDRIHCVAFVFDASSIQYFSSQMIVKIKRIRRELVNAGNLREEIINCAQGKK

SEQ ID NO: 838506 - protein, 106 aa, Homo sapiens
MMRTQCLLGLRTFVAFAAKLWSFSALLRWQICMVIQHQTVRYDIIPLSSCPGISQVKRKIMVLDPDEILIHSHHDGVLRLTVWPGTPPDFILKVVIDKHPVRFFVH

SEQ ID NO: 838507 - protein, 390 aa, Homo sapiens
MRTRTGSQLAAREVTGSGAVPRQLEGRRCQAGRDANGGTSSDGSSSMAAIYGGVEGGGTRSEVLLVSEDGKILAEADGLSTNHWLIGTDKCVERINEMVNRAKRKAGVDPLVPLRSLGLSLSGGDQEDAGRILIEELRDRFPYLSESYLITTDAAGSIATATPDGGVVLISGTGSNCRLINPDGSESGCGGWGHMMGDEGSAYWIAHQAVKIVFDSIDNLEAAPHDIGYVKQAMFHYFQVPDRLGILTHLYRDFDKCRFAGFCRKIAEGAQQGDPLSRYIFRKAGEMLGRHIVAVLPEIDPVLFQGKIGLPILCVGSVWKSWELLKEGFLLALTQGREIQAQNFFSSFTLMKLRHSSALGGASLGARHIGHLLPMDYSANAIAFYSYTFS

SEQ ID NO: 838508 - protein, 390 aa, Homo sapiens; identical to SEQ ID NO: 838507

SEQ ID NO: 838509 - protein, 293 aa, Homo sapiens
MVNRAKRKAGVDPLVPLRSLGLSLSGGDQEDAGRILIEELRDRFPYLSESYLITTDAAGSIATATPDGGVVLISGTGSNCRLINPDGSESGCGGWGHMMGDEGSAYWIAHQAVKIVFDSIDNLEAAPHDIGYVKQAMFHYFQVPDRLGILTHLYRDFDKCRFAGFCRKIAEGAQQGDPLSRYIFRKAGEMLGRHIVAVLPEIDPVLFQGKIGLPILCVGSVWKSWELLKEGFLLALTQGREIQAQNFFSSFTLMKLRHSSALGGASLGARHIGHLLPMDYSANAIAFYSYTFS

SEQ ID NO: 838510 - protein, 195 aa, Homo sapiens
MGDEGSAYWIAHQAVKIVFDSIDNLEAAPHDIGYVKQAMFHYFQVPDRLGILTHLYRDFDKCRFAGFCRKIAEGAQQGDPLSRYIFRKAGEMLGRHIVAVLPEIDPVLFQGKIGLPILCVGSVWKSWELLKEGFLLALTQGREIQAQNFFSSFTLMKLRHSSALGGASLGARHIGHLLPMDYSANAIAFYSYTFS

SEQ ID NO: 838511 - protein, 383 aa, Homo sapiens [sequence omitted]

SEQ ID NO: 838512 - protein, 225 aa, Homo sapiens
MRTRTGSQLAAREVTGSGAVPRQLEGRRCQAGRDANGGTSSDGSSSMAAIYGGVEGGGTRSEVLLVSEDGKILAEADGLSTNHWLIGTDKCVERINEMVNRAKRKAGVDPLVPLRSLGLSLSGGDQEDAGRILIEELRDRFPYLSESYLITTDAAGSIATATPDGGVVLISGTGSNCRLINPDGSESGCGGWGHMMGDEGSGELTDWPSSRSWICSFLHSLSFSP

SEQ ID NO: 838513 - protein, 288 aa, Homo sapiens
MRTRTGSQLAAREVTGSGAVPRQLEGRRCQAGRDANGGTSSDGSSSMAAIYGGVEGGGTRSEVLLVSEDGKILAEADGLSTNHWLIGTDKCVERINEMVNRAKRKAGVDPLVPLRSLGLSLSGGDQEDAGRILIEELRDRFPYLSESYLITTDAAGSIATATPDGGVVLISGTGSNCRLINPDGSESGCGGWGHMMGDEGSAYWIAHQAVKIVFDSIDNLEAAPHDIGYVKQAMFHYFQVPDRLGILTHLYRDFDKCRCSAGRPPFPLYLQEGWGDAGQTHRSSVARD

SEQ ID NO: 838514 - protein, 205 aa, Homo sapiens
MRTRTGSQLAAREVTGSGAVPRQLEGRRCQAGRDANGGTSSDGSSSMAAIYGGVEGGGTRSEVLLVSEDGKILAEADGLSTNHWLIGTDKCVERINEMVNRAKRKAGVDPLVPLRSLGLSLSGGDQEDAGRILIEELRDRFPYLSESYLITTDAAGSIATATPDGGVVLISGTGSNCRLINPDGSESGCGGWGHMMGDEGSALAH

SEQ ID NO: 838515 - protein, 396 aa, Homo sapiens
MRTRTGSQLAAREVTGSGAVPRQLEGRRCQAGRDANGGTSSDGSSSMAAIYGGVEGGGTRSEVLLVSEDGKILAEADGLSTNHWLIGTDKCVERINEMVNRAKRKAGVDPLVPLRSLGLSLSGGDQEDAGRILIEELRDRFPYLSESYLITTDAAGSIATATPDGGVVLISGTGSNCRLINPDGSESGCGGWGHMMGDEGSALSAPAAYWIAHQAVKIVFDSIDNLEAAPHDIGYVKQAMFHYFQVPDRLGILTHLYRDFDKCRFAGFCRKIAEGAQQGDPLSRYIFRKAGEMLGRHIVAVLPEIDPVLFQGKIGLPILCVGSVWKSWELLKEGFLLALTQGREIQAQNFFSSFTLMKLRHSSALGGASLGARHIGHLLPMDYSANAIAFYSYTFS

SEQ ID NO: 838516 - protein, 208 aa, Homo sapiens
ATLVGSPAHGVCMMGDEGSAYWIAHQAVKIVFDSIDNLEAAPHDIGYVKQAMFHYFQVPDRLGILTHLYRDFDKCRFAGFCRKIAEGAQQGDPLSRYIFRKAGEMLGRHIVAVLPEIDPVLFQGKIGLPILCVGSVWKSWELLKEGFLLALTQGREIQAQNFFSSFTLMKLRHSSALGGASLGARHIGHLLPMDYSANAIAFYSYTFS

SEQ ID NO: 838517 - protein, 104 aa, Homo sapiens [sequence omitted]

SEQ ID NO: 838518 - protein, 328 aa, Homo sapiens
MRTRTGSQLAAREVTGSGAVPRQLEGRRCQAGRDANGGTSSDGSSSMAAIYGGVEGGGTRSEVLLVSEDGKILAEADGLSTNHWLIGTDKCVERINEMVNRAKRKAGVDPLVPLRSLGLSLSGGDQEDAGRILIEELRDRFPYLSESYLITTDAAGSIATATPDGGVVLISGTGSNCRLINPDGSESGCGGWGHMMGDEGSAYWIAHQAVKIVFDSIDNLEAAPHDIGYVKQAMFHYFQVLFQGKIGLPILCVGSVWKSWELLKEGFLLALTQGREIQAQNFFSSFTLMKLRHSSALGGASLGARHIGHLLPMDYSANAIAFYSYTFS

SEQ ID NO: 838519 - protein, 225 aa, Homo sapiens; identical to SEQ ID NO: 838512

SEQ ID NO: 838520 - protein, 390 aa, Homo sapiens; identical to SEQ ID NO: 838507

SEQ ID NO: 838521 - protein, 293 aa, Homo sapiens; identical to SEQ ID NO: 838509

SEQ ID NO: 838522 - protein, 293 aa, Homo sapiens; identical to SEQ ID NO: 838509

SEQ ID NO: 838523 - protein, 195 aa, Homo sapiens; identical to SEQ ID NO: 838510

SEQ ID NO: 838524 - protein, 195 aa, Homo sapiens; identical to SEQ ID NO: 838510

SEQ ID NO: 838525 - protein, 191 aa, Homo sapiens
MGDEGSAYWIAHQAVKIVFDSIDNLEAAPHDIGYVKQAMFHYFQVPDRLGILTHLYRDFDKCRFAGFCRKIAEGAQQGDPLSRYIFRKAGEMLGRHIVAVLPEIDPVLFQGKIGLPILCVGSVWKSWELLKEGFLLALTQGREIQAQNFFSSFTLMKLRHSSALGGASLGARHIGHLLPMDYSANAIAFYI

SEQ ID NO: 838526 - protein, 135 aa, Homo sapiens
MKSMLGNTDNFSQMRNLKSLYFGVKKNYSSFSNSRDIRKANFGGQIGDFPLLLMTLLCPFSSQVPDRLGILTHLYRDFDKCRFAGFCRKIAEGTGGGGWVLSGFVLQRSPVGRLSGVQTGLTTIFLSPSDLSSLP

SEQ ID NO: 838527 - protein, 468 aa, Homo sapiens
RGGRRADPGSRQRRCGGSRETLRAGLAGGGADGDGALSGCRRGRAPRVPSMAGSLPPCVVDCGTGYTKLGYAGNTEPQFIIPSCIAIRESAKVVDQAQRRVLRGVDDLDFFIGDEAIDKPTYATKWPIRHGIIEDWDLMERFMEQVVFKYLRAEPEDHYFLMTEPPLNTPENREYLAEIMFESFNVPGLYIAVQAVLALAASWTSRQVGERTLTGIVIDSGDGVTHVIPVAEGYVIGSCIKHIPIAGRDITYFIQQLLREREVGIPPEQSLETAKAIKEKYCYICPDIVKEFAKYDVDPRKWIKQYTGINAINQKKFVIDVGYERFLGPEIFFHPEFANPDFMESISDVVDEVIQNCPIDVRRPLYKNVVLSGGSTMFRDFGRRLQRDLKRVVDARLRLSEELSGGRIKPKPVEVQVVTHHMQRYAVWFGGSMLASTPEFFQVCHTKKDYEEYGPSICRHNPVFGVMS

SEQ ID NO: 838528 - protein, 468 aa, Homo sapiens; identical to SEQ ID NO: 838527

SEQ ID NO: 838529 - protein, 163 aa, Homo sapiens
RGGRRADPGSRQRRCGGSRETLRAGLAGGGADGDGALSGCRRGRAPRVPSMAGSLPPCVVDCGTGYTKLGYAGNTEPQFIIPSCIAIRESAKVVDQAQRRVLRGVDDLDFFIGDEAIDKPTYATKWPIRHGIIEDWDLMERFMEQVVFKYLRAEPEDHYFLMG

SEQ ID NO: 838530 - protein, 398 aa, Homo sapiens
RGGRRADPGSRQRRCGGSRETLRAGLAGGGADGDGALSGCRRGRAPRVPSMAGSLPPCVVDCGTGYTKLGYAGNTEPQFIIPSCIAIRESAKVVDQAQRRVLRGVDDLDFFIGDEAIDKPTYATKWPIRHGIIEDWDLMERFMEQVVFKYLRAEPEDHYFLMTEPPLNTPENREYLAEIMFESFNVPGLYIAVQAVLALAASWTSRQVGERTLTGIVIDSGDGVTHVIPVAEGYVIGSCIKHIPIAGRDITYFIQQLLREREVGIPPEQSLETAKAIKEKYCYICPDIVKEFAKYDVDPRKWIKQYTGINAINQKKFVIDVGYERFLGPEIFFHPEFANPDFMESISDVVDEVIQNCPIDVRRPLYKPEFFQVCHTKKDYEEYGPSICRHNPVFGVMS

SEQ ID NO: 838531 - protein, 114 aa, Homo sapiens
GFTQGSLCFVSCENVVLSGGSTMFRDFGRRLQRDLKRVVDARLRLSEELSGGRIKPKPVEVQVVTHHMQRYAVWFGGSMLASTPEFFQVCHTKKDYEEYGPSICRHNPVFGVMS

SEQ ID NO: 838532 - protein, 460 aa, Homo sapiens
RGGRRADPGSRQRRCGGSRETLRAGLAGGGADGDGALSGCRRGRAPRVPSMAGSLPPCVVDCGTGYTKLGYAGNTEPQFIIPSCIAIRESAKVVDQAQRRVLRGVDDLDFFIGDEAIDKPTYATKWPIRHGIIEDWDLMERFMEQVVFKYLRAEPEDHYFLMTEPPLNTPENREYLAEIMFESFNVPGLYIAVQAVLALAASWTSRQVGERTLTGIVIDSGDGVTHVIPVAEGYVIGSCIKHIPIAGRDITYFIQQLLREREVGIPPEQSLETAKAIKEKYCYICPDIVKEFAKYDVDPRKWIKQYTGINAINQKKFVIDVGYERFLGPEIFFHPEFANPDFMESISDVVDEVIQNCPIDVRRPLYKNVVLSGGSTMFRDFGRRLQRDLKRVVDARLRLSEELSGGRIKPKPVEVQVVTHHMQRYAVWFGGSMLASTPRVLSGLPTSRAACLGISSGRNM

SEQ ID NO: 838533 - protein, 163 aa, Homo sapiens; identical to SEQ ID NO: 838529

SEQ ID NO: 838534 - protein, 330 aa, Homo sapiens
MERFMEQVVFKYLRAEPEDHYFLMTEPPLNTPENREYLAEIMFESFNVPGLYIAVQAVLALAASWTSRQVGERTLTGIVIDSGDGVTHVIPVAEGYVIGSCIKHIPIAGRDITYFIQQLLREREVGIPPEQSLETAKAIKEKYCYICPDIVKEFAKYDVDPRKWIKQYTGINAINQKKFVIDVGYERFLGPEIFFHPEFANPDFMESISDVVDEVIQNCPIDVRRPLYKNVVLSGGSTMFRDFGRRLQRDLKRVVDARLRLSEELSGGRIKPKPVEVQVVTHHMQRYAVWFGGSMLASTPEFFQVCHTKKDYEEYGPSICRHNPVFGVMS

SEQ ID NO: 838535 - protein, 301 aa, Homo sapiens
RGGRRADPGSRQRRCGGSRETLRAGLAGGGADGDGALSGCRRGRAPRVPSMAGSLPPCVVDCGTGYTKLGYAGNTEPQFIIPSCIAIRESAKVVDQAQRRVLRGVDDLDFFIGDEAIDKPTYATKWPIRHGIIEDWDLMERFMEQVVFKYLRAEPEDHYFLMTEPPLNTPENREYLAEIMFESFNVPGLYIAVQAVLALAASWTSRQVGERTLTGIVIDSGDGVTHVIPVAEGYVIGSCIKHIPIAGRDITYFIQQLLREREVGIPPEQSLETAKAIKEKYCYICPDIVKEFANGVHLRCC

SEQ ID NO: 838536 - protein, 126 aa, Homo sapiens
MESISDVVDEVIQNCPIDVRRPLYKNVVLSGGSTMFRDFGRRLQRDLKRVVDARLRLSEELSGGRIKPKPVEVQVVTHHMQRYAVWFGGSMLASTPEFFQVCHTKKDYEEYGPSICRHNPVFGVMS

SEQ ID NO: 838537 - protein, 463 aa, Homo sapiens
RGGRRADPGSRQRRCGGSRETLRAGLAGGGADGDGALSGCRRGRAPRVPSMAGSLPPCVVDCGTGYTKLGYAGNTEPQFIIPSCIAIRESAKVVDQAQRRVLRGVDDLDFFIGDEAIDKPTYATKWPIRHGIIEDWDLMERFMEQVVFKYLRAEPEDHYFLMTEPPLNTPENREYLAEIMFESFNVPGLYIAVQAVLALAASWTSRQVGERTLTGIVIDSGDGVTHVIPVAEGYVIGSCIKHIPIAGRDITYFIQQLLREREVGIPPEQSLETAKAIKEKYCYICPDIVKEFAKYDVDPRKWIKQYTGINAINQKKFVIDVGYERFLGPEIFFHPEFANPDFMESISDVVDEVIQNCPIDVRRPLYKNVVLSGGSTMFRDFGRRLQRDLKRVVDARLRLSEELSGGRIKPKPVEVQVVTHHMQRYAVWFGGSMLASTVSPSLEGSVSPFLCSRLSLGKYCLRR

SEQ ID NO: 838538 - protein, 263 aa, Homo sapiens
RGGRRADPGSRQRRCGGSRETLRAGLAGGGADGDGALSGCRRGRAPRVPSMAGSLPPCVVDCGTGYTKLGYAGNTEPQFIIPSCIAIRESAKVVDQAQRRVLRGVDDLDFFIGDEAIDKPTYATKWPIRHGIIEDWDLMERFMEQVVFKYLRAEPEDHYFLMTEPPLNTPENREYLAEIMFESFNVPGLYIAVQAVLALAASWTSRQVGERTLTGIVIDSGDGVTHVIPVAEGYVIGSCIKHIPIAGEILLHLPRYSQGICQV

SEQ ID NO: 838539 - protein, 597 aa, Homo sapiens
MAEIIQERIEDRLPELEQLERIGLFSHAEIKAIIKKASDLEYKIQRRTLFKEDFINYVQYEINLLELIQRRRTRIGYSFKKDEIENSIVHRVQGVFQRASAKWKDDVQLWLSYVAFCKKWATKTRLSKVFSAMLAIHSNKPALWIMAAKWEMEDRLSSESARQLFLRALRFHPECPKLYKEYFRMELMHAEKLRKEKEEFEKASMDVENPDYSEEILKGELAWIIYKNSVSIIKGAEFHVSLLSIAQLFDFAKDLQKEIYDDLQALHTDDPLTWDYVARRELEIESQTEEQPTTKQAKAVEVGRKEERCCAVYEEAVKTLPTEAMWKCYITFCLERFTKKSNSGFLRGKRLERTMTVFRKAHELKLLSECQYKQLSVSLLCYNFLREALEVAVAGTELFRDSGTMWQLKLQVLIESKSPDIAMLFEEAFVHLKPQVCLPLWISWAEWSEGAKSQEDTEAVFKKALLAVIGADSVTLKNKYLDWAYRSGGYKKARAVFKSLQESRPFSVDFFRKMIQFEKEQESCNMANIREYYERALREFGSADSDLWMDYMKEELNHPLGRPENCGQIYWRAMKMLQGESAEAFVAKHAMHQTGHL

SEQ ID NO: 838540 - protein, 597 aa, Homo sapiens; identical to SEQ ID NO: 838539

SEQ ID NO: 838541 - protein, 597 aa, Homo sapiens; identical to SEQ ID NO: 838539

SEQ ID NO: 838542 - protein, 553 aa, Homo sapiens
MAEIIQERIEDRLPELEQLERIGLFSHAEIKAIIKKASDLEYKIQRRTLFKEDFINYVQYEINLLELIQRRRTRIGYSFKKDEIENSIVHRVQGVFQRASAKWKDDVQLWLSYVAFCKKWATKTRLSKVFSAMLAIHSNKPALWIMAAKWEMEDRLSSESARQLFLRALRFHPECPKLYKEYFRMELMHAEKLRKEKEEFEKASMDVENPDYSEEILKGELAWIIYKNSVSIIKGAEFHVSLLSIAQLFDFAKDLQKEIYDDLQALHTDDPLTWDYVARRELEIESQTEEQPTTKQAKAVEVGRKEERCCAVYEEAVKTLPTEAMWKCYITFCLERFTKKSNSGFLRGKRLERTMTVFRKAHELKLLSECQYKQLSVSLLCYNFLREALEVAVAGTELFRDSGTMWQLKLQVLIESKSPDIAMLFEEAFVHLKPQVCLPLWISWAEWSEGAKSQEDTEAVFKKALLAVIGADSVTLKNKYLDWAYRSGGYKKARAVFKSLQESRPFSVDFFRKMIQFEKEQTESLSVAQAGLLAHCNLCFPGILQYGEHKRIL

SEQ ID NO: 838543 - protein, 527 aa, Homo sapiens
MAEIIQERIEDRLPELEQLERIGLFSHAEIKAIIKKASDLEYKIQRRTLFKEDFINYVQYEINLLELIQRRRTRIGYSFKKDEIENSIVHRVQGVFQRASAKWKDDVQLWLSYVAFCKKWATKTRLSKVFSAMLAIHSNKPALWIMAAKWEMEDRLSSESARQLFLRALRFHPECPKLYKEYFRMELMHAEKLRKEKEEFEKASMDVENPDYSEEILKGELAWIIYKNSVSIIKGAEFHVSLLSIAQLFDFAKDLQKEIYDDLQALHTDDPLTWDYVARRELEIESQTEEQPTTKQAKAVEVGRKEERCCAVYEEAVKTLPTEAMWKCYITFCLERFTKKSNSGFLRGKRLERTMTVFRKAHELKLLSECQYKQLSVSLLCYNFLREALEVAVAGTELFRDSGTMWQLKLQVLIESKSPDIAMLFEEAFVHLKPQVCLPLWISWAEWSEGAKSQEDTEAVFKKALLAVIGADSVTLKNKYLDWAYRSGGYKKARAVFKSLQESRPFSVDFFRKMIQFEKEQIFGWII

SEQ ID NO: 838544 - protein, 597 aa, Homo sapiens; identical to SEQ ID NO: 838539

SEQ ID NO: 838545 - protein, 120 aa, Homo sapiens
MLAIHSNKPALWIMAAKWEMEDRLSSESARQLFLRALRFHPECPKLYKEYFRMELMHAEKLRKEKEEFEKASMDVENPDYSEEILKGELAWIIYKNSVSIIKGSYSVTHAGVQWYNYGSL

SEQ ID NO: 838546 - protein, 446 aa, Homo sapiens
MENRLSSESARQLFLRALRFHPECPKLYKEYFRMELMHAEKLRKEKEEFEKASMDVENPDYSEEILKGELAWIIYKNSVSIIKGAEFHVSLLSIAQLFDFAKDLQKEIYDDLQALHTDDPLTWDYVARRELEIESQTEEQPTTKQAKAVEVGRKEERCCAVYEEAVKTLPTEAMWKCYITFCLERFTKKSNSGFLRGKRLERTMTVFRKAHELKLLSECQYKQLSVSLLCYNFLREALEVAVAGTELFRDSGTMWQLKLQVLIESKSPDIAMLFEEAFVHLKPQVCLPLWISWAEWSEGAKSQEDTEAVFKKALLAVIGADSVTLKNKYLDWAYRSGGYKKARAVFKSLQESRPFSVDFFRKMIQFEKEQESCNMANIREYYERALREFGSADSDLWMDYMKEELNHPLGRPENCGQIYWRAMKMLQGESAEAFVAKHAMHQTGHL

SEQ ID NO: 838547 - protein, 243 aa, Homo sapiens [sequence omitted]

SEQ ID NO: 838548 - protein, 553 aa, Homo sapiens; identical to SEQ ID NO: 838542

SEQ ID NO: 838549 - protein, 176 aa, Homo sapiens
DSTKPETVEPIPSHLALPEEVSLQEQLAQGVPRYSYLGQAMDQDGPSEMQEYFLRPGTDPQSEKLHGKMSLEHEGLATADGICSMMIQNQVSPEDALYGFDSYGPVTDSLIHEGENSYKFEEMFNENCFLVQHEQILPRVKPYDCPECGKAFGKSKHLLQHHIIHTGEKPYKCLEC

SEQ ID NO: 838550 - protein, 101 aa, Homo sapiens
MHALPSWSASVSPSVSLDSDAPSVRRSPALGPWSLRLITRGCRDGRGRVWRGQGPLRPSLRKEWRNPKTGPWRPSCKVGRRAGRQDLGRAWGAGPPEGGGG

SEQ ID NO: 838551 - protein, 274 aa, Homo sapiens
MVLGLCPRKGPLTHLISAWFPHFGFFLQNKIQQIENLACIPSLRFLSLAGNQIRQVENLLDLPCLQFLDLSENLIETLKLDEFPQSLLILNLSGNSCTNQDGYRELVTEALPLLLDLDGQPVVERWISDEEDEASSDEEFPELSGPFCSERGFLKELEQELSRHREHRQQTALTEHLLRMEMQPTLTDLPLLPGVPMAGDSSPSATPAQGEETVPEAVSSPQASSPTKKPCSLIPRGHQSSFWGRKGARAATAPKASVAEAPSTTKTTAKRSKK

SEQ ID NO: 838552 - protein, 316 aa, Homo sapiens
MGNCQRRCTQQCCGMNEWVDGTSAFFSMNDSKGRFHTLDELQTVRLDREGITTIRNLEGLQNLHSLYLQGNKIQQIENLACIPSLRFLSLAGNQIRQVENLLDLPCLQFLDLSENLIETLKLDEFPQSLLILNLSGNSCTNQDGYRELVTEALPLLLDLDGQPVVERWISDEEDEASSDEEFPELSGPFCSERGFLKELEQELSRHREHRQQTALTEHLLRMEMQPTLTDLPLLPGVPMAGDSSPSATPAQGEETVPEAVSSPQASSPTKKPCSLIPRGHQSSFWGRKGARAATAPKASVAEAPSTTKTTAKRSKK

SEQ ID NO: 838553 - protein, 291 aa, Homo sapiens
MSGGKSAQGPEEGGVCITEALITKRNLTFPEDGELSEKMFHTLDELQTVRLDREGITTIRNLEGLQNLHSLYLQGNKIQQIENLACIPSLRFLSLAGNQIRQVENLLDLPCLQFLDLSENLIETLKLDEFPQSLLILNLSGNSCTNQDGYRELVTEALPLLLDLDGQPVVERWISDEEDEASSDEEFPELSGPFCSERGFLKELEQELSRHREHRQQTALTEHLLRMEMQPTLTDLPLLPGVPMAGDSSPSATPAQGEETVPEAVSSPQASSPTKKPCSLIPRGLPLFSDL

SEQ ID NO: 838554 - protein, 321 aa, Homo sapiens
MSGGKSAQGPEEGGVCITEALITKRNLTFPEDGELSEKMFHTLDELQTVRLDREGITTIRNLEGLQNLHSLYLQGNKIQQIENLACIPSLRFLSLAGNQIRQVENLLDLPCLQFLDLSENLIETLKLDEFPQSLLILNLSGNSCTNQDGYRELVTEALPLLLDLDGQPVVERWISDEEDEASSDEEFPELSGPFCSERGFLKELEQELSRHREHRQQTALTEHLLRMEMQPTLTDLPLLPGVPMAGDSSPSATPAQGEETVPEAVSSPQASSPTKKPCSLIPRGHQSSFWGRKGARAATAPKASVAEAPSTTKTTAKRSKK

SEQ ID NO: 838555 - protein, 362 aa, Homo sapiens
MSGGKSAQGPEEGGVCITEALITKRNLTFPEDGELSEKMFHTLDELQTVRLDREGITTIRNLEGLQNLHSLYLQGLQPISCFEEEETMKIPVHHSDPTWRLFGGGGGGWLIFSLPLNKIQQIENLACIPSLRFLSLAGNQIRQVENLLDLPCLQFLDLSENLIETLKLDEFPQSLLILNLSGNSCTNQDGYRELVTEALPLLLDLDGQPVVERWISDEEDEASSDEEFPELSGPFCSERGFLKELEQELSRHREHRQQTALTEHLLRMEMQPTLTDLPLLPGVPMAGDSSPSATPAQGEETVPEAVSSPQASSPTKKPCSLIPRGHQSSFWGRKGARAATAPKASVAEAPSTTKTTAKRSKK

SEQ ID NO: 838556 - protein, 45 aa, Homo sapiens
LAQSLPSPFPQPAGPGLSLPAPPVSTSAFPVPQAACPAGHSVSHL

SEQ ID NO: 838557 - protein, 101 aa, Homo sapiens
RILSSLWGTGAGGTVHAKMAVSTEELEATVQEVLGRLKSHQFFQSTWDTVAFIVFLTFMGTVLLLLLLVVAHCCCCSSPGPRRESPRKERPKGVDNLALEP

SEQ ID NO: 838558 - protein, 114 aa, Homo sapiens
WSRKQEAACAPQDLPGWGNWRLLGGGTVHAKMAVSTEELEATVQEVLGRLKSHQFFQSTWDTVAFIVFLTFMGTVLLLLLLVVAHCCCCSSPGPRRESPRKERPKGVDNLALEP

SEQ ID NO: 838559 - protein, 121 aa, Homo sapiens
TKNACAQRKDHVRTQQKGGHLQAKQRGLRRNQPCPQLDLGLPGSRIVRNNFHCLSYTACGILLWQPKQMNTFIKIKTFCLLKKINTQTHRLIKIFVIHTYYISKYVYNSYTLTIKDKQLNF

SEQ ID NO: 838560 - protein, 53 aa, Homo sapiens
MVSDAGGTLWVTTTQCGGEQWAPATAADNGGPGGPDTPGTELLPTTTNIQRPP

SEQ ID NO: 838561 - protein, 942 aa, Homo sapiens
VTVPEPGAAESRAPCGDSSGGCVRSAGASMDQSVAIQETLAEGEYCVIAVQGVLCEGDSRQSRLLGLVRYRLEHGGQEHALFLYTHRRMAITGDDVSLDQIVPVSRDFTLEEVSPDGELYILGSDVTVQLDTAELSLVFQLPFGSQTRMFLHEVARACPGFDSATRDPEFLWLSRYRCAELELEMPTPRGCNSALVTWPGYATIGGGGSNFDGLRPNGKGVPMDQSSRGQDKPESLQPRQNKSKSEITDMVRSSTITVSDKAHILSMQKFGLRDTIVKSHLLQKEEDYTYIQNFRFFAGTYNVNGQSPKECLRLWLSNGIQAPDVYCVGFQELDLSKEAFFFHDTPKEEEWFKAVSEGLHPDAKYAKVKLIRLVGIMLLLYVKQEHAAYISEVEAETVGTGIMGRMGNKGGVAIRFQFHNTSICVVNSHLAAHIEEYERRNQDYKDICSRMQFCQPDPSLPPLTISNHDVILWLGDLNYRIEELDVEKVKKLIEEKDFQMLYAYDQLKIQVAAKTVFEGFTEGELTFQPTYKYDTGSDDWDTSEKCRAPAWCDRILWKGKNITQLSYQSHMALKTSDHKPVSSVFDIGVRVVNDELYRKTLEEIVRSLDKMENANIPSVSLSKREFCFQNVKYMQLKVESFTIHNGQVPCHFEFINKPDEESYCKQWLNANPSRGFLLPDSDVEIDLELFVNKTTATKLNSGEDKIEDILVLHLDRGKDYFLSVSGNYLPSCFGSPIHTLCYMREPILDLPLETISELTLMPVWTGDDGSQLDSPMEIPKELWMMVDYLYRNAVQQEDLFQQPGLRSEFEHIRDCLDTGMIDNLSASNHSVAEALLLFLESLPEPVICYSTYHNCLECSGNYTASKQVISTLPIFHKNVFHYLMAFLRELLKNSAKNHLDENILASIFGSLLLRNPAGHQKLDMTEKKKAQEFIHQFLCNPL

SEQ ID NO: 838562 - protein, 761 aa, Homo sapiens
RRDEELEEAGREMSAAASSRERNTAGGSNFDGLRPNGKGVPMDQSSRGQDKPESLQPRQNKSKSEITDMVRSSTITVSDKAHILSMQKFGLRDTIVKSHLLQKEEDYTYIQNFRFFAGTYNVNGQSPKECLRLWLSNGIQAPDVYCVGFQELDLSKEAFFFHDTPKEEEWFKAVSEGLHPDAKYAKVKLIRLVGIMLLLYVKQEHAAYISEVEAETVGTGIMGRMGNKGGVAIRFQFHNTSICVVNSHLAAHIEEYERRNQDYKDICSRMQFCQPDPSLPPLTISNHDVILWLGDLNYRIEELDVEKVKKLIEEKDFQMLYAYDQLKIQVAAKTVFEGFTEGELTFQPTYKYDTGSDDWDTSEKCRAPAWCDRILWKGKNITQLSYQSHMALKTSDHKPVSSVFDIGVRVVNDELYRKTLEEIVRSLDKMENANIPSVSLSKREFCFQNVKYMQLKVESFTIHNGQVPCHFEFINKPDEESYCKQWLNANPSRGFLLPDSDVEIDLELFVNKTTATKLNSGEDKIEDILVLHLDRGKDYFLSVSGNYLPSCFGSPIHTLCYMREPILDLPLETISELTLMPVWTGDDGSQLDSPMEIPKELWMMVDYLYRNAVQQEDLFQQPGLRSEFEHIRDCLDTGMIDNLSASNHSVAEALLLFLESLPEPVICYSTYHNCLECSGNYTASKQVISTLPIFHKNVFHYLMAFLRELLKNSAKNHLDENILASIFGSLLLRNPAGHQKLDMTEKKKAQEFIHQFLCNPL

SEQ ID NO: 838563 - protein, 71 aa, Homo sapiens
LTTSMPLELCQTPHACHSSQAVLTVVMKNWEPLVSLPALACSPSQARVLQFEVLIGEALTVDALSSCAISR

SEQ ID NO: 838564 - protein, 942 aa, Homo sapiens; identical to SEQ ID NO: 838561

SEQ ID NO: 838565 - protein, 761 aa, Homo sapiens; identical to SEQ ID NO: 838562

SEQ ID NO: 838566 - protein, 761 aa, Homo sapiens; identical to SEQ ID NO: 838562

SEQ ID NO: 838567 - protein, 761 aa, Homo sapiens; identical to SEQ ID NO: 838562

SEQ ID NO: 838568 - protein, 288 aa, Homo sapiens
RRDEELEEAGREMSAAASSRERNTAGGSNFDGLRPNGKGVPMDQSSRGQDKPESLQPRQNKSKSEITDMVRSSTITVSDKAHILSMQKFGLRDTIVKSHLLQKEEDYTYIQNFRFFAGTYNVNGQSPKECLRLWLSNGIQAPDVYCVGFQELDLSKEAFFFHDTPKEEEWFKAVSEGLHPDAKYAKVKLIRLVGIMLLLYVKQEHAAYISEVEAETVGTGIMGRMGNKGGVAIRFQFHNTSICVVNSHLAAHIEEYERRNQDYKDICSRMQFCQPDPSLPPLTISNHE

SEQ ID NO: 838569 - protein, 120 aa, Homo sapiens
TPYREFGPQGQEIRPEVESLPEPVICYSTYHNCLECSGNYTASKQVISTLPIFHKNVFHYLMAFLRELLKNSAKNHLDENILASIFGSLLLRNPAGHQKLDMTEKKKAQEFIHQFLCNPL

SEQ ID NO: 838570 - protein, 761 aa, Homo sapiens; identical to SEQ ID NO: 838562

SEQ ID NO: 838571 - protein, 808 aa, Homo sapiens
RRDEELEEAGREMSAAASSRERNTAGGSNFDGLRPNGKGVPMDQSSRGQDKPESLQPRQNKSKSEITDMVRSSTITVSDKAHILSMQKFGLRDTIVKSHLLQKEEDYTYIQNFRFFAGTYNVNGQSPKECLRLWLSNGIQAPDVYCVGFQELDLSKEAFFFHDTPKEEEWFKAVSEGLHPDAKYAKVKLIRLVGIMLLLYVKQEHAAYISEVEAETVGTGIMGRMGNKGGVAIRFQFHNTSICVVNSHLAAHIEEYERRNQDYKDICSRMQFCQPDPSLPPLTISNHDVILWLGDLNYRIEELDVEKVKKLIEEKDFQMLYAYDQLKIQVAAKTVFEGFTEGELTFQPTYKYDTGSDDWDTSEKCRAPAWCDRILWKGKNITQLSYQSHMALKTSDHKPVSSVFDIGVRVVNDELYRKTLEEIVRSLDKMENANIPSVSLSKREFCFQNVKYMQLKVESFTIHNGQVPCHFEFINKPDEESYCKQWLNANPSRGFLLPDSDVEIDLELFVNKTTATKLNSGEDKIEDILVLHLDRGKDYFLSVSGNYLPSCFGSPIHTLCYMREPILDLPLETISELFWRLRSPRSRHCQLWCLVIILNYICCHLKDSYGDNSNTRELIWSRPMTLMPVWTGDDGSQLDSPMEIPKELWMMVDYLYRNAVQQEDLFQQPGLRSEFEHIRDCLDTGMIDNLSASNHSVAEALLLFLESLPEPVICYSTYHNCLECSGNYTASKQVISTLPIFHKNVFHYLMAFLRELLKNSAKNHLDENILASIFGSLLLRNPAGHQKLDMTEKKKAQEFIHQFLCNPL

SEQ ID NO: 838572 - protein, 761 aa, Homo sapiens; identical to SEQ ID NO: 838562

SEQ ID NO: 838573 - protein, 271 aa, Homo sapiens
MRELAIEIGVRALLFGVFVFTEFLDPFQRVIQPEEIWLYKNPLVQSDNIPTRLMFAISFLTPLAVICVVKIIRRTDKTEIKEAFLAVSLALALNGVCTNTIKLIVGRPRPDFFYRCFPDGVMNSEMHCTGDPDLVSEGRKSFPSIHSSFAFSGLGFTTFYLAGKLHCFTESGRGKSWRLCAAILPLYCAMMIALSRMCDYKHHWQDSFVGGVIGLIFAYICYRQHYPPLANTACHKPYVSLRVPASLKKEERPTADSAPSLPLEGITEGPV

SEQ ID NO: 838574 - protein, 271 aa, Homo sapiens; identical to SEQ ID NO: 838573

SEQ ID NO: 838575 - protein, 222 aa, Homo sapiens
MRELAIEIGVRALLFGVFVFTEFLDPFQRVIQPEEIWLYKNPLVQSDNIPTRLMFAISFLTPLAVICVVKIIRRTDKTEIKEAFLAVSLALALNGVCTNTIKLIVGRPRPDFFYRCFPDGVMNSEMHCTGDPDLVSEGRKSFPSIHSSFAFSGLGFTTFYLAGKLHCFTESGRGKSWRLCAAILPLYCAMMIALSRMCDYKHHWQAVGRSQPSRRMAAPICS

SEQ ID NO: 838576 - protein, 271 aa, Homo sapiens; identical to SEQ ID NO: 838573

SEQ ID NO: 838577 - protein, 395 aa, Homo sapiens
MRELAIEIGVRALLFGVFVFTEFLDPFQRVIQPEEIWLYKNPLVQSDNIPTRLMFAISFLTPLAVICVVKIIRRTDKTEIKEAFLAVSLALALNGVCTNTIKLIVGRPRPDFFYRCFPDGVMNSEMHCTGDPDLVSEGRKSFPSIHSSFAFSGLGFTTFYLAGKLHCFTESGRGKSWRLCAAILPLYCAMMIALSRMCDYKHHWQDSFVGGVIGLIFAYICYRQHYPPLANTACHKPYVSLRVPASLKKEERPTADSAPSLPLEGITPRPPPPSPRHDAPPPPSAPTSISYLSLLSASLSALFLLLLPIPSVLLNIAKFWHTSHLPLPPLHLYPRPPSTARRTSPPLSYLIPPPHLPPPTHLTSPSPLRSLLTTLSSPLPRSPLRGTRPLHIHYS

SEQ ID NO: 838578 - protein, 64 aa, Homo sapiens
QLGSDPRKAEACPGLSWGWEDSQVVVSSPFLGLIPETKSTQSIWVFPEACLRRRPGLVGVIGGG

SEQ ID NO: 838579 - protein, 350 aa, Homo sapiens [sequence omitted]

SEQ ID NO: 838580 - protein, 374 aa, Homo sapiens
SPGDPDLELPRARPQLVNSPGADKMETNSSLPTNISGGTPAVSAGYLFLDIITYLVFAVTFVLGVLGNGLVIWVAGFRMTHTVTTISYLNLAVADFCFTSTLPFFMVRKAMGGHWPFGWFLCKFVFTIVDINLFGSVFLIALIALDRCVCVLHPVWTQNHRTVSLAKKVIIGPWVMALLLTLPVIIRVTTVPGKTGTVACTFNFSPWTNDPKERINVAVAMLTVRGIIRFIIGFSAPMSIVAVSYGLIATKIHKQGLIKSSRPLRVLSFVAAAFFLCWSPYQVVALIATVRIRELLQGMYKEIGIAVDVTSALAFFNSCLNPMLYVFMGQDFRERLIHALPASLERALTEDSTQTSDTATNSTLPSAEVALQAK

SEQ ID NO: 838581 - protein, 374 aa, Homo sapiens; identical to SEQ ID NO: 838580

SEQ ID NO: 838582 - protein, 411 aa, Homo sapiens
SPGDPDLELPRARPQLVNSPGADKMETNSSLPTNISGGTPAVSAGYLFLDIITYLVFAVTFVLGVLGNGLVIWVAGFRMTHTVTTISYLNLAVADFCFTSTLPFFMVRKAMGGHWPFGWFLCKFVFTIVDINLFGSVFLIALIALDRCVCVLHPVWTQNHRTVSLAKKVIIGPWVMALLLTLPVIIRVTTVPGKTGTVACTFNFSPWTNDPKERINVAVAMLTVRGIIRFIIGFSAPMSIVAVSYGLIATKIHKQGLIKSSRPLRVLSFVAAAFFLCWSPYQVVALIATVRIRELLQGMYKEIGIAVDVTSALAFFNSCLNPMLYVFMGQDFRERLIHALPASLERALTEDSTQTSDTATNSTLPSAECVQVGGFTQLLLATSYDTIKKTFFLIKKKKFFFFFFFFFFFFF

SEQ ID NO: 838583 - protein, 316 aa, Homo sapiens
TPHRSSQVQALVWSLRRWEMLARAARGTGALLLRGSLLASGRAPRRASSGLPRNTVVLFVPQQEAWVVERMGRFHRILEPGLNILIPVLDRIRYVQSLKEIVINVPEQSAVTLDNVTLQIDGVLYLRIMDPYKASYGVEDPEYAVTQLAQTTMRSELGKLSLDKVFRERESLNASIVDAINQAADCWGIRCLRYEIKDIHVPPRVKESMQMQVEAERRKRATVLESEGTRESAINVAEGKKQAQILASEAEKAEQINQAAGEASAVLAKAKAKAEAIRILVESCPHNAASRVPLMWPAVFRFPHVLSAYYGSLGVP

SEQ ID NO: 838584 - protein, 88 aa, Homo sapiens
KAFHLEPVVWPSSMSARSPKLAKDSNTILLPSNPGDVTSMVAQAMGVYGALTKAPVPGTPDSLSSGSSRDVQGTDASLDEELDRVKMS

SEQ ID NO: 838585 - protein, 365 aa, Homo sapiens
TPHRSSQVQALVWSLRRWEMLARAARGTGALLLRGSLLASGRAPRRASSGLPRNTVVLFVPQQEAWVVERMGRFHRILEPGLNILIPVLDRIRYVQSLKEIVINVPEQSAVTLDNVTLQIDGVLYLRIMDPYKASYGVEDPEYAVTQLAQTTMRSELGKLSLDKVFRERESLNASIVDAINQAADCWGIRCLRYEIKDIHVPPRVKESMQMQVEAERRKRATVLESEGTRESAINVAEGKKQAQILASEAEKAEQINQAAGEASAVLAKAKAKAEAIRILAAALTQHNGDAAASLTVAEQYVSAFSQTGQGLQHYPTALQPWRCHQHGGSGHGCIWSPHQSPSARDSRLTLQWEQQRCPGYRCKS

SEQ ID NO: 838586 - protein, 346 aa, Homo sapiens
MLARAARGTGALLLRGSLLASGRAPRRASSGLPRNTVVLFVPQQEAWVVERMGRFHRILEPGLNILIPVLDRIRYVQSLKEIVINVPEQSAVTLDNVTLQIDGVLYLRIMDPYKASYGVEDPEYAVTQLAQTTMRSELGKLSLDKVFRERESLNASIVDAINQAADCWGIRCLRYEIKDIHVPPRVKESMQMQVEAERRKRATVLESEGTRESAINVAEGKKQAQILASEAEKAEQINQAAGEASAVLAKAKAKAEAIRILAAALTQHNGDAAASLTVAEQYVSAFSQTGQGLQHYPTALQPWRCHQHGGSGHGCIWSPHQSPSARDSRLTLQWEQQRCPGYRCKS

SEQ ID NO: 838587 - protein, 381 aa, Homo sapiens
YIRGSGTARGKARVGFWERPLRSSRWFRRSLRRWEMLARAARGTGALLLRGSLLASGRAPRRASSGLPRNTVVLFVPQQEAWVVERMGRFHRILEPGLNILIPVLDRIRYVQSLKEIVINVPEQSAVTLDNVTLQIDGVLYLRIMDPYKASYGVEDPEYAVTQLAQTTMRSELGKLSLDKVFRERESLNASIVDAINQAADCWGIRCLRYEIKDIHVPPRVKESMQMQVEAERRKRATVLESEGTRESAINVAEGKKQAQILASEAEKAEQINQAAGEASAVLAKAKAKAEAIRILAAALTQHNGDAAASLTVAEQYVSAFSQTGQGLQHYPTALQPWRCHQHGGSGHGCIWSPHQSPSARDSRLTLQWEQQRCPGYRCKS

SEQ ID NO: 838588 - protein, 465 aa, Homo sapiens
YIRGSGTARGKARVGFWERPLRSSRWFRRSLRRWEMLARAARGTGALLLRGSLLASGRAPRRASSGLPRNTVVLFVPQQEAWVVERMGRFHRILEPGLNILIPVLDRIRYVQSLKEIVINVPEQSAVTLDNVTLQIDGVLYLRIMDPYKASYGVEDPEYAVTQLAQTTMRSELGKLSLDKVFRERESLNASIVDAINQAADCWGIRCLRYEIKDIHVPPRVKESMQMQVEAERRKRATVLESEGTRESAINVAEGKKQAQILASEAEKAEQINQAAGEASAVLAKAKAKAEAIRILAAALTQHNGDAAASLTVAEQYVSAFSQTGQGLQHYPTALQPWRCHQHGGSGYELSEDPAQSTGARDQTETPPPSSTLTYHKGLQSALALDLPSFFVEMESKNETSPLSPANMEVLEIPFFGRYLCWYSESHFTLMVCKIPKINSRAYKTGLREGERKTNLLAPMPSFPV

SEQ ID NO: 838589 - protein, 295 aa, Homo sapiens
MGRFHRILEPGLNILIPVLDRIRYVQSLKEIVINVPEQSAVTLDNVTLQIDGVLYLRIMDPYKASYGVEDPEYAVTQLAQTTMRSELGKLSLDKVFRERESLNASIVDAINQAADCWGIRCLRYEIKDIHVPPRVKESMQMQVEAERRKRATVLESEGTRESAINVAEGKKQAQILASEAEKAEQINQAAGEASAVLAKAKAKAEAIRILAAALTQHNGDAAASLTVAEQYVSAFSQTGQGLQHYPTALQPWRCHQHGGSGHGCIWSPHQSPSARDSRLTLQWEQQRCPGYRCKS

SEQ ID NO: 838590 - protein, 340 aa, Homo sapiens
MGSAPLVSLVPEVAAAVGNGRASSGLPRNTVVLFVPQQEAWVVERMGRFHRILEPGLNILIPVLDRIRYVQSLKEIVINVPEQSAVTLDNVTLQIDGVLYLRIMDPYKASYGVEDPEYAVTQLAQTTMRSELGKLSLDKVFRERESLNASIVDAINQAADCWGIRCLRYEIKDIHVPPRVKESMQMQVEAERRKRATVLESEGTRESAINVAEGKKQAQILASEAEKAEQINQAAGEASAVLAKAKAKAEAIRILAAALTQHNGDAAASLTVAEQYVSAFSQTGQGLQHYPTALQPWRCHQHGGSGHGCIWSPHQSPSARDSRLTLQWEQQRCPGYRCKS

SEQ ID NO: 838591 - protein, 325 aa, Homo sapiens
YIRGSGTARGKARVGFWERPLRSSRWFRRSLRRWEMLARAARGTGALLLRGSLLASGRAPRRASSGLPRNTVVLFVPQQEAWVVERMGRFHRILEPGLNILIPVLDRIRYVQSLKEIVINVPEQSAVTLDNVTLQIDGVLYLRIMDPYKASYGVEDPEYAVTQLAQTTMRSELGKLSLDKVFRERESLNASIVDAINQAADCWGIRCLRYEIKDIHVPPRVKESMQMQVEAERRKRATVLESEGTRESAINVAEGKKQAQILASEAEKAEQINQAAGEASAVLAKAKAKAEAIRILAAALTQHVRGPWVGMGTGIDSGRGSLIYA

SEQ ID NO: 838592 - protein, 540 aa, Homo sapiens
SDLEITRPLPDYRDPLRSSRWFRRSLRRWEMLARAARGTGALLLRGSLLASGRAPRRASSGLPRNTVVLFVPQQEAWVVERMGRFHRILEPCEKPLLPTLGQPDDQSLTTCNVGRTSFGPARTVSSRLCRPDLTGPRLLTIIPMLPPFPMHLTGPILGNLPCPLSALPLSLHRDGYSAGSDSHDSPLHSGASLAFLFSWVFLPVTPQPSEDLFLGRSCCFSGHVPCVDSLHTPGLSLGPNPIVPSLLRTHDSSFQGLNILIPVLDRIRYVQSLKEIVINVPEQSAVTLDNVTLQIDGVLYLRIMDPYKASYGVEDPEYAVTQLAQTTMRSELGKLSLDKVFRERESLNASIVDAINQAADCWGIRCLRYEIKDIHVPPRVKESMQMQVEAERRKRATVLESEGTRESAINVAEGKKQAQILASEAEKAEQINQAAGEASAVLAKAKAKAEAIRILAAALTQHNGDAAASLTVAEQYVSAFSQTGQGLQHYPTALQPWRCHQHGGSGHGCIWSPHQSPSARDSRLTLQWEQQRCPGYRCKS

SEQ ID NO: 838593 - protein, 325 aa, Homo sapiens; identical to SEQ ID NO: 838591

SEQ ID NO: 838594 - protein, 157 aa, Homo sapiens
MQMQVEAERRKRATVLESEGTRESAINVAEGKKQAQILASEAEKAEQINQAAGEASAVLAKAKAKAEAIRILAAALTQHNGDAAASLTVAEQYVSAFSQTGQGLQHYPTALQPWRCHQHGGSGHGCIWSPHQSPSARDSRLTLQWEQQRCPGYRCKS

SEQ ID NO: 838595 - protein, 312 aa, Homo sapiens
MLARAARGTGALLLRGSLLASGRAPRRASSGLPRNTVVLFVPQQEAWVVERMGRFHRILEPGLNILIPVLDRIRYVQSLKEIVINVPEQSAVTLDNVTLQIDGVLYLRIMDPYKASYGVEDPEYAAINQAADCWGIRCLRYEIKDIHVPPRVKESMQMQVEAERRKRATVLESEGTRESAINVAEGKKQAQILASEAEKAEQINQAAGEASAVLAKAKAKAEAIRILAAALTQHNGDAAASLTVAEQYVSAFSQTGQGLQHYPTALQPWRCHQHGGSGHGCIWSPHQSPSARDSRLTLQWEQQRCPGYRCKS

SEQ ID NO: 838596 - protein, 361 aa, Homo sapiens
YIRGSGTARGKARVGFWERPLRSSRWFRRSLRRWEMLARAARGTGALLLRGSLLASGRAPRRASSGLPRNTVVLFVPQQEAWVVERMGRFHRILEPGLNILIPVLDRIRYVQSLKEIVINVPEQSAVTLDNVTLQIDGVLYLRIMDPYKASYGVEDPEYAVTQLAQTTMRSELGKLSLDKVFRERESLNASIVDAINQAADCWGIRCLRYEIKDIHVPPRVKESMQMQVEAERRKRATVLESEGTRESAINVAEGKKQAQILASEAEKAEQINQAAGEASAVLAKQVKLSIDLVSLTHYGMRVPDVPPMRRSNGRSISLPHWGPDVSAVFGPNQGGTIPGMSQLEANYRRRNLSPRLCPKC

SEQ ID NO: 838597 - protein, 234 aa, Homo sapiens
SDLEITRPLPDYRDPLRSSRWFRRSLRRWEMLARAARGTGALLLRGSLLASGRAPRRASSGLPRNTVVLFVPQQEAWVVERMGRFHRILEPGLNILIPVLDRIRYVQSLKEIVINVPEQSAVTLDNVTLQIDGVLYLRIMDPYKASYGVEDPEYAVTQLAQTTMRSELGKLSLDKVFRERESLNASIVDAMGVYGALTKAPVPGTPDSLSSGSSRDVQGTDASLDEELDRVKMS

SEQ ID NO: 838598 - protein, 320 aa, Homo sapiens
MGSAPLVSLVPEVAAAVGNGRASSGLPRNTVVLFVPQQEAWVVERMGRFHRILEPGLNILIPVLDRIRYVQSLKEIVINVPEQSAVTLDNVTLQIDGVLYLRIMDPYKASYGVEDPEYAVTQLAQTTMRSELGKLSLDKVFRERESLNASIVDAINQAADCWGIRCLRYEIKDIHVPPRVKESMQMQVEAERRKRATVLESEGTRESAINVAEGKKQAQILASEAEKAEQINQAAGEASAVLAKQVKLSIDLVSLTHYGMRVPDVPPMRRSNGRSISLPHWGPDVSAVFGPNQGGTIPGMSQLEANYRRRNLSPRLCPKC

SEQ ID NO: 838599 - protein, 183 aa, Homo sapiens
MLARAARGTGALLLRGSLLASGRAPRRASSGLPRNTVVLFVPQQEAWVVERMGRFHRILEPGLNILIPVLDRIRYVQSLKEIVINVPEQSAVTLDNVTLQIDGVLYLRIMDPYKASYGVEDPEYAVTQLAQTTMRSELGKLSLDKVFRVSRSEPELGFEDTNLTLLIFSEGQDQSQALLSVGP

SEQ ID NO: 838600 - protein, 189 aa, Homo sapiens
GRTLDVGVLINEFGYVTVIRYDFAKLESRTDPQGCRVEAERRKRATVLESEGTRESAINVAEGKKQAQILASEAEKAEQINQAAGEASAVLAKAKAKAEAIRILAAALTQHNGDAAASLTVAEQYVSAFSQTGQGLQHYPTALQPWRCHQHGGSGHGCIWSPHQSPSARDSRLTLQWEQQRCPGYRCKS

SEQ ID NO: 838601 - protein, 381 aa, Homo sapiens; identical to SEQ ID NO: 838587

SEQ ID NO: 838602 - protein, 346 aa, Homo sapiens; identical to SEQ ID NO: 838586

SEQ ID NO: 838603 - protein, 381 aa, Homo sapiens; identical to SEQ ID NO: 838587

SEQ ID NO: 838604 - protein, 344 aa, Homo sapiens
YIRGSGTARGKARGSLLASGRAPRRASSGLPRNTVVLFVPQQEAWVVERMGRFHRILEPGLNILIPVLDRIRYVQSLKEIVINVPEQSAVTLDNVTLQIDGVLYLRIMDPYKASYGVEDPEYAVTQLAQTTMRSELGKLSLDKVFRERESLNASIVDAINQAADCWGIRCLRYEIKDIHVPPRVKESMQMQVEAERRKRATVLESEGTRESAINVAEGKKQAQILASEAEKAEQINQAAGEASAVLAKAKAKAEAIRILAAALTQHNGDAAASLTVAEQYVSAFSQTGQGLQHYPTALQPWRCHQHGGSGHGCIWSPHQSPSARDSRLTLQWEQQRCPGYRCKS

SEQ ID NO: 838605 - protein, 325 aa, Homo sapiens; identical to SEQ ID NO: 838591

SEQ ID NO: 838606 - protein, 237 aa, Homo sapiens
MDPYKASYGVEDPEYAVTQLAQTTMRSELGKLSLDKVFRERESLNASIVDAINQAADCWGIRCLRYEIKDIHVPPRVKESMQMQVEAERRKRATVLESEGTRESAINVAEGKKQAQILASEAEKAEQINQAAGEASAVLAKAKAKAEAIRILAAALTQHNGDAAASLTVAEQYVSAFSQTGQGLQHYPTALQPWRCHQHGGSGHGCIWSPHQSPSARDSRLTLQWEQQRCPGYRCKS

SEQ ID NO: 838607 - protein, 300 aa, Homo sapiens
MLARAARGTGALLLRGLNILIPVLDRIRYVQSLKEIVINVPEQSAVTLDNVTLQIDGVLYLRIMDPYKASYGVEDPEYAVTQLAQTTMRSELGKLSLDKVFRERESLNASIVDAINQAADCWGIRCLRYEIKDIHVPPRVKESMQMQVEAERRKRATVLESEGTRESAINVAEGKKQAQILASEAEKAEQINQAAGEASAVLAKAKAKAEAIRILAAALTQHNGDAAASLTVAEQYVSAFSQTGQGLQHYPTALQPWRCHQHGGSGHGCIWSPHQSPSARDSRLTLQWEQQRCPGYRCKS

SEQ ID NO: 838608 - protein, 396 aa, Homo sapiens
MLARAARGTGALLLRGSLLASGRAPRRASSGLPRNTVVLFVPQQEAWVVERMGRFHRILEPGLNILIPVLDRIRYVQSLKEIVINVPEQSAVTLDNVTLQIDGVLYLRIMDPYKASYGVEDPEYAVTQLAQTTMRSELGKLSLDKVFRVSRSEPELGFEDTNLTLLIFSEGQDQSQALLSVRPLIGRLRLWGLHLFFQERESLNASIVDAINQAADCWGIRCLRYEIKDIHVPPRVKESMQMQVEAERRKRATVLESEGTRESAINVAEGKKQAQILASEAEKAEQINQAAGEASAVLAKAKAKAEAIRILAAALTQHNGDAAASLTVAEQYVSAFSQTGQGLQHYPTALQPWRCHQHGGSGHGCIWSPHQSPSARDSRLTLQWEQQRCPGYRCKS

SEQ ID NO: 838609 - protein, 174 aa, Homo sapiens
RRNPRNGMDAAPGERGLSKATVEAERRKRATVLESEGTRESAINVAEGKKQAQILASEAEKAEQINQAAGEASAVLAKAKAKAEAIRILAAALTQHNGDAAASLTVAEQYVSAFSQTGQGLQHYPTALQPWRCHQHGGSGHGCIWSPHQSPSARDSRLTLQWEQQRCPGYRCKS

SEQ ID NO: 838610 - protein, 143 aa, Homo sapiens
RRPRGRRGGGVSKEAEGKKQAQILASEAEKAEQINQAAGEASAVLAKAKAKAEAIRILAAALTQHNGDAAASLTVAEQYVSAFSQTGQGLQHYPTALQPWRCHQHGGSGHGCIWSPHQSPSARDSRLTLQWEQQRCPGYRCKS

SEQ ID NO: 838611 - protein, 190 aa, Homo sapiens
AQRKLRLVEPGVQSLRRWEMLARAARGTGALLLRGSLLASGRAPRRASSGLPRNTVVLFVPQQEAWVVERMGRFHRILEPGLNILIPVLDRIRYVQSLKEIVINVPEQSAVTLDNVTLQIDGVLYLRIMDPYKASYGVEDPEYAVTQLAQTTMRSELGKLSPDSLSSGSSRDVQGTDASLDEELDRVKMS

SEQ ID NO: 838612 - protein, 192 aa, Homo sapiens
AQRKLRLVEPGVQSLRRWEMLARAARGTGALLLRGSLLASGRAPRRASSGLPRNTVVLFVPQQEAWVVERMGRFHRILEPGLNILIPVLDRIRYVQSLKEIVINVPEQSAVTLDNVTLQIDGVLYLRIMDPYKASYGVEDPEYAVTQLAQTTMRSELGKLSKTNSLLGTKSPLFFPTPHGGQGHRRDHKIQN

SEQ ID NO: 838613 - protein, 387 aa, Homo sapiens
AQACYSLGNTYTLLQDYERAAEYHLRHLLIAQELADRVGEGRACWSLGNAYVSMGRPAQALTFAKKHLQISQEIGDRHGELTARMNVAQLQLVLGRLTSPAASEKPDLAGYEAQGARPKRTQRLSAETWDLLRLPLEREQNGDSHHSGDWRGPSRDSLPLPVRSRKYQEGPDAERRPREGSHSPLDSADVRVHVPRTSIPRAPSSDEECFFDLLTKFQSSRMDDQRCPLDDGQAGAAEATAAPTLEDRIAQPSMTASPQTEEFFDLIASSQSRRLDDQRASVGSLPGLRITHSNAGHLRGHGEPQEPGDDFFNMLIKYQSSRIDDQRCPPPDVLPRGPTMPDEDFFSLIQRVQAKRMDEQRVDLAGGPEQGAGGPPEPQQQCQPGAS

SEQ ID NO: 838614 - protein, 242 aa, Homo sapiens
DTSGGGVADRRQVRVPILARPQKCVWPGQAAPGLVWGSAGLALAAVTPLPPQSIPRAPSSDEECFFDLLTKFQSSRMDDQRCPLDDGQAGAAEATAAPTLEDRIAQPSMTASPQTEEFFDLIASSQSRRLDDQRASVGSLPGLRITHSNAGHLRGHGEPQEPGDDFFNMLIKYQSSRIDDQRCPPPDVLPRGPTMPDEDFFSLIQRVQAKRMDEQRVDLAGGPEQGAGGPPEPQQQCQPGAS

SEQ ID NO: 838615 - protein, 261 aa, Homo sapiens
CVGHGHRELMAGLTQGVVGTGTGGREASRDVWEVFQAKAGEAGPGQVTDRGLDWGSTHERGEVRGSRRVPRSIPRAPSSDEECFFDLLTKFQSSRMDDQRCPLDDGQAGAAEATAAPTLEDRIAQPSMTASPQTEEFFDLIASSQSRRLDDQRASVGSLPGLRITHSNAGHLRGHGEPQEPGDDFFNMLIKYQSSRIDDQRCPPPDVLPRGPTMPDEDFFSLIQRVQAKRMDEQRVDLAGGPEQGAGGPPEPQQQCQPGAS

SEQ ID NO: 838616 - protein, 387 aa, Homo sapiens; identical to SEQ ID NO: 838613

SEQ ID NO: 838617 - protein, 107 aa, Homo sapiens
GNLGNTLKVLGRFDEAAVLLQRHLSIAQEQGDKVGEARALYNIGKRDKGKQLSWNAANATQDRRHLPPDVRETLCKASEFYERNLLLEGQGRTREQGQVPEHRVSRT

SEQ ID NO: 838618 - protein, 233 aa, Homo sapiens
AGWYWSGSMDGRWWPGHLVYCLRSVWPSTQRGSLLLWRQPVIRSIPRAPSSDEECFFDLLTKFQSSRMDDQRCPLDDGQAGAAEATAAPTLEDRIAQPSMTASPQTEEFFDLIASSQSRRLDDQRASVGSLPGLRITHSNAGHLRGHGEPQEPGDDFFNMLIKYQSSRIDDQRCPPPDVLPRGPTMPDEDFFSLIQRVQAKRMDEQRVDLAGGPEQGAGGPPEPQQQCQPGAS

SEQ ID NO: 838619 - protein, 215 aa, Homo sapiens
QSEAGPRTNFLGGQGEAREQCTLASGTTAADQPRTTGAGGVRPPTALCPPSPPGSMTSAAHHLTYCPGALPCRTRTSSASFRGCRLSAWTSSGWTSPGARSRGQAARPSPSSSASLVRAKALCPPPGPPCPHSWTPVSQSQPRPPEAIAEDRHWACSPTASPTQGDRLRPSCPWWEGVLPSRAGPHGPQLPPFCPCRRPDGAFGMSAPTWCCQTP

SEQ ID NO: 838620 - protein, 181 aa, Homo sapiens
YSRLGHYSVPRLPEGLVPVSSPSGLAPRRRYARLEPQREPPVSGVGSGAGGRAGKAARDAGLSLLGLHSPRYLSRALTPGMVRRQLRVGVRRRGLGWAGSRPEGSTEDSSSESVCVCGPVLLSNGLCWRFEKSCLSSLLPQLRPFCSSSVLSEANPQKHSEVSLLPVAPRLLRTDFFVCLF

SEQ ID NO: 838621 - protein, 1029 aa, Homo sapiens
MTRENVAHNALRQEGLVKGKDDTWKWGTSFQGSSSSVWETSHLHFRQLRYHETSGPQEALSRLRELCRRWLRPEARTKAQILELLVLEQFLSILPGEIRTWVQLHHPGSGEEAVALVEELQKDLDGPAIQVPVLVKDQDTLQKVVSAPGTTLPPVLPGSHIAAEICPHPPTDLVAFNLQDPQHDSPAPEASALSQEENPRNQLMALMLLTAQPQELVMFEEVSVCFTSEEWACLGPIQRALYWDVMLENYGNVTSLEWETMTENEEVTSKPSSSQRADSHKGTSKRLQGSVPQVLDFEEECEWQVLASQWGNETDERADTVKKVSLCERDKKKRTPPEKQGQKWKELGDSLTFGSAISESLIGTEGKKFYKCDMCCKHFNKISHLINHRRIHTGEKPHKCKECGKGFIQRSSLLMHLRNHSGEKPYKCNECGKAFSQSAYLLNHQRIHTGEKPYKCKECGKGFYRHSGLIIHLRRHSGERPYKCNECGKVFSQNAYLIDHQRLHKGEEPYKCNKCQKAFILKKSLILHQRIHSGEKPYKCDECGKTFAQTTYLIDHQRLHSAENPYKCKECGKVFIRSKSLLLHQRVHTEKKTFGCKKCGKIFSSKSNFIDHKRMHSREKPYKCTECGKAFTQSAYLFDHQRLHNGEKPYECNECGKVFILKKSLILHQRFHTGENLYECKDCGKVFGSNRNLIDHERLHNGEKPYECRECGKTFIMSKSFMVHQKLHTQEKAYKCEDCGKAFSYNSSLLVHRRIHTGEKPFECSECGRAFSSNRNLIEHKRIHSGEKPYECDECGKCFILKKSLIGHQRIHTREKSYKCNDCGKVFSYRSNLIAHQRIHTGEKPYACSECGKGFTYNRNLIEHQRIHSGEKTYECHVCRKVLTSSRNLMVHQRIHTGEKPYKCNECGKDFSQNKNLVVHQRMHTGEKPYECDKCRKSFTSKRNLVGHQRIHTGEKPYGCNDCSKVFRQRKNLTVHQKIHTDEKPCECDVSEKEFSQTSNLHLQQKIHTIEEFSWLQNTNESKIEIQKI

SEQ ID NO: 838622 - protein, 1073 aa, Homo sapiens
MTRENVAHNALRQEGLVKGKDDTWKWGTSFQGSSSSVWETSHLHFRQLRYHETSGPQEALSRLRELCRRWLRPEARTKAQILELLVLEQFLSILPGEIRTWVQLHHPGSGEEAVALVEELQKDLDGPAIQVWLLFPPLCTVSSGRGHQCHEWGSRAAPLFSMQSFTAVLMLHTEVPVLVKDQDTLQKVVSAPGTTLPPVLPGSHIAAEICPHPPTDLVAFNLQDPQHDSPAPEASALSQEENPRNQLMALMLLTAQPQELVMFEEVSVCFTSEEWACLGPIQRALYWDVMLENYGNVTSLEWETMTENEEVTSKPSSSQRADSHKGTSKRLQGSVPQVLDFEEECEWQVLASQWGNETDERADTVKKVSLCERDKKKRTPPEKQGQKWKELGDSLTFGSAISESLIGTEGKKFYKCDMCCKHFNKISHLINHRRIHTGEKPHKCKECGKGFIQRSSLLMHLRNHSGEKPYKCNECGKAFSQSAYLLNHQRIHTGEKPYKCKECGKGFYRHSGLIIHLRRHSGERPYKCNECGKVFSQNAYLIDHQRLHKGEEPYKCNKCQKAFILKKSLILHQRIHSGEKPYKCDECGKTFAQTTYLIDHQRLHSAENPYKCKECGKVFIRSKSLLLHQRVHTEKKTFGCKKCGKIFSSKSNFIDHKRMHSREKPYKCTECGKAFTQSAYLFDHQRLHNGEKPYECNECGKVFILKKSLILHQRFHTGENLYECKDCGKVFGSNRNLIDHERLHNGEKPYECRECGKTFIMSKSFMVHQKLHTQEKAYKCEDCGKAFSYNSSLLVHRRIHTGEKPFECSECGRAFSSNRNLIEHKRIHSGEKPYECDECGKCFILKKSLIGHQRIHTREKSYKCNDCGKVFSYRSNLIAHQRIHTGEKPYACSECGKGFTYNRNLIEHQRIHSGEKTYECHVCRKVLTSSRNLMVHQRIHTGEKPYKCNECGKDFSQNKNLVVHQRMHTGEKPYECDKCRKSFTSKRNLVGHQRIHTGEKPYGCNDCSKVFRQRKNLTVHQKIHTDEKPCECDVSEKEFSQTSNLHLQQKIHTIEEFSWLQNTNESKIEIQKI

SEQ ID NO: 838623 - protein, 1120 aa, Homo sapiens
ISINGLMLLTAQPQDLVMFEEVSVCFTSEEWACLGPILRALYWDVMLENYGNVTSLEWETMTENEEVTSKPSSSQRAFSHKGDIKKTSHLHFRQLRYHETSGPQEALSRLRELCRRWLRPEARTKAQILELLVLEQFLSILPGEIRTWVQLHHPGSGEEAVALVEELQKDLDGPAIQVWLLFPPLCTVSSGRGHQCHEWGSRAAPLFSMQSFTAVLMLHTEVPVLVKDQDTLQKVVSAPGTTLPPVLPGSHIAAEICPHPPTDLVAFNLQDPQHDSPAPEASALSQEENPRNQLMALMLLTAQPQELVMFEEVSVCFTSEEWACLGPIQRALYWDVMLENYGNVTSLEWETMTENEEVTSKPSSSQRADSHKGTSKRLQGSVPQVLDFEEECEWQVLASQWGNETDERADTVKKVSLCERDKKKRTPPEKQGQKWKELGDSLTFGSAISESLIGTEGKKFYKCDMCCKHFNKISHLINHRRIHTGEKPHKCKECGKGFIQRSSLLMHLRNHSGEKPYKCNECGKAFSQSAYLLNHQRIHTGEKPYKCKECGKGFYRHSGLIIHLRRHSGERPYKCNECGKVFSQNAYLIDHQRLHKGEEPYKCNKCQKAFILKKSLILHQRIHSGEKPYKCDECGKTFAQTTYLIDHQRLHSAENPYKCKECGKVFIRSKSLLLHQRVHTEKKTFGCKKCGKIFSSKSNFIDHKRMHSREKPYKCTECGKAFTQSAYLFDHQRLHNGEKPYECNECGKVFILKKSLILHQRFHTGENLYECKDCGKVFGSNRNLIDHERLHNGEKPYECRECGKTFIMSKSFMVHQKLHTQEKAYKCEDCGKAFSYNSSLLVHRRIHTGEKPFECSECGRAFSSNRNLIEHKRIHSGEKPYECDECGKCFILKKSLIGHQRIHTREKSYKCNDCGKVFSYRSNLIAHQRIHTGEKPYACSECGKGFTYNRNLIEHQRIHSGEKTYECHVCRKVLTSSRNLMVHQRIHTGEKPYKCNECGKDFSQNKNLVVHQRMHTGEKPYECDKCRKSFTSKRNLVGHQRIHTGEKPYGCNDCSKVFRQRKNLTVHQKIHTDEKPCECDVSEKEFSQTSNLHLQQKIHTIEEFSWLQNTNESKIEIQKI

SEQ ID NO: 838624 - protein, 835 aa, Homo sapiens
MTRENVAHNALRQEGLVKGKDDTWKWGTSFQGSSSSVWETSHLHFRQLRYHETSGPQEALSRLRELCRRWLRPEARTKAQILELLVLEQFLSILPGEIRTWVQLHHPGSGEEAVALVEELQKDLDGPAIQVPVLVKDQDTLQKVVSAPGTTLPPVLPGSHIAAEICPHPPTDLVAFNLQDPQHDSPAPEASALSQEENPRNQLMALMLLTAQPQELVMFEEVSVCFTSEEWACLGPIQRALYWDVMLENYGNVTSLEWETMTENEEVTSKPSSSQRADSHKGTSKRLQGSVPQVLDFEEECEWQVLASQWGNETDERADTVKKVSLCERDKKKRTPPEKQGQKWKELGDSLTFGSAISESLIGTEGKKFYKCDMCCKHFNKISHLINHRRIHTGEKPHKCKECGKGFIQRSSLLMHLRNHSGEKPYKCNECGKAFSQSAYLLNHQRIHTGEKPYKCKECGKGFYRHSGLIIHLRRHSGERPYKCNECGKVFSQNAYLIDHQRLHKGEEPYKCNKCQKAFILKKSLILHQRIHSGEKPYKCDECGKTFAQTTYLIDHQRLHSAENPYKCKECGKVFIRSKSLLLHQRVHTEKKTFGCKKCGKIFSSKSNFIDHKRMHSREKPYKCTECGKAFTQSAYLFDHQRLHNGEKPYECNECGKVFILKKSLILHQRFHTGENLYECKDCGKVFGSNRNLIDHERLHNGEKPYECRECGKTFIMSKSFMVHQKLHTQEKAYKCEDCGKAFSYNSSLLVHRRIHTGEKPFECSECGRAFSSNRNLIEHKRIHSGEKPYECDECGKCFILKKSLIGHQRIHTGNLYACLELSTVTNAKTTVEHA

SEQ ID NO: 838625 - protein, 267 aa, Homo sapiens
MTRENVAHNALRQEGLVKGKDDTWKWGTSFQGSSSSVWETSHLHFRQLRYHETSGPQEALSRLRELCRRWLRPEARTKAQILELLVLEQFLSILPGEIRTWVQLHHPGSGEEAVALVEELQKDLDGPAIQVPVLVKDQDTLQKVVSAPGTTLPPVLPGSHIAAEICPHPPTDLVAFNLQDPQHDSPAPEASALSQEENPRNQLMALMLLTAQPQELVMFEEVSVCFTSEEWACLGPIQRALYWDVMLENYGNVTSLGYRKYRRQRNK

SEQ ID NO: 838626 - protein, 267 aa, Homo sapiens; identical to SEQ ID NO: 838625

SEQ ID NO: 838627 - protein, 284 aa, Homo sapiens
IVHKILLEEEFPTYMTYVGLFSTVSISSNRNLIEHKRIHSGEKPYECDECGKCFILKKSLIGHQRIHTREKSYKCNDCGKVFSYRSNLIAHQRIHTGEKPYACSECGKGFTYNRNLIEHQRIHSGEKTYECHVCRKVLTSSRNLMVHQRIHTGEKPYKCNECGKDFSQNKNLVVHQRMHTGEKPYECDKCRKSFTSKRNLVGHQRIHTGEKPYGCNDCSKVFRQRKNLTVHQKIHTDEKPCECDVSEKEFSQTSNLHLQQKIHTIEEFSWLQNTNESKIEIQKI

SEQ ID NO: 838628 - protein, 1029 aa, Homo sapiens; identical to SEQ ID NO: 838621

SEQ ID NO: 838629 - protein, 812 aa, Homo sapiens
MFEEVSVCFTSEEWACLGPIQRALYWDVMLENYGNVTSLEWETMTENEEVTSKPSSSQRADSHKGTSKRLQGSVPQVLDFEEECEWQVLASQWGNETDERADTVKKVSLCERDKKKRTPPEKQGQKWKELGDSLTFGSAISESLIGTEGKKFYKCDMCCKHFNKISHLINHRRIHTGEKPHKCKECGKGFIQRSSLLMHLRNHSGEKPYKCNECGKAFSQSAYLLNHQRIHTGEKPYKCKECGKGFYRHSGLIIHLRRHSGERPYKCNECGKVFSQNAYLIDHQRLHKGEEPYKCNKCQKAFILKKSLILHQRIHSGEKPYKCDECGKTFAQTTYLIDHQRLHSAENPYKCKECGKVFIRSKSLLLHQRVHTEKKTFGCKKCGKIFSSKSNFIDHKRMHSREKPYKCTECGKAFTQSAYLFDHQRLHNGEKPYECNECGKVFILKKSLILHQRFHTGENLYECKDCGKVFGSNRNLIDHERLHNGEKPYECRECGKTFIMSKSFMVHQKLHTQEKAYKCEDCGKAFSYNSSLLVHRRIHTGEKPFECSECGRAFSSNRNLIEHKRIHSGEKPYECDECGKCFILKKSLIGHQRIHTREKSYKCNDCGKVFSYRSNLIAHQRIHTGEKPYACSECGKGFTYNRNLIEHQRIHSGEKTYECHVCRKVLTSSRNLMVHQRIHTGEKPYKCNECGKDFSQNKNLVVHQRMHTGEKPYECDKCRKSFTSKRNLVGHQRIHTGEKPYGCNDCSKVFRQRKNLTVHQKIHTDEKPCECDVSEKEFSQTSNLHLQQKIHTIEEFSWLQNTNESKIEIQKI

SEQ ID NO: 838630 - protein, 790 aa, Homo sapiens
MTRENVAHNALRQEGLVKGKDDTWKWGTSFQGSSSSVWETSHLHFRQLRYHETSGPQEALSRLRELCRRWLRPEARTKAQILELLVLEQFLSILPGEIRTWVQLHHPGSGEEAVALVEELQKDLDGPAIQVPVLVKDQDTLQKVVSAPGTTLPPVLPGSHIAAEICPHPPTDLVAFNLQDPQHDSPAPEASALSQEENPRNQLMALMLLTAQPQELVMFEEVSVCFTSEEWACLGPIQRALYWDVMLENYGNVTSLEWETMTENEEVTSKPSSSQRADSHKGTSKRLQGSVPQVLDFEEECEWQVLASQWGNETDERADTVKKVSLCERDKKKRTPPEKQGQKWKELGDSLTFGSAISESLIGTEGKKFYKCDMCCKHFNKISHLINHRRIHTGEKPHKCKECGKGFIQRSSLLMHLRNHSGEKPYKCNECGKAFSQSAYLLNHQRIHTGEKPYKCKECGKGFYRHSGLIIHLRRHSGERPYKCNECGKVFSQNAYLIDHQRLHKGEEPYKCNKCQKAFILKKSLILHQRIHSGEKPYKCDECGKTFAQTTYLIDHQRLHSAENPYKCKECGKVFIRSKSLLLHQRVHTEKKTFGCKKCGKIFSSKSNFIDHKRMHSREKPYKCTECGKAFTQSAYLFDHQRLHNGEKPYECNECGKVFILKKSLILHQRFHTGENLYECKDCGKVFGSNRNLIDHERLHNGEKPYECRECGKTFIMSKSFMVHQKLHTQEKAYKCEDCGKAFSYNSSLLVHRRIHTGEKPFECSECGRAWTLFTEDTSRPIPERPYDHR

SEQ ID NO: 838631 - protein, 150 aa, Homo sapiens
VPVLVKDQDTLQKVVSAPGTTLPPVLPGSHIAAEICPHPPTDLVAFNLQDPQHGIYSVLWVLGCSRTLPVAHPPTSRELLPLLPCLGVSYSANFFLLFCCSLLLSWAPLSLYTSPLFFFETESRSVAQAGVQWRDLSSLQPPPPGFTPFS

SEQ ID NO: 838632 - protein, 669 aa, Homo sapiens
MEKKKIVLEQEVKTLNDSLKKVENKVSAIVDEKENVIKEVEGKRALLEIKEREHNQLVKLLELARENEATSLTERGILDLNLRNSLIDKQNYHDELSRKQREKERDFRNLRKMELLLKVSWDALRQTQALHQRLLLEKIISEMESKLVEQQLAEENKLLKEQENMKELVVNLLRMTQIKIDEKEQKSKDFLKAQQKYTNIVKEMKAKDLEIRIHKKKKCEIYRRLREFAKLYDTIRNERNKFVNLLHKAHQKVNEIKERHKMSLNELEILRNSAVSQERKLQNSMLKHANNVTIRESMQNDVRKIVSKLQEMKEKKEAQLNNIDRLANTITMIEEEMVQLRKRYEKAVQHRNESGVQLIEREEEICIFYEKINIQEKMKLNGEIEIHLLEEKIQFLKMKIAEKQRQICVTQKLLPAKRSLDADLAVLQIQFSQCTDRIKDLEKQFVKPDGENRARFLPGKDLTEKEMIQKLDKLELQLAKKEEKLLEKDFIYEQVSRLTDRLCSKTQGCKQDTLLLAKKMNGYQRRIKNATEKMMALVAELSMKQALTIELQKEVREKEDFIFTCNSRIEKGLPLNKEIEKEWLKVLRDEEMHALAIAEKSQEFLEADNRQLPNGVYTTAEQRPNAYIPEADATLPLPKPYGALAPFKPSEPGANMRHIRKPVIKPVEI

SEQ ID NO: 838633 - protein, 701 aa, Homo sapiens [sequence omitted]

SEQ ID NO: 838634 - protein, 510 aa, Homo sapiens
MEKKKIVLEQEVKTLNDSLKKVENKVSAIVDEKENVIKEVEGKRALLEIKEREHNQLVKLLELARENEATSLTERGILDLNLRNSLIDKQNYHDELSRKQREKERDFRNLRKMELLLKVSWDALRQTQALHQRLLLEMEAIPKDDSTLSERRRELHKEVEVAKRNLAQQKIISEMESKLVEQQLAEENKLLKEQENMKELVVNLLRMTQIKIDEKEQKSKDFLKAQQKYTNIVKEMKAKDLEIRIHKKKKCEIYRRLREFAKLYDTIRNERNKFVNLLHKAHQKVNEIKERHKMSLNELEILRNSAVSQERKLQNSMLKHANNVTIRESMQNDVRKIVSKLQEMKEKKEAQLNNIDRLANTITMIEEEMVQLRKRYEKAVQHRNESGVQLIEREEEICIFYEKINIQEKMKLNGEIEIHLLEEKIQFLKMKIAEKQRQICVTQKLLPAKRSLDADLAVLQIQFSQCTDRIKDLEKQFVKPDGENRARFLPGKDLTEKEMIQKLDKVNIIA

SEQ ID NO: 838635 - protein, 741 aa, Homo sapiens
GNSKEIVGDIFVLKDEVAHHQTIPVQIGKEIEKITRKKVEMEKKKIVLEQEVKTLNDSLKKVENKVSAIVDEKENVIKEVEGKRALLEIKEREHNQLVKLLELARENEATSLTERGILDLNLRNSLIDKQNYHDELSRKQREKERDFRNLRKMELLLKVSWDALRQTQALHQRLLLEMEAIPKDDSTLSERRRELHKEVEVAKRNLAQQKIISEMESKLVEQQLAEENKLLKEQENMKELVVNLLRMTQIKIDEKEQKSKDFLKAQQKYTNIVKEMKAKDLEIRIHKKKKCEIYRRLREFAKLYDTIRNERNKFVNLLHKAHQKVNEIKERHKMSLNELEILRNSAVSQERKLQNSMLKHANNVTIRESMQNDVRKIVSKLQEMKEKKEAQLNNIDRLANTITMIEEEMVQLRKRYEKAVQHRNESGVQLIEREEEICIFYEKINIQEKMKLNGEIEIHLLEEKIQFLKMKIAEKQRQICVTQKLLPAKRSLDADLAVLQIQFSQCTDRIKDLEKQFVKPDGENRARFLPGKDLTEKEMIQKLDKLELQLAKKEEKLLEKDFIYEQVSRLTDRLCSKTQGCKQDTLLLAKKMNGYQRRIKNATEKMMALVAELSMKQALTIELQKEVREKEDFIFTCNSRIEKGLPLNKEIEKEWLKVLRDEEMHALAIAEKSQEFLEADNRQLPNGVYTTAEQRPNAYIPEADATLPLPKPYGALAPFKPSEPGANMRHIRKPVIKPVEI

SEQ ID NO: 838636 - protein, 292 aa, Homo sapiens
MKLNGEIEIHLLEEKIQFLKMKIAEKQRQICVTQKLLPAKRSLDADLAVLQIQFSQCTDRIKDLEKQFVKPDGENRARFLPGKDLTEKEMIQKLDKLELQLAKKEEKLLEKDFIYEQVSRLTDRLCSKTQGCKQDTLLLAKKMNGYQRRIKNATEKMMALVAELSMKQALTIELQKEVREKEDFIFTCNSRIEKGLPLNKEIEKEWLKVLRDEEMHALAIAEKSQEFLEADNRQLPNGVYTTAEQRPNAYIPEADATLPLPKPYGALAPFKPSEPGANMRHIRKPVIKPVEI

SEQ ID NO: 838637 - protein, 197 aa, Homo sapiens
MLELQLAKKEEKLLEKDFIYEQVSRLTDRLCSKTQGCKQDTLLLAKKMNGYQRRIKNATEKMMALVAELSMKQALTIELQKEVREKEDFIFTCNSRIEKGLPLNKEIEKEWLKVLRDEEMHALAIAEKSQEFLEADNRQLPNGVYTTAEQRPNAYIPEADATLPLPKPYGALAPFKPSEPGANMRHIRKPVIKPVEI

SEQ ID NO: 838638 - protein, 472 aa, Homo sapiens
PSMGKLHSKPAAVCKRRESPEGDSFAVSAAWARKGIEEWIGRQRCPGGVSGPRQLRLAGTIGRSTRELVGDVLRDTLSEEEEDDFRLEVALPPEKTDGLGSGDEKKMERVSEPCPGSKKQLKFEELQCDVSMEEDSRQEWTFTLYDFDNNGKVTREDITSLLHTIYEVVDSSVNHSPTSSKMLRVKLTVAPDGSQSKRSVLVNQADLQSARPRAETKPTEDLRSWEKKQRAPLRFQGDSRLEQSGCYHHCVDENIERRNHYLDLAGIENYTSQFGPGSPSVAQKSELPPRTSNPTRSRSHEPEAIHIPHRKPQGVDPASFHFLDTPIAKVSELQQRLRGTQDGSKHFVRSPKAQGKSVGVGHVARGARNKPPLGPAIPAVSPSAHLAASPALLPSLAPLGHKKHKHRAKESQQGCRGLQAPLASGGPVLGREHLRELPALVVYESQAGQPVQRHEHHHHHEHHHHYHHFYQT

SEQ ID NO: 838639 - protein, 472 aa, Homo sapiens; identical to SEQ ID NO: 838638

SEQ ID NO: 838640 - protein, 434 aa, Homo sapiens
SFVFEDPQTTRHPCRHPSPGQTSPARALAALLGQFCLGQSAPCPLKVWGGQRTGGRPLAWPLGPGFHYPVSVATDRGPAPPISCIQELQCDVSMEEDSRQEWTFTLYDFDNNGKVTREDITSLLHTIYEVVDSSVNHSPTSSKMLRVKLTVAPDGSQSKRSVLVNQADLQSARPRAETKPTEDLRSWEKKQRAPLRFQGDSRLEQSGCYHHCVDENIERRNHYLDLAGIENYTSQFGPGSPSVAQKSELPPRTSNPTRSRSHEPEAIHIPHRKPQGVDPASFHFLDTPIAKVSELQQRLRGTQDGSKHFVRSPKAQGKSVGVGHVARGARNKPPLGPAIPAVSPSAHLAASPALLPSLAPLGHKKHKHRAKESQQGCRGLQAPLASGGPVLGREHLRELPALVVYESQAGQPVQRHEHHHHHEHHHHYHHFYQT

SEQ ID NO: 838641 - protein, 472 aa, Homo sapiens; identical to SEQ ID NO: 838638

SEQ ID NO: 838642 - protein, 148 aa, Homo sapiens
MSSDFPHYNFRMPNIGFQNLPLNIYIVVFGTAIFVFILSLLFCCYLIRLRHQAHKEFYAYKQVILKEKVKELNLHELCAVCLEDFKPRDELGICPCKHAFHRKCLIKWLEVRKVCPLCNMPVLQLAQLHSKQDRGPPQGPLPGAENIV

SEQ ID NO: 838643 - protein, 169 aa, Homo sapiens
MLNKSGESRYPALFPVLGGSSMSSDFPHYNFRMPNIGFQNLPLNIYIVVFGTAIFVFILSLLFCCYLIRLRHQAHKEFYAYKQVILKEKVKELNLHELCAVCLEDFKPRDELGICPCKHAFHRKCLIKWLEVRKVCPLCNMPVLQLAQLHSKQDRGPPQGPLPGAENIV

SEQ ID NO: 838644 - protein, 148 aa, Homo sapiens; identical to SEQ ID NO: 838642

SEQ ID NO: 838645 - protein, 166 aa, Homo sapiens
SLRPPVWWNSLEIAEDSSMSSDFPHYNFRMPNIGFQNLPLNIYIVVFGTAIFVFILSLLFCCYLIRLRHQAHKEFYAYKQVILKEKVKELNLHELCAVCLEDFKPRDELGICPCKHAFHRKCLIKWLEVRKVCPLCNMPVLQLAQLHSKQDRGPPQGPLPGAENIV

SEQ ID NO: 838646 - protein, 175 aa, Homo sapiens
GRRPRAGVWGTEPLRVRDAEETAGPRQPPTHTHSPGASAGRARCAGVRRCLQAEEGRGGGSGAAPGLEGESLTKGGAGLSPGDHGGKVRGPPHVLLAQALASGPRAWEAAGMSWEARRRMARTLPPRWRWARALGGAAWQCFPGPRPLLPFLCGACLVPRCHSVHGSGRGGDLFP

SEQ ID NO: 838647 - protein, 197 aa, Homo sapiens
MNGKNINTLSTIFVSDEVIVPLYVHNDNAVLVLSLYLFFFHSFLPPHSSMSSDFPHYNFRMPNIGFQNLPLNIYIVVFGTAIFVFILSLLFCCYLIRLRHQAHKEFYAYKQVILKEKVKELNLHELCAVCLEDFKPRDELGICPCKHAFHRKCLIKWLEVRKVCPLCNMPVLQLAQLHSKQDRGPPQGPLPGAENIV

SEQ ID NO: 838648 - protein, 116 aa, Homo sapiens
PCGRQCGGIPWISRRELRHQAHKEFYAYKQVILKEKVKELNLHELCAVCLEDFKPRDELGICPCKHAFHRKCLIKWLEVRKVCPLCNMPVLQLAQLHSKQDRGPPQGPLPGAENIV

SEQ ID NO: 838649 - protein, 220 aa, Homo sapiens
MIAELVSSALGLALYLNTLSADFCYDDSRAIKTNQDLLPETPWTHIFYNDFWGTLLTHSGSHKSYRPLCTLSFRLNHAIGGLNPWSYHLVNVLLHAAVTGLFTSFSKILLGDGYWTFMAGLMFASHPIHTEAVAGIVGRADVGASLFFLLSLLCYIKHCSTRGYSARTWGWFLGSGLCAGCSMLWKEQGVTVLAVSAVYDVFVFHRLKIKQILPTIYKVS

SEQ ID NO: 838650 - protein, 223 aa, Homo sapiens
DSRAIIIAEIRTQVLRYKASPSSADFCYDDSRAIKTNQDLLPETPWTHIFYNDFWGTLLTHSGSHKSYRPLCTLSFRLNHAIGGLNPWSYHLVNVLLHAAVTGLFTSFSKILLGDGYWTFMAGLMFASHPIHTEAVAGIVGRADVGASLFFLLSLLCYIKHCSTRGYSARTWGWFLGSGLCAGCSMLWKEQGVTVLAVSAVYDVFVFHRLKIKQILPTIYKVS

SEQ ID NO: 838651 - protein, 595 aa, Homo sapiens
MAGAIASRMSFSSLKRKQPKTFTVRIVTMDAEMEFNCEMKWKGKDLFDLVCRTLGLRETWFFGLQYTIKDTVAWLKMDKKVLDHDVSKEEPVTFHFLAKFYPENAEEELVQEITQHLFFLQVKKQILDEKIYCPPEASVLLASYAVQAKYGDYDPSVHKRGFLAQEELLPKRVINLYQMTPEMWEERITAWYAEHRGRARDEAEMEYLKIAQDLEMYGVNYFAIRNKKGTELLLGVDALGLHIYDPENRLTPKISFPWNEIRNISYSDKEFTIKPLDKKIDVFKFNSSKLRVNKLILQLCIGNHDLFMRRRKADSLEVQQMKAQAREEKARKQMERQRLAREKQMREEAERTRDELERRLLQMKEEATMANEALMRSEETADLLAEKAQITEEEAKLLAQKAAEAEQEMQRIKATAIRTEEEKRLMEQKVLEAEVLALKMAEESERRAKEADQLKQDLQEAREAERRAKQKLLEIATKPTYPPMNPIPAPLPPDIPSFNLIGDSLSFDFKDTDMKRLSMEIEKEKVEYMEKSKHLQEQLNELKTEIEALKLKERETALDILHNENSDRGGSSKHNTIKKLTLQSAKSRVAFFEEL

SEQ ID NO: 838652 - protein, 590 aa, Homo sapiens
MAGAIASRMSFSSLKRKQPKTFTVRIVTMDAEMEFNCEMKWKGKDLFDLVCRTLGLRETWFFGLQYTIKDTVAWLKMDKKVLDHDVSKEEPVTFHFLAKFYPENAEEELVQEITQHLFFLQVKKQILDEKIYCPPEASVLLASYAVQAKYGDYDPSVHKRGFLAQEELLPKRVINLYQMTPEMWEERITAWYAEHRGRARDEAEMEYLKIAQDLEMYGVNYFAIRNKKGTELLLGVDALGLHIYDPENRLTPKISFPWNEIRNISYSDKEFTIKPLDKKIDVFKFNSSKLRVNKLILQLCIGNHDLFMRRRKADSLEVQQMKAQAREEKARKQMERQRLAREKQMREEAERTRDELERRLLQMKEEATMANEALMRSEETADLLAEKAQITEEEAKLLAQKAAEAEQEMQRIKATAIRTEEEKRLMEQKVLEAEVLALKMAEESERRAKEADQLKQDLQEAREAERRAKQKLLEIATKPTYPPMNPIPAPLPPDIPSFNLIGDSLSFDFKDTDMKRLSMEIEKEKVEYMEKSKHLQEQLNELKTEIEALKLKERETALDILHNENSDRGGSSKHNTIKKPQAQGRRPICI

SEQ ID NO: 838653 - protein, 595 aa, Homo sapiens; identical to SEQ ID NO: 838651

SEQ ID NO: 838654 - protein, 595 aa, Homo sapiens; identical to SEQ ID NO: 838651

SEQ ID NO: 838655 - protein, 598 aa, Homo sapiens
MAGAIASRMSFSSLKRKQPKTFTVRIVTMDAEMEFNCEMKWKGKDLFDLVCRTLGLRETWFFGLQYTIKDTVAWLKMDKKVGLELMKLVLDHDVSKEEPVTFHFLAKFYPENAEEELVQEITQHLFFLQVKKQILDEKIYCPPEASVLLASYAVQAKYGDYDPSVHKRGFLAQEELLPKRVINLYQMTPEMWEERITAWYAEHRGRARDEAEMEYLKIAQDLEMYGVNYFAIRNKKGTELLLGVDALGLHIYDPENRLTPKISFPWNEIRNISYSDKEFTIKPLDKKIDVFKFNSSKLRVNKLILQLCIGNHDLFMRRRKADSLEVQQMKAQAREEKARKQMERQRLAREKQMREEAERTRDELERRLLQMKEEATMANEALMRSEETADLLAEKAQITEEEAKLLAQKAAEAEQEMQRIKATAIRTEEEKRLMEQKVLEAEVLALKMAEESERRAKEADQLKQDLQEAREAERRAKQKLLEIATKPTYPPMNPIPAPLPPDIPSFNLIGDSLSFDFKDTDMKRLSMEIEKEKVEYMEKSKHLQEQLNELKTEIEALKLKERETALDILHNENSDRGGSSKHNTIKKPQAQGRRPICI

SEQ ID NO: 838656 - protein, 548 aa, Homo sapiens
MAGAIASRMSFSSLKRKQPKTFTVRIVTMDAEMEFNCEVLDHDVSKEEPVTFHFLAKFYPENAEEELVQEITQHLFFLQVKKQILDEKIYCPPEASVLLASYAVQAKYGDYDPSVHKRGFLAQEELLPKRVINLYQMTPEMWEERITAWYAEHRGRARDEAEMEYLKIAQDLEMYGVNYFAIRNKKGTELLLGVDALGLHIYDPENRLTPKISFPWNEIRNISYSDKEFTIKPLDKKIDVFKFNSSKLRVNKLILQLCIGNHDLFMRRRKADSLEVQQMKAQAREEKARKQMERQRLAREKQMREEAERTRDELERRLLQMKEEATMANEALMRSEETADLLAEKAQITEEEAKLLAQKAAEAEQEMQRIKATAIRTEEEKRLMEQKVLEAEVLALKMAEESERRAKEADQLKQDLQEAREAERRAKQKLLEIATKPTYPPMNPIPAPLPPDIPSFNLIGDSLSFDFKDTDMKRLSMEIEKEKVEYMEKSKHLQEQLNELKTEIEALKLKERETALDILHNENSDRGGSSKHNTIKKPQAQGRRPICI

SEQ ID NO: 838657 - protein, 507 aa, Homo sapiens
MAGAIASRMSFSSLKRKQPKTFTVRIVTMDAEMEFNCEVKKQILDEKIYCPPEASVLLASYAVQAKYGDYDPSVHKRGFLAQEELLPKRVINLYQMTPEMWEERITAWYAEHRGRARDEAEMEYLKIAQDLEMYGVNYFAIRNKKGTELLLGVDALGLHIYDPENRLTPKISFPWNEIRNISYSDKEFTIKPLDKKIDVFKFNSSKLRVNKLILQLCIGNHDLFMRRRKADSLEVQQMKAQAREEKARKQMERQRLAREKQMREEAERTRDELERRLLQMKEEATMANEALMRSEETADLLAEKAQITEEEAKLLAQKAAEAEQEMQRIKATAIRTEEEKRLMEQKVLEAEVLALKMAEESERRAKEADQLKQDLQEAREAERRAKQKLLEIATKPTYPPMNPIPAPLPPDIPSFNLIGDSLSFDFKDTDMKRLSMEIEKEKVEYMEKSKHLQEQLNELKTEIEALKLKERETALDILHNENSDRGGSSKHNTIKKPQAQGRRPICI

SEQ ID NO: 838658 - protein, 624 aa, Homo sapiens
RSEDGDSHARAYAPDAARPRDPSRPLRGARSLGRCRLGVPSRGVPGISGPNPGVPGRACTEGPGSCALPAAVRDLFDLVCRTLGLRETWFFGLQYTIKDTVAWLKMDKKVLDHDVSKEEPVTFHFLAKFYPENAEEELVQEITQHLFFLQVKKQILDEKIYCPPEASVLLASYAVQAKYGDYDPSVHKRGFLAQEELLPKRVINLYQMTPEMWEERITAWYAEHRGRARDEAEMEYLKIAQDLEMYGVNYFAIRNKKGTELLLGVDALGLHIYDPENRLTPKISFPWNEIRNISYSDKEFTIKPLDKKIDVFKFNSSKLRVNKLILQLCIGNHDLFMRRRKADSLEVQQMKAQAREEKARKQMERQRLAREKQMREEAERTRDELERRLLQMKEEATMANEALMRSEETADLLAEKAQITEEEAKLLAQKAAEAEQEMQRIKATAIRTEEEKRLMEQKVLEAEVLALKMAEESERRAKEADQLKQDLQEAREAERRAKQKLLEIATKPTYPPMNPIPAPLPPDIPSFNLIGDSLSFDFKDTDMKRLSMEIEKEKVEYMEKSKHLQEQLNELKTEIEALKLKERETALDILHNENSDRGGSSKHNTIKKLTLQSAKSRVAFFEEL

SEQ ID NO: 838659 - protein, 286 aa, Homo sapiens
MAGAIASRMSFSSLKRKQPKTFTVRIVTMDAEMEFNCEMKWKGKDLFDLVCRTLGLRETWFFGLQYTIKDTVAWLKMDKKVLDHDVSKEEPVTFHFLAKFYPENAEEELVQEITQHLFFLQVKKQILDEKIYCPPEASVLLASYAVQAKYGDYDPSVHKRGFLAQEELLPKRVINLYQMTPEMWEERITAWYAEHRGRARDEAEMEYLKIAQDLEMYGVNYFAIRNKKGTELLLGVDALGLHIYDPENRLTPKISFPWNEIRNISYSDKELTLQSAKSRVAFFEEL

SEQ ID NO: 838660 - protein, 165 aa, Homo sapiens
MAGAIASRMSFSSLKRKQPKTFTVRIVTMDAEMEFNCEMKWKGKDLFDLVCRTLGLRETWFFGLQYTIKDTVAWLKMDKKVLDHDVSKEEPVTFHFLAKFYPENAEEELVQEITQHLFFLQVKKQILDEKIYCPPEASVLLASYAVQAKLTLQSAKSRVAFFEEL

SEQ ID NO: 838661 - protein, 595 aa, Homo sapiens; identical to SEQ ID NO: 838651

SEQ ID NO: 838662 - protein, 595 aa, Homo sapiens; identical to SEQ ID NO: 838651

SEQ ID NO: 838663 - protein, 590 aa, Homo sapiens; identical to SEQ ID NO: 838652

SEQ ID NO: 838664 - protein, 339 aa, Homo sapiens
MAGAIASRMSFSSLKRKQPKTFTVRIVTMDAEMEFNCEMKWKGKDLFDLVCRTLGLRETWFFGLQYTIKDTVAWLKMDKKVLDHDVSKEEPVTFHFLAKFYPENAEEELVQEITQHLFFLQVKKQILDEKIYCPPEASVLLASYAVQAKYGDYDPSVHKRGFLAQEELLPKRVINLYQMTPEMWEERITAWYAEHRGRARDEAEMEYLKIAQDLEMYGVNYFAIRNKKGTELLLGVDALGLHIYDPENRLTPKISFPWNEIRNISYSDKEFTIKPLDKKIDVFKFNSSKLRVNKLILQLCIGNHDLFMRRRKADSLEVQQMKAQAREEKARKQVSTTLF

SEQ ID NO: 838665 - protein, 590 aa, Homo sapiens; identical to SEQ ID NO: 838652

SEQ ID NO: 838666 - protein, 507 aa, Homo sapiens; identical to SEQ ID NO: 838657

SEQ ID NO: 838667 - protein, 552 aa, Homo sapiens
MKWKGKDLFDLVCRTLGLRETWFFGLQYTIKDTVAWLKMDKKVLDHDVSKEEPVTFHFLAKFYPENAEEELVQEITQHLFFLQVKKQILDEKIYCPPEASVLLASYAVQAKYGDYDPSVHKRGFLAQEELLPKRVINLYQMTPEMWEERITAWYAEHRGRARDEAEMEYLKIAQDLEMYGVNYFAIRNKKGTELLLGVDALGLHIYDPENRLTPKISFPWNEIRNISYSDKEFTIKPLDKKIDVFKFNSSKLRVNKLILQLCIGNHDLFMRRRKADSLEVQQMKAQAREEKARKQMERQRLAREKQMREEAERTRDELERRLLQMKEEATMANEALMRSEETADLLAEKAQITEEEAKLLAQKAAEAEQEMQRIKATAIRTEEEKRLMEQKVLEAEVLALKMAEESERRAKEADQLKQDLQEAREAERRAKQKLLEIATKPTYPPMNPIPAPLPPDIPSFNLIGDSLSFDFKDTDMKRLSMEIEKEKVEYMEKSKHLQEQLNELKTEIEALKLKERETALDILHNENSDRGGSSKHNTIKKPQAQGRRPICI

SEQ ID NO: 838668 - protein, 549 aa, Homo sapiens
MAGAIASRMSFSSLKRKQPKTFTVRIVTMDAEMEFNCEMKWKGKDLFDLVCRTLGLRETWFFGLQYTIKDTVAWLKMDKKVKKQILDEKIYCPPEASVLLASYAVQAKYGDYDPSVHKRGFLAQEELLPKRVINLYQMTPEMWEERITAWYAEHRGRARDEAEMEYLKIAQDLEMYGVNYFAIRNKKGTELLLGVDALGLHIYDPENRLTPKISFPWNEIRNISYSDKEFTIKPLDKKIDVFKFNSSKLRVNKLILQLCIGNHDLFMRRRKADSLEVQQMKAQAREEKARKQMERQRLAREKQMREEAERTRDELERRLLQMKEEATMANEALMRSEETADLLAEKAQITEEEAKLLAQKAAEAEQEMQRIKATAIRTEEEKRLMEQKVLEAEVLALKMAEESERRAKEADQLKQDLQEAREAERRAKQKLLEIATKPTYPPMNPIPAPLPPDIPSFNLIGDSLSFDFKDTDMKRLSMEIEKEKVEYMEKSKHLQEQLNELKTEIEALKLKERETALDILHNENSDRGGSSKHNTIKKPQAQGRRPICI

SEQ ID NO: 838669 - protein, 566 aa, Homo sapiens
MAGAIASRMSFSSLKRKQPKTFTVRIVTMDAEMEFNCEMKWKGKDLFDLVCRTLGLRETWFFGLQYTIKDTVAWLKMDKKVLDHDVSKEEPVTFHFLAKFYPENAEEELVQEITQHLFFLQVKKQILDEKIYCPPEASVLLASYAVQAKYGDYDPSVHKRGFLAQEELLPKRVINLYQMTPEMWEERITAWYAEHRGRARDEAEMEYLKIAQDLEMYGVNYFAIRNKKGTELLLGVDALGLHIYDPENRLTPKISFPWNEIRNISYSDKEFTIKPLDKKIDVFKFNSSKLRVNKLILQLCIGNHDLFMRRRKADSLEVQQMKAQAREEKARKQMKEEATMANEALMRSEETADLLAEKAQITEEEAKLLAQKAAEAEQEMQRIKATAIRTEEEKRLMEQKVLEAEVLALKMAEESERRAKEADQLKQDLQEAREAERRAKQKLLEIATKPTYPPMNPIPAPLPPDIPSFNLIGDSLSFDFKDTDMKRLSMEIEKEKVEYMEKSKHLQEQLNELKTEIEALKLKERETALDILHNENSDRGGSSKHNTIKKLTLQSAKSRVAFFEEL

SEQ ID NO: 838670 - protein, 220 aa, Homo sapiens
MAGAIASRMSFSSLKRKQPKTFTVRIVTMDAEMEFNCEVKKQILDEKIYCPPEASVLLASYAVQAKNKKGTELLLGVDALGLHIYDPENRLTPKISFPWNEIRNISYSDKEFTIKPLDKKIDVFKFNSSKLRVNKLILQLCIGNHDLFMRRRKADSLEVQQMKAQAREEKARKQGQRGRSAEAGPAGSTRGGAKSQAEAPGDCHQAHVPAHEPNSSTVAS

SEQ ID NO: 838671 - protein, 595 aa, Homo sapiens; identical to SEQ ID NO: 838651

SEQ ID NO: 838672 - protein, 561 aa, Homo sapiens
MAGAIASRMSFSSLKRKQPKTFTVRIVTMDAEMEFNCEMKWKGKDLFDLVCRTLGLRETWFFGLQYTIKDTVAWLKMDKKVLDHDVSKEEPVTFHFLAKFYPENAEEELVQEITQHLFFLQVKKQILDEKIYCPPEASVLLASYAVQAKYGDYDPSVHKRGFLAQEELLPKRVINLYQMTPEMWEERITAWYAEHRGRARDEAEMEYLKIAQDLEMYGVNYFAIRNKKGTELLLGVDALGLHIYDPENRLTPKISFPWNEIRNISYSDKEFTIKPLDKKIDVFKFNSSKLRVNKLILQLCIGNHDLFMRRRKADSLEVQQMKAQAREEKARKQMKEEATMANEALMRSEETADLLAEKAQITEEEAKLLAQKAAEAEQEMQRIKATAIRTEEEKRLMEQKVLEAEVLALKMAEESERRAKEADQLKQDLQEAREAERRAKQKLLEIATKPTYPPMNPIPAPLPPDIPSFNLIGDSLSFDFKDTDMKRLSMEIEKEKVEYMEKSKHLQEQLNELKTEIEALKLKERETALDILHNENSDRGGSSKHNTIKKPQAQGRRPICI

SEQ ID NO: 838673 - protein, 282 aa, Homo sapiens
MAGAIASRMSFSSLKRKQPKTFTVRIVTMDAEMEFNCEMKWKGKDLFDLVCRTLGLRETWFFGLQYTIKDTVAWLKMDKKVLDHDVSKEEPVTFHFLAKFYPENAEEELVQEITQHLFFLQVKKQILDEKIYCPPEASVLLASYAVQAKYGDYDPSVHKRGFLAQEELLPKRVINLYQMTPEMWEERITAWYAEHRGRARDEAEMEYLKIAQDLEMYGVNYFAIRNKKGTELLLGVDALGLHIYDPENRLTPKISFPWNEIRNISYSDKEPKAWDGQKCLPP

SEQ ID NO: 838674 - protein, 289 aa, Homo sapiens
CEGSGHCSGKSLLRWTVRLSALSSSQRPHAGPPAGPSTLRPPSFPGASFGLDCPCSSILLPPPDLLSSRLPPPLARVMRSRLLLSVAHLPTIRETTEEMLLGGPGQEPPPSPSLDDYVRSISRLAQPTSVLDKATAQGQPRPPHRPAQACRKGRPAVSLRDITARFSGQQPTLPMADTVDPLDWLFGESQEKQPSQRDLPRRTGPSAGLWGPHRQMDSSKPMGAPRGRLCEARMPGHSLARPPQDGQQSSDLRSWTFGQSAQAMASRHRPRPSSVLRTLYSHLPVIHEL

SEQ ID NO: 838675 - protein, 289 aa, Homo sapiens; identical to SEQ ID NO: 838674

SEQ ID NO: 838676 - protein, 289 aa, Homo sapiens; identical to SEQ ID NO: 838674

SEQ ID NO: 838677 - protein, 289 aa, Homo sapiens; identical to SEQ ID NO: 838674

SEQ ID NO: 838678 - protein, 134 aa, Homo sapiens
CEGSGHCSGKSLLRWTVRLSALSSSQRPHAGPPAGPSTLRPPSFPGASFGLDCPCSSILLPPPDLLSSRLPPPLARVMRSRLLLSVAHLPTIRETTEEMLLGGPGQEPPPSPSLDDYSQDVLRPRPGHLESEGP

SEQ ID NO: 838679 - protein, 156 aa, Homo sapiens
SVHCPPPSDPTLDPLPDPPPFGPQASQGLPLDWTVPAHPFSCHPQTSSAPGKREQLPLGLRQNTRALFIFEGNSQPELAQPPYGLETRAVCRGLCIYKGIQGLFHAFPTTSRPGVFITLFYGWVSGGLERWPCQRSHGQCVADPGFKPSLPLTSVC

SEQ ID NO: 838680 - protein, 289 aa, Homo sapiens; identical to SEQ ID NO: 838674

SEQ ID NO: 838681 - protein, 289 aa, Homo sapiens; identical to SEQ ID NO: 838674

SEQ ID NO: 838682 - protein, 153 aa, Homo sapiens
AQLVVSHRQPLSSALTRYPLQWWPCLYPGHFRGSVLGRGRGWKVDPWSAQLKTRFVLFLHKSRQWSITRPRPGERCLCPSSPSRGWLHRTASSAPKSASWLPPSKPMFCEAQENTWSLSKCTNVFRGTVTWHHWGTLLATTHTSCGGIGRVPP

SEQ ID NO: 838683 - protein, 134 aa, Homo sapiens
PKEEGTGLPRPQGPDFHLSAQICLCHCRPGTGRWGAEGKSRPPLKSQPPSDWLQGSRLGRGLVTPEGLKGGWERRTPQTDGGQGSGSGSGDPECAPTPPWPGCCRRPACFPCSWPASSRRAGDKRSRRWTAMVA

SEQ ID NO: 838684 - protein, 79 aa, Homo sapiens
MTDECAALPTLKYVRPGGGFVPNFQLFEKGDVNGEKEQKFYTFLKNSCPPTSDILEGRKDLWVLSWFLFSKLVAGKAQN

SEQ ID NO: 838685 - protein, 124 aa, Homo sapiens
MREGPKALVGGPPLSLSEGPALSAFRLRPLGRDATPLLLRRTCPHPSLVHWLETHPVCPVKAFLQQLMQTHNAAANTQCCCKHTMQLQTHNAAANTQCSCKHTMQLQTHNAAANTQCSCKHNAG

SEQ ID NO: 838686 - protein, 134 aa, Homo sapiens; identical to SEQ ID NO: 838683

SEQ ID NO: 838687 - protein, 157 aa, Homo sapiens
MLPHLLFLFGPELNALQEELAPFGLVILGFPCNQFGKQEPGENSEILPTLKYVRPGGGFVPNFQLFEKGDVNGEKEQKFYTFLKNSCPPTSELLGTSDRLFWEPMKVHDIRWNFEKFLVGPDGIPIMRWHHRTTVSNVKMDILSYMRRQAALGVKRK

SEQ ID NO: 838688 - protein, 137 aa, Homo sapiens
SVPDFLVCCVSELFIGKQEPGENSEILPTLKYVRPGGGFVPNFQLFEKGDVNGEKEQKFYTFLKNSCPPTSELLGTSDRLFWEPMKVHDIRWNFEKFLVGPDGIPIMRWHHRTTVSNVKMDILSYMRRQAALGVKRK

SEQ ID NO: 838689 - protein, 134 aa, Homo sapiens; identical to SEQ ID NO: 838683

SEQ ID NO: 838690 - protein, 104 aa, Homo sapiens
MSPRVSSLFDEKGDVKWRRKSMNILALVSKWNSCPPTSELLGTSDRLFWEPMKVHDIRWNFEKFLVGPDGIPIMRWHHRTTVSNVKMDILSYMRRQAALGVKRK

SEQ ID NO: 838691 - protein, 134 aa, Homo sapiens; identical to SEQ ID NO: 838683

SEQ ID NO: 838692 - protein, 114 aa, Homo sapiens
FAAASTWCQRMMGIPAGHGQQRQDGHPVLHEAAGSPGGQEEVTEGRLIPCPPCRGGTLFRKKSVSPTTLSTHHRPLSYHSRPQPGTNGCIQFCVLPGMWVWVHVGVYTHAYRYA

SEQ ID NO: 838693 - protein, 126 aa, Homo sapiens
VGPTSPTRQLLKVPADVVNLHGFPEEAVRCTQGLRGGRDFVQEEIRVSNHTIYPSQTPFLSLKAPAWHKWMHTVLCTARHVGVGACGCLHTCLQVCVIVCVCMGVQPRVYLCVFLGMCTICVPAAV

SEQ ID NO: 838694 - protein, 102 aa, Homo sapiens
MDAYSSVYCQACGCGCMWVFTHMPTGMRDCVCVHGCTATCLPMCLSGNVYHLCACSCVVLDSDNPFSPVLHSNDNSSLTPKPKGKTSAPSEDVPSPLTGPLA

SEQ ID NO: 838695 - protein, 134 aa, Homo sapiens; identical to SEQ ID NO: 838683

SEQ ID NO: 838696 - protein, 79 aa, Homo sapiens
MKVHDIRWNFEKFLVGPDGIPIMRWHHRTTVSNVKMDILSYMRRQAALGVKLPAPLSTCLGGTDLGELHAWGHARPSQT

SEQ ID NO: 838697 - protein, 134 aa, Homo sapiens; identical to SEQ ID NO: 838683

SEQ ID NO: 838698 - protein, 134 aa, Homo sapiens; identical to SEQ ID NO: 838683

SEQ ID NO: 838699 - protein, 134 aa, Homo sapiens; identical to SEQ ID NO: 838683

SEQ ID NO: 838700 - protein, 134 aa, Homo sapiens; identical to SEQ ID NO: 838683

SEQ ID NO: 838701 - protein, 168 aa, Homo sapiens
MDISAVCWQIRPLSSARRGQYIELNALQEELAPFGLVILGFPCNQFGKQEPGENSEILPTLKYVRPGGGFVPNFQLFEKGDVNGEKEQKFYTFLKNSCPPTSELLGTSDRLFWEPMKVHDIRWNFEKFLVGPDGIPIMRWHHRTTVSNVKMDILSYMRRQAALGVKRK

SEQ ID NO: 838702 - protein, 104 aa, Homo sapiens; identical to SEQ ID NO: 838690

SEQ ID NO: 838703 - protein, 134 aa, Homo sapiens; identical to SEQ ID NO: 838683

SEQ ID NO: 838704 - protein, 134 aa, Homo sapiens; identical to SEQ ID NO: 838683

SEQ ID NO: 838705 - protein, 105 aa, Homo sapiens
MHTGRACTIRSGHSGLSLQPIWKTGTRRELRDPSYPQVCPTRWRLVPNFQLFEKGDVNGRERAEILHFPKRTPVLPPRTYLRVGRISEFSPGSCFPNWLQGKPRM

SEQ ID NO: 838706 - protein, 134 aa, Homo sapiens; identical to SEQ ID NO: 838683

SEQ ID NO: 838707 - protein, 109 aa, Homo sapiens
LCLISQVRVRSMADWRWWTGWGLWLKFLGPPLGGVRSQMQVADSRLSHYAVGFSSLASPASVWEWIPQKTLYPLSSQHTLCFSWFSPLMVVFSSLTGSPSGSIPKSSHY

SEQ ID NO: 838708 - protein, 76 aa, Homo sapiens
LLLEPLTTILDHNPQEKGGSVKDGEKLCKPWQHFKPWILQALCFTPRFFNYINQQIPFLRKPVRGEILFQGRQNPD

SEQ ID NO: 838709 - protein, 67 aa, Homo sapiens
AGQEVSICRGVCGAREQGRGFFLPGSLRVKGVKLGFGEGNRNFASGHIWFPATDSHGLSSLPACLGL

SEQ ID NO: 838710 - protein, 67 aa, Homo sapiens
PFRGPHPDPHRFHSWVQRAFLNSRRQLWGRRIFFCGGHPAQEGWRNGAARHSHSFLESRSQGGPSVT

SEQ ID NO: 838711 - protein, 443 aa, Homo sapiens
PCDEAGFSRFETSRIPRQQEQISRRDKSKQVWEAVLLPLSLLSMMDLRNTPAKSLDKFIEDYLLPDTCFRMQINHAIDIICGFLKERCFRGSSYPVCVSKVVKGGSSGKGTTLRGRSDADLVVFLSPLTTFQDQLNRRGEFIQEIRRQLEACQRERAFSVKFEVQAPRWGNPRALSFVLSSLQLGEGVEFDVLPAFDALGQLTGSYKPNPQIYVKLIEECTDLQKEGEFSTCFTELQRDFLKQRPTKLKSLIRLVKHWYQNCKKKLGKLPPQYALELLTVYAWERGSMKTHFNTAQGFRTVLELVINYQQLCIYWTKYYDFKNPIIEKYLRRQLTKPRPVILDPADPTGNLGGGDPKGWRQLAQEAEAWLNYPCFKNWDGSPVSSWILLAESNSADDETDDPRRYQKYGYIGTHEYPHFSHRPSTLQAASTPQAEEDWTCTIL

SEQ ID NO: 838712 - protein, 389 aa, Homo sapiens
PCDEAGFSRFETSRIPRQQEQISRRDKSKQVWEAVLLPLSLLSMMDLRNTPAKSLDKFIEDYLLPDTCFRMQINHAIDIICGFLKERCFRGSSYPVCVSKVVKGGSSGKGTTLRGRSDADLVVFLSPLTTFQDQLNRRGEFIQEIRRQLEACQRERAFSVKFEVQAPRWGNPRALSFVLSSLQLGEGVEFDVLPAFDALGQLTGSYKPNPQIYVKLIEECTDLQKEGEFSTCFTELQRDFLKQRPTKLKSLIRLVKHWYQNCKKKLGKLPPQYALELLTVYAWERGSMKTHFNTAQGFRTVLELVINYQQLCIYWTKYYDFKNPIIADPTGNLGGGDPKGWRQLAQEAEAWLNYPCFKNWDGSPVSSWILLVRPPASSLPFIPAPLHEA

SEQ ID NO: 838713 - protein, 407 aa, Homo sapiens
PCDEAGFSRFETSRIPRQQEQISRRDKSKQVWEAVLLPLSLLSMMDLRNTPAKSLDKFIEDYLLPDTCFRMQINHAIDIICGFLKERCFRGSSYPVCVSKVVKGGSSGKGTTLRGRSDADLVVFLSPLTTFQDQLNRRGEFIQEIRRQLEACQRERAFSVKFEVQAPRWGNPRALSFVLSSLQLGEGVEFDVLPAFDALGQLTGSYKPNPQIYVKLIEECTDLQKEGEFSTCFTELQRDFLKQRPTKLKSLIRLVKHWYQNCKKKLGKLPPQYALELLTVYAWERGSMKTHFNTAQGFRTVLELVINYQQLCIYWTKYYDFKNPIIEKYLRRQLTKPRPVILDPADPTGNLGGGDPKGWRQLAQEAEAWLNYPCFKNWDGSPVSSWILLVRPPASSLPFIPAPLHEA

SEQ ID NO: 838714 - protein, 378 aa, Homo sapiens
MPSEQWLVLHNVSDCSCAFYLGRFASLSINYYFCRLFQGGSSGKGTTLRGRSDADLVVFLSPLTTFQDQLNRRGEFIQEIRRQLEACQRERAFSVKFEVQAPRWGNPRALSFVLSSLQLGEGVEFDVLPAFDALGQLTGSYKPNPQIYVKLIEECTDLQKEGEFSTCFTELQRDFLKQRPTKLKSLIRLVKHWYQNCKKKLGKLPPQYALELLTVYAWERGSMKTHFNTAQGFRTVLELVINYQQLCIYWTKYYDFKNPIIEKYLRRQLTKPRPVILDPADPTGNLGGGDPKGWRQLAQEAEAWLNYPCFKNWDGSPVSSWILLAESNSADDETDDPRRYQKYGYIGTHEYPHFSHRPSTLQAASTPQAEEDWTCTIL

SEQ ID NO: 838715 - protein, 285 aa, Homo sapiens
PCDEAGFSRFETSRIPRQQEQISRRDKSKQVWEAVLLPLSLLSMMDLRNTPAKSLDKFIEDYLLPDTCFRMQINHAIDIICGFLKERCFRGSSYPVCVSKVVKCKKKLGKLPPQYALELLTVYAWERGSMKTHFNTAQGFRTVLELVINYQQLCIYWTKYYDFKNPIIEKYLRRQLTKPRPVILDPADPTGNLGGGDPKGWRQLAQEAEAWLNYPCFKNWDGSPVSSWILLAESNSADDETDDPRRYQKYGYIGTHEYPHFSHRPSTLQAASTPQAEEDWTCTIL

SEQ ID NO: 838716 - protein, 337 aa, Homo sapiens
PCDEAGFSRFETSRIPRQQEQISRRDKSKQVWEAVLLPLSLLSMMDLRNTPAKSLDKFIEDYLLPDTCFRMQINHAIDIICGFLKERCFRGSSYPVCVSKVVKGGSSGKGTTLRGRSDADLVVFLSPLTTFQDQLNRRGEFIQEIRRQLEACQRERAFSVKFEVQAPRWGNPRALSFVLSSLQLGEGVEFDVLPAFDALGQLTGSYKPNPQIYVKLIEECTDLQKEGEFSTCFTELQRDFLKQRPTKLKSLIRLVKHWYQNCKKKLGKLPPQYALELLTVYAWERGSMKTHFNTAQGFRTVLELVINYQQLCIYWTKYYDFKNPIIEKYLPLMPWVS

SEQ ID NO: 838717 - protein, 271 aa, Homo sapiens
PCDEAGFSRFETSRIPRQQEQISRRDKSKQVWEAVLLPLSLLSMMDLRNTPAKSLDKFIEDYLLPDTCFRMQINHAIDIICGFLKERCFRGSSYPVCVSKVVKGGSSGKGTTLRGRSDADLVVFLSPLTTFQDQLNRRGEFIQEIRRQLEACQRERAFSVKFEVQAPRWGNPRALSFVLSSLQLGEGVEFDVLPAFDALGQLTGSYKPNPQIYVKLIEECTDLQKEGEFSTCFTELQRDFLKQRPTKLKSLIRLVKHWYQNPACWYLYIFI

SEQ ID NO: 838718 - protein, 117 aa, Homo sapiens
PCDEAGFSRFETSRIPRQQEQISRRDKSKQVWEAVLLPLSLLSMMDLRNTPAKSLDKFIEDYLLPDTCFRMQINHAIDIICGFLKERCFRGSSYPVCVSKVVKGGSSGKGTTLRGRS

SEQ ID NO: 838719 - protein, 395 aa, Homo sapiens
NETNSSPSSVSRRDKSKQVWEAVLLPLSLLSMMDLRNTPAKSLDKFIEDYLLPDTCFRMQINHAIDIICGFLKERCFRGSSYPVCVSKVVKGGSSGKGTTLRGRSDADLVVFLSPLTTFQDQLNRRGEFIQEIRRQLEACQRERAFSVKFEVQAPRWGNPRALSFVLSSLQLGEGVEFDVLPAFDALGQLTGSYKPNPQIYVKLIEECTDLQKEGEFSTCFTELQRDFLKQRPTKLKSLIRLVKHWYQNCKKKLGKLPPQYALELLTVYAWERGSMKTHFNTAQGFRTVLELVINYQQLCIYWTKYYDFKNPIIEKYLRRQLTKPRPVILDPADPTGNLGGGDPKGWRQLAQEAEAWLNYPCFKNWDGSPVSSWILLVRPPASSLPFIPAPLHEA

SEQ ID NO: 838720 - protein, 407 aa, Homo sapiens; identical to SEQ ID NO: 838713

SEQ ID NO: 838721 - protein, 457 aa, Homo sapiens
PCDEAGFSRFETSRIPRQQEQISRRDKSKQVWEAVLLPLSLLSMMDLRNTPAKSLDKFIEDYLLPDTCFRMQINHAIDIICGFLKERCFRGSSYPVCVSKVVKGGSSGKGTTLRGRSDADLVVFLSPLTTFQDQLNRRGEFIQEIRRQLEACQRERAFSVKFEVQAPRWGNPRALSFVLSSLQLGEGVEFDVLPAFDALGQLTGSYKPNPQIYVKLIEECTDLQKEGEFSTCFTELQRDFLKQRPTKLKSLIRLVKHWYQNCKKKLGKLPPQYALELLTVYAWERGSMKTHFNTAQGFRTVLELVINYQQLCIYWTKYYDFKNPIIEKYLRRQLTKPRPVILDPADPTGNLGGGDPKGWRQLAQEAEAWLNYPCFKNWDGSPVSSWILLTQHTPGSIHPTGRRGLDLHHPLNASASWGKGLQCYLDQFLHFQVGLLIQRGQSSSVSWCIIQDRTQVS

SEQ ID NO: 838722 - protein, 403 aa, Homo sapiens
PCDEAGFSRFETSRIPRQQEQISRRDKSKQVWEAVLLPLSLLSMMDLRNTPAKSLDKFIEDYLLPDTCFRMQINHAIDIICGFLKERCFRGSSYPVCVSKVVKGGSSGKGTTLRGRSDADLVVFLSPLTTFQDQLNRRGEFIQEIRRQLEACQRERAFSVKFEVQAPRWGNPRALSFVLSSLQLGEGVEFDVLPAFDALGQLTGSYKPNPQIYVKLIEECTDLQKEGEFSTCFTELQRDFLKQRPTKLKSLIRLVKHWYQNCKKKLGKLPPQYALELLTVYAWERGSMKTHFNTAQGFRTVLELVINYQQLCIYWTKYYDFKNPIIEKYLRRQLTKPRPVILDPADPTGNLGGGDPKGWRQLAQEAEAWLNYPCFKNWDGSPVSSWILLVNLTLVGRRNYTNN

SEQ ID NO: 838723 - protein, 349 aa, Homo sapiens
PCDEAGFSRFETSRIPRQQEQISRRDKSKQVWEAVLLPLSLLSMMDLRNTPAKSLDKFIEDYLLPDTCFRMQINHAIDIICGFLKERCFRGSSYPVCVSKVVKGGSSGKGTTLRGRSDADLVVFLSPLTTFQDQLNRRGEFIQEIRRQLEACQRERAFSVKFEVQAPRWGNPRALSFVLSSLQLGEGVEFDVLPAFDALGQLTGSYKPNPQIYVKLIEECTDLQKEGEFSTCFTELQRDFLKQRPTKLKSLIRLVKHWYQNCKKKLGKLPPQYALELLTVYAWERGSMKTHFNTAQGFRTVLELVINYQQLCIYWTKYYDFKNPIIEKYLRRQLTKPRYAIPTWLSSPM

SEQ ID NO: 838724 - protein, 220 aa, Homo sapiens
PCDEAGFSRFETSRIPRQQEQISRRDKSKQVWEAVLLPLSLLSMMDLRNTPAKSLDKFIEDYLLPDTCFRMQINHAIDIICGFLKERCFRGSSYPVCVSKVVKGGSSGKGTTLRGRSDADLVVFLSPLTTFQDQLNRRGEFIQEIRRQLEACQRERAFSVKFEVQAPRWGNPRALSFVLSSLQLGEGVEFDVLPAFDALGESSQLLFLPLPISEQKSPTV

SEQ ID NO: 838725 - protein, 115 aa, Homo sapiens
PCDEAGFSRFETSRIPRQQEQISRRDKSKQVWEAVLLPLSLLSMMDLRNTPAKSLDKFIEDYLLPDTCFRMQINHAIDIICGFLKERCFRGSSYPVCVSKVVKVSPGLPGQGRGG

SEQ ID NO: 838726 - protein, 105 aa, Homo sapiens
PSKTGSLRGNSEGTGSAAVCPTVRHFREQGSLVSSPLQAKWAAARSDGVIRGDLAVSHISVLPSATYWMCSKWGSGHGEEPSPQRVDNELFTRKREASKGTSWPS

SEQ ID NO: 838727 - protein, 599 aa, Homo sapiens
MDVHDLFRRLGAGAKFDTRRFSADAARFQIGKRKYDFDSSEVLQGLDFFGNKKSVPGVCGASQTHQKPQNGEKKEESLTERKREQSKKKRKTMTSEIASQEEGATIQWMSSVEAKIEDKKVQRESKLTSGKLENLRKEKINFLRNKHKIHVQGTDLPDPIATFQQLDQEYKINSRLLQNILDAGFQMPTPIQMQAIPVMLHGRELLASAPTGSGKTLAFSIPILMQLKQPANKGFRALIISPTRELASQIHRELIKISEGTGFRIHMIHKAAVAAKKFGPKSSKKFDILVTTPNRLIYLLKQDPPGIDLASVEWLVVDESDKLFEDGKTGFRDQLASIFLACTSHKVRRAMFSATFAYDVEQWCKLNLDNVISVSIGARNSAVETVEQELLFVGSETGKLLAVRELVKKGFNPPVLVFVQSIERAKELFHELIYEGINVDVIHAERTQQQRDNTVHSFRAGKIWVLICTALLARGIDFKGVNLVINYDFPTSSVEYIHRIGRTGRAGNKGKAITFFTEDDKPLLRSVANVIQQAGCPVPEYIKGFQKLLSKQKKKMIKKPLERESISTTPKCFLEKAKDKQKKVTGQNSKKKVALEDKS

SEQ ID NO: 838728 - protein, 637 aa, Homo sapiens
MDVHDLFRRLGAGAKFDTRRFSADAARFQIGKRKYDFDSSEVLQGLDFFGNKKSVPGVCGASQTHQKPQNGEKKEESLTERKREQSKKKRKTMTSETGFHHVGQYGLDLLTCDSPTLGSQSAGITDVSHHAQPEIASQEEGATIQWMSSVEAKIEDKKVQRESKLTSGKLENLRKEKINFLRNKHKIHVQGTDLPDPIATFQQLDQEYKINSRLLQNILDAGFQMPTPIQMQAIPVMLHGRELLASAPTGSGKTLAFSIPILMQLKQPANKGFRALIISPTRELASQIHRELIKISEGTGFRIHMIHKAAVAAKKFGPKSSKKFDILVTTPNRLIYLLKQDPPGIDLASVEWLVVDESDKLFEDGKTGFRDQLASIFLACTSHKVRRAMFSATFAYDVEQWCKLNLDNVISVSIGARNSAVETVEQELLFVGSETGKLLAVRELVKKGFNPPVLVFVQSIERAKELFHELIYEGINVDVIHAERTQQQRDNTVHSFRAGKIWVLICTALLARGIDFKGVNLVINYDFPTSSVEYIHRIGRTGRAGNKGKAITFFTEDDKPLLRSVANVIQQAGCPVPEYIKGFQKLLSKQKKKMIKKPLERESISTTPKCFLEKAKDKQKKVTGQNSKKKVALEDKS

SEQ ID NO: 838729 - protein, 599 aa, Homo sapiens; identical to SEQ ID NO: 838727

SEQ ID NO: 838730 - protein, 513 aa, Homo sapiens
MDVHDLFRRLGAGAKFDTRRFSADAARFQIGKRKYDFDSSEVLQGLDFFGNKKSVPGVCGASQTHQKPQNGEKKEESLTERKREQSKKKRKTMTSEIASQEEGATIQWMSSVEAKIEDKKVQRESKLTSGKLENLRKEKINFLRNKHKIHVQGTDLPDPIATFQQLDQEYKINSRLLQNILDAGFQMPTPIQMQAIPVMLHGRELLASAPTGSGKTLAFSIPILMQLKQPANKGFRALIISPTRELASQIHRELIKISEGTGFRIHMIHKAAVAAKKFGPKSSKKFDILVTTPNRLIYLLKQDPPGIDLASVEWLVVDESDKLFEDGKTGFRDQLASIFLACTSHKVRRAMFSATFAYDVEQWCKLNLDNVISVSIGARNSAVETVEQELLFVGSETGKLLAVRELVKKGFNPPVLVFVQSIERAKELFHELIYEGINVDVIHAERTQQQRDNTVHSFRAGKIWVLICTALLARGIDFKGVNLVINYDFPTSSVEYIHRIGELSFFSFPSVTH

SEQ ID NO: 838731 - protein, 599 aa, Homo sapiens; identical to SEQ ID NO: 838727

SEQ ID NO: 838732 - protein, 114 aa, Homo sapiens
MTSEIASQEEGATIQWMSSVEAKIEDKKVQRESKLTSGKLENLRKEKINFLRNKHKIHVQGTDLPDPIATFQQLDQEYKINSRLLQNILDAGFQMPTPIQMQAIPVMLHVSMKI

SEQ ID NO: 838733 - protein, 599 aa, Homo sapiens; identical to SEQ ID NO: 838727

SEQ ID NO: 838734 - protein, 599 aa, Homo sapiens; identical to SEQ ID NO: 838727

SEQ ID NO: 838735 - protein, 419 aa, Homo sapiens
MDVHDLFRRLGAGAKFDTRRFSADAARFQIGKRKYDFDSSEVLQGLDFFGNKKSVPGVCGASQTHQKPQNGEKKEESLTERKREQSKKKRKTMTSEIASQEEGATIQWMSSVEAKIEDKKVQRESKLTSGKLENLRKEKINFLRNKHKIHVQGTDLPDPIATFQQLDQEYKINSRLLQNILDAGFQMPTPIQMQAIPVMLHGRELLASAPTGSGKTLAFSIPILMQLKQPANKGFRALIISPTRELASQIHRELIKISEGTGFRIHMIHKAAVAAKKFGPKSSKKFDILVTTPNRLIYLLKQDPPGIDLASVEWLVVDESDKLFEDGKTGFRDQLASIFLACTSHKVRRAMFSATFAYDVEQWCKLNLDNVISVSIGARNSAVETVEQELLFVGSETGKLLAVRELVKKVYLYYLLEFW

SEQ ID NO: 838736 - protein, 782 aa, Homo sapiens
MVQHFKPQIFGDRKPVYDGKKNIYTVTALPIGNERVDFEVTIPGEGKDRIFKVSIKWLAIVSWRMLHEALVSGQIPVPLESVQALDVAMRHLASMRYTPVGRSFFSPPEGYYHPLGGGREVWFGFHQSVRPAMWKMMLNIDVSATAFYKAQPVIEFMCEVLDIRNIDEQPKPLTDSQRVRFTKEIKGLKVEVTHCGQMKRKYRVCNVTRRPASHQTFPLQLESGQTVECTVAQYFKQKYNLQLKYPHLPCLQVGQEQKHTYLPLEVCNIVAGQRCIKKLTDNQTSTMIKATARSAPDRQEEISRLMKNASYNLDPYIQEFGIKVKDDMTEVTGRVLPAPILQYGGRNRAIATPNQGVWDMRGKQFYNGIEIKVWAIACFAPQKQCREEVLKNFTDQLRKISKDAGMPIQGQPCFCKYAQGADSVEPMFRHLKNTYSGLQLIIVILPGKTPVYAEVKRVGDTLLGMATQCVQVKNVVKTSPQTLSNLCLKINVKLGGINNILVPHQRSAVFQQPVIFLGADVTHPPAGDGKKPSITAVVGSMDAHPSRYCATVRVQRPRQEIIEDLSYMVRELLIQFYKSTRFKPTRIIFYRDGVPEGQLPQILHYELLAIRDACIKLEKDYQPGITYIVVQKRHHTRLFCADKNERIGKSGNIPAGTTVDTNITHPFEFDFYLCSHAGIQGTSRPSHYYVLWDDNRFTADELQILTYQLCHTYVRCTRSVSIPAPAYYARLVAFRARYHLVDKEHDSGEGSHISGQSNGRDPQALAKAVQVHQDTLRTMYFA

SEQ ID NO: 838737 - protein, 782 aa, Homo sapiens; identical to SEQ ID NO: 838736

SEQ ID NO: 838738 - protein, 817 aa, Homo sapiens [sequence omitted]

SEQ ID NO: 838739 - protein, 782 aa, Homo sapiens; identical to SEQ ID NO: 838736

SEQ ID NO: 838740 - protein, 76 aa, Homo sapiens
MGVVGLYSQGLLLPYPPDSTEAHLGAPSTYPQNRAIATPNQGVWDMRGKQFYNGIEIKVWAIACFAPQKQCREEVL

SEQ ID NO: 838741 - protein, 927 aa, Homo sapiens
WQLAGRSQWELLQAPRRRQRRLRGRRRERPGLVGEPSPARDPEQRECGVPRPLTLDFTVSGPPDLRTGYGMEAGPSGAAAGAYLPPLQQVFQAPRRPGIGTVGKPIKLLANYFEVDIPKIDVYHYEVDIKPDKCPRRVNREVVEYMVQHFKPQIFGDRKPVYDGKKNIYTVTALPIGNERVDFEVTIPGEGKDRIFKVSIKWLAIVSWRMLHEALVSGQIPVPLESVQALDVAMRHLASMRYTPVGRSFFSPPEGYYHPLGGGREVWFGFHQSVRPAMWKMMLNIDVSATAFYKAQPVIEFMCEVLDIRNIDEQPKPLTDSQRVRFTKEIKGLKVEVTHCGQMKRKYRVCNVTRRPASHQTFPLQLESGQTVECTVAQYFKQKYNLQLKYPHLPCLQVGQEQKHTYLPLEVCNIVAGQRCIKKLTDNQTSTMIKATARSAPDRQEEISRLMKNASYNLDPYIQEFGIKVKDDMTEVTGRVLPAPILQYGGRNRAIATPNQGVWDMRGKQFYNGIEIKVWAIACFAPQKQCREEVLKNFTDQLRKISKDAGMPIQGQPCFCKYAQGADSVEPMFRHLKNTYSGLQLIIVILPGKTPVYAEVKRVGDTLLGMATQCVQVKNVVKTSPQTLSNLCLKINVKLGGINNILVPHQRSAVFQQPVIFLGADVTHPPAGDGKKPSITAVVGSMDAHPSRYCATVRVQRPRQEIIEDLSYMVRELLIQFYKSTRFKPTRIIFYRDGVPEGQLPQILHYELLAIRDACIKLEKDYQPGITYIVVQKRHHTRLFCADKNERIGKSGNIPAGTTVDTNITHPFEFDFYLCSHAGIQGTSRPSHYYVLWDDNRFTADELQILTYQLCHTYVRCTRSVSIPAPAYYARLVAFRARYHLVDKEHDSGEGSHISGQSNGRDPQALAKAVQVHQDTLRTMYFA

SEQ ID NO: 838742 - protein, 782 aa, Homo sapiens; identical to SEQ ID NO: 838736

SEQ ID NO: 838743 - protein, 114 aa, Homo sapiens
TWVIHGLGSHGWAHAPGAVPPKSRGSKEEGGGVGRSVGCLVSFYRGGVRVGNRASKTDHQPEISDINLMSPTPHPILSHLALTPLDQKGQHWCPPYTQVSHVTHSAKDSCLTAW

SEQ ID NO: 838744 - protein, 725 aa, Homo sapiens
MGHCLDFELLPKLEVVVVSQLPQATPIPHREVVEYMVQHFKPQIFGDRKPVYDGKKNIYTVTALPIGNERVDFEVTIPGEGKDRIFKVSIKWLAIVSWRMLHEALVSGQIPVPLESVQALDVAMRHLASMRYTPVGRSFFSPPEGYYHPLGGGREVWFGFHQSVRPAMWKMMLNIDVSATAFYKAQPVIEFMCEVLDIRNIDEQPKPLTDSQRVRFTKEIKGLKVEVTHCGQMKRKYRVCNVTRRPASHQTFPLQLESGQTVECTVAQYFKQKYNLQLKYPHLPCLQVGQEQKHTYLPLEVCNIVAGQRCIKKLTDNQTSTMIKATARSAPDRQEEISRLMKNASYNLDPYIQEFGIKVKDDMTEVTGRVLPAPILQYGGRNRAIATPNQGVWDMRGKQFYNGIEIKVWAIACFAPQKQCREEVLKNFTDQLRKISKDAGMPIQGQPCFCKYAQGADSVEPMFRHLKNTYSGLQLIIVILPGKTPVYAEVKRVGDTLLGMATQCVQVKNVVKTSPQTLSNLCLKINVKLGGINNILVPHQRSAVFQQPVIFLGADVTHPPAGDGKKPSITAVVGSMDAHPSRYCATVRVQRPRQEIIEDLSYMVRELLIQFYKSTRFKPTRIIFYRDGVPEGQLPQILHYELLAIRDACIKLEKDYQPGITYIVVQKRHHTRLFCADKNERIGKSGNIPAGTTVDTNITHPFEFDFYLCSHAGIQIRKLKPREIK

SEQ ID NO: 838745 - protein, 189 aa, Homo sapiens
MWRPGSCVAPGPAAMPKRSCPFADVAPLQLKVRVSQRELSRGVCAERYSQEVFEKTKRLLFLGAQAYLDHVWDEGCAVVHLPESPKPGPTGAPRAARGQMLIGPDGRLIRSLGQASEADPSGVASIACSSCVRAVDGKAVCGQCERALCGQCVRTCWGCGSVACTLCGLVDCSDMYEKVLCTSCAMFET

SEQ ID NO: 838746 - protein, 124 aa, Homo sapiens
MWRPGSCVAPGPAAMPKRSCPFADVAPLQLKVRVSQRELSRGVCAERYSQEVFDPSGVASIACSSCVRAVDGKAVCGQCERALCGQCVRTCWGCGSVACTLCGLVDCSDMYEKVLCTSCAMFET

SEQ ID NO: 838747 - protein, 171 aa, Homo sapiens
MWRPGSCVAPGPAAMPKRSCPFADVAPLQLKVRVSQRELSRGVCAERYSQEVFEKTKRLLFLGAQAYLDHVWDEGCAVVHLPESPKPGPTGAPRAARGQMLIGPDGRLIRSLGQASEADPSGVASIACSSCVRAVDGKAVCGQCERALCGQCVRTCWGCGSVACTLCGLVE

SEQ ID NO: 838748 - protein, 189 aa, Homo sapiens; identical to SEQ ID NO: 838745

SEQ ID NO: 838749 - protein, 189 aa, Homo sapiens; identical to SEQ ID NO: 838745

SEQ ID NO: 838750 - protein, 163 aa, Homo sapiens
MWRPGSCVAPGPAAMPKRSCPFADVAPLQLKVRVSQRELSRGVCAERYSQEVFEKTKRLLFLGAQAYLDHVWDEGCAVVHLPESPKPGPTGAPRAARGQMLIGPDGRLIRSLGQASEADPSGVASIACSSCVRAVDGKAVCGQCERALCGQCVRTCSCAMFET

SEQ ID NO: 838751 - protein, 88 aa, Homo sapiens
VILEDWAGRWCLPGRVALTGHAQGPLLVAVPHLWPGGIGFRVNLSCPKRASGGCSISWNVYSFRPLDVDTGDEKFRKWTDSWSSVQTY

SEQ ID NO: 838752 - protein, 559 aa, Homo sapiens
MPLVKRNIDPRHLCHTALPRGIKNELECVTNISLANIIRQLSSLSKYAEDIFGELFNEAHSFSFRVNSLQERVDRLSVSVTQLDPKEEELSLQDITMRKAFRSSTIQDQQLFDRKTLPIPLQETYDVCEQPPPLNILTPYRDDGKEGLKFYTNPSYFFDLWKEKMLQDTEDKRKEKRKQKQKNLDRPHEPEKVPRAPHDRRREWQKLAQGPELAEDDANLLHKHIEVANGPASHFETRPQTYVDHMDGSYSLSALPFSQMSELLTRAEERVLVRPHEPPPPPPMHGAGDAKPIPTCISSATGLIENRPQSPATGRTPVFVSPTPPPPPPPLPSALSTSSLRASMTSTPPPPVPPPPPPPATALQAPAVPPPPAPLQIAPGVLHPAPPPIAPPLVQPSPPVARAAPVCETVPVHPLPQGEVQGLPPPPPPPPLPPPGIRPSSPVTVTALAHPPSGLHPTPSTAPGPHVPLMPPSPPSQVIPASEPKRHPSTLPVISDARSVLLEAIRKGIQLRKVEEQREQEAKHERIENDVATILSRRIAVEYSDSEDDSEFDEVDWLE

SEQ ID NO: 838753 - protein, 559 aa, Homo sapiens; identical to SEQ ID NO: 838752

SEQ ID NO: 838754 - protein, 559 aa, Homo sapiens; identical to SEQ ID NO: 838752

SEQ ID NO: 838755 - protein, 604 aa, Homo sapiens
AGLARGGGGGNGSSRCCSLARRAHGGSGGGLAPQAAFPVAWRLGRCPERVPPQSPTLLGALGGVPRAEGDRRPLPKHEEGVRREPPRFHGKYAEDIFGELFNEAHSFSFRVNSLQERVDRLSVSVTQLDPKEEELSLQDITMRKAFRSSTIQDQQLFDRKTLPIPLQETYDVCEQPPPLNILTPYRDDGKEGLKFYTNPSYFFDLWKEKMLQDTEDKRKEKRKQKQKNLDRPHEPEKVPRAPHDRRREWQKLAQGPELAEDDANLLHKHIEVANGPASHFETRPQTYVDHMDGSYSLSALPFSQMSELLTRAEERVLVRPHEPPPPPPMHGAGDAKPIPTCISSATGLIENRPQSPATGRTPVFVSPTPPPPPPPLPSALSTSSLRASMTSTPPPPVPPPPPPPATALQAPAVPPPPAPLQIAPGVLHPAPPPIAPPLVQPSPPVARAAPVCETVPVHPLPQGEVQGLPPPPPPPPLPPPGIRPSSPVTVTALAHPPSGLHPTPSTAPGPHVPLMPPSPPSQVIPASEPKRHPSTLPVISDARSVLLEAIRKGIQLRKVEEQREQEAKHERIENDVATILSRRIAVEYSDSEDDSEFDEVDWLE

SEQ ID NO: 838756 - protein, 559 aa, Homo sapiens; identical to SEQ ID NO: 838752

SEQ ID NO: 838757 - protein, 559 aa, Homo sapiens; identical to SEQ ID NO: 838752

SEQ ID NO: 838758 - protein, 559 aa, Homo sapiens; identical to SEQ ID NO: 838752

SEQ ID NO: 838759 - protein, 525 aa, Homo sapiens
MPLVKRNIDPRHLCHTALPRGIKNELECVTNISLANIIRQLSSLSKYAEDIFGELFNEAHSFSFRVNSLQERVDRLSVSVTQLDPKEEELSLQDITMRKAFRSSTIQDQQLFDRKTLPIPLQETYDVCEQPPPLNILTPYRDDGKEGLKFYTNPSYFFDLWKEKMLQDTEDKRKEKRKQKQKNLDRPHEPEKVPRAPHDRRREWQKLAQGPELAEDDANLLHKHIEVANGPASHFETRPQTYVDHMDGSYSLSALPFSQMSELLTRAEERVLVRPHEPPPPPPMHGAGDAKPIPTCISSATGLIENRPQSPATGRTPVFVSPTPPPPPPPLPSALSTSSLRASMTSTPPPPVPPPPPPPATALQAPAVPPPPAPLQIAPGVLHPAPPPIAPPLVQPSPPVARAAPVCETVPVHPLPQGEVQGLPPPPPPPPLPPPGIRPSSPVTVTALAHPPSGLHPTPSTAPGPHVPLMPPSPPSQVIPASEPKRHPSTLPVISDARSVLLEAIRKGNFLSSMKSIAIVALETF

SEQ ID NO: 838760 - protein, 164 aa, Homo sapiens
MSLLGDRFRSIIDDAWWFGTVLSQEPYQPQYPDSHFQCYIVRWDNTEIEKLSPWDMEPIPDNVDPPEELGASISVTTDELEKLLYKPQAGEWGQKSRDEECDRIISGIDQLLNLDIAAAFAGPVDLCTYPKYCTVVAYPTDLYTIRMRLVNRFYRLVETCFQNV

SEQ ID NO: 838761 - protein, 2318 aa, Homo sapiens
GPGGAHGMGGGGGGGGARLRRGDASPVRPRRGLHAPLARSLPPPAPRPAMAEPSSARRPVPLIESELYFLIARYLSAGPCRRAAQVLVQELEQYQLLPKRLDWEGNEHNRSYEELVLSNKHVAPDHLLQICQRIGPMLDKEIPPSISRVTSLLGAGRQSLLRTAKDCRHTVWKGSAFAALHRGRPPEMPVNYGSPPNLVEIHRGKQLTGCSTFSTAFPGTMYQHIKMHRRILGHLSAVYCVAFDRTGHRIFTGSDDCLVKIWSTHNGRLLSTLRGHSAEISDMAVNYENTMIAAGSCDKIIRVWCLRTCAPVAVLQGHTGSITSLQFSPMAKGSQRYMVSTGADGTVCFWQWDLESLKFSPRPLKFTEKPRPGVQMLCSSFSVGGMFLATGSTDHVIRMYFLGFEAPEKIAELESHTDKVDSIQFCNNGDRFLSGSRDGTARIWRFEQLEWRSILLDMATRISGDLSSEEERFMKPKVTMIAWNQNDSIVVTAVNDHVLKVWNSYTGQLLHNLMGHADEVFVLETHPFDSRIMLSAGHDGSIFIWDITKGTKMKHYFNMIEGQGHGAVFDCKFSQDGQHFACTDSHGHLLIFGFGCSKPYEKIPDQMFFHTDYRPLIRDSNNYVLDEQTQQAPHLMPPPFLVDVDGNPHPTKYQRLVPGRENSADEHLIPQLGYVATSDGEVIEQIISLQTNDNDERSPESSILDGMIRQLQQQQDQRMGADQDTIPRGLSNGEETPRRGFRRLSLDIQSPPNIGLRRSGQVEGVRQMHQNAPRSQIATERDLQAWKRRVVVPEVPLGIFRKLEDFRLEKGEEERNLYIIGRKRKTLQLSHKSDSVVLVSQSRQRTCRRKYPNYGRRNRSWRELSSGNESSSSVRHETSCDQSEGSGSSEEDEWRSDRKSESYSESSSDSSSRYSDWTADAGINLQPPLRTSCRRRITRFCSSSEDEISTENLSPPKRRRKRKKENKPKKENLRRMTPAELANMEHLYEFHPPVWITDTTLRKSPFVPQMGDEVIYFRQGHEAYIEAVRRNNIYELNPNKEPWRKMDLRDQELVKIVGIRYEVGPPTLCCLKLAFIDPATGKLMDKSFSIRYHDMPDVIDFLVLRQFYDEARQRNWQSCDRFRSIIDDAWWFGTVLSQEPYQPQYPDSHFQCYIVRWDNTEIEKLSPWDMEPIPDNVDPPEELGASISVTTDELEKLLYKPQAGEWGQKSRDEECDRIISGIDQLLNLDIAAAFAGPVDLCTYPKYCTVVAYPTDLYTIRMRLVNRFYRRLSALVWEVRYIEHNARTFNEPESVIARSAKKITDQLLKFIKNQHCTNISELSNTSENDEQNAEDLDDSDLPKTSSGRRRVHDGKKSIRATNYVESNWKKQCKELVNLIFQCEDSEPFRQPVDLVEYPDYRDIIDTPMDFGTVRETLDAGNYDSPLEFCKDIRLIFSNAKAYTPNKRSKIYSMTLRLSALFEEKMKKISSDFKIGQKFNEKLRRSQRFKQRQNCKGDSQPNKSIRNLKPKRLKSQTKIIPELVGSPTQSTSSRTAYLGTHKTSAGISSGVTSGDSSDSAESSERRKRNRPITNGSTLSESEVEDSLATSLSSSASSSSEESKESSRARESSSRSGLSRSSNLRVTRTRAAQRKTGPVSLANGCGRKATRKRVYLSDSDNNSLETGEILKARAGNNRKVLRKCAAVAANKIKLMSDVEENSSSESVCSGRKLPHRNASAVARKKLLHNSEDEQSLKSEIEEEELKDENQPLPVSSSHTAQSNVDESENRDSESESDLRVARKNWHANGYKSHTPAPSKTKFLKIESSEEDSKSHDSDHACNRTAGPSTSVQKLKAESISEEADSEPGRSGGRKYNTFHKNASFFKKTKILSDSEDSESEEQDREDGKCHKMEMNPISGNLNCDPIAMSQCSSDHGCETDLDSDDDKIEKPNNFMKDSASQDNGLSRKISRKRVCSSDSDSSLQVVKKSSKARTGLLRITRRCAATAANKIKLMSDVEDVSLENVHTRSKNGRKKPLHLACTTAKKKLSDCEGSVHCEVPSEQYACEGKPPDPDSEGSTKVLSQALNGDSDSEDMLNSEHKHRHTNIHKIDAPSKRKSSSVTSSGEDSKSHIPGSETDRTFSSESTLAQKATAENNFEVELNYGLRRWNGRRLRTYGKAPFSKTKVIHDSQETAEKEVKRKRSHPELENVKISETTGNSKFRPDTSSKSSDLGSVTESDIDCTDNTKTKRRKTKGKAKVVRKGKTFTANISKTVRRQRQSKRPRLSVDDNDWEDLDYAKSKRVLRRSKIKTRNQGRRTVRYHDGDDDRSLENVLDFNGCTL

SEQ ID NO: 838762 - protein, 169 aa, Homo sapiens
GPGGAHGMGGGGGGGGARLRRGDASPVRPRRGLHAPLARSLPPPAPRPAMAEPSSARRPVPLIESELYFLIARYLSAGPCRRAAQVLVQELEQYQLLPKRLDWEGNEHNRSYEELVLSNKHVAPDHLLQICQRIGPMLDKEIPPSISRVTSLLGAGRQSLLRTAKGTLI

SEQ ID NO: 838763 - protein, 2401 aa, Homo sapiens
GPGGAHGIGGGGGGGGARLRRGDASPVRPRRGLHAPLARSLPPPAPRPAMAEPSSARRPVPLIESELYFLIARYLSAGPCRRAAQVLVQELEQYQLLPKRLDWEGNEHNRSYEELVLSNKHVAPDHLLQICQRIGPMLDKEIPPSISRVTSLLGAGRQSLLRTAKDCRHTVWKGSAFAALHRGRPPEMPVNYGSPPNLVEIHRGKQLTGCSTFSTAFPGTMYQHIKMHRRILGHLSAVYCVAFDRTGHRIFTGSDDCLVKIWSTHNGRLLSTLRGHSAEISDMAVNYENTMIAAGSCDKIIRVWCLRTCAPVAVLQGHTGSITSLQFSPMAKGSQRYMVSTGADGTVCFWQWDLESLKFSPRPLKFTEKPRPGVQMLCSSFSVGGMFLATGSTDHVIRMYFLGFEAPEKIAELESHTDKVDSIQFCNNGDRFLSGSRDGTARIWRFEQLEWRSILLDMATRISGDLSSEEERFMKPKVTMIAWNQNDSIVVTAVNDHVLKVWNSYTGQLLHNLMVGNFWYNVTNEDFLKYDCNFEAIKIIYGTSCFSHVNYEMIRNFYNYKLLSNTFLKVYAVTVCIFKFSICNLKTLLNVMTLLNKGHADEVFVLETHPFDSRIMLSAGHDGSIFIWDITKGTKMKHYFNMIEGQGHGAVFDCKFSQDGQHFACTDSHGHLLIFGFGCSKPYEKIPDQMFFHTDYRPLIRDSNNYVLDEQTQQAPHLMPPPFLVDVDGNPHPTKYQRLVPGRENSADEHLIPQLGYVATSDGEVIEQIISLQTNDNDERSPESSILDGMIRQLQQQQDQRMGADQDTIPRGLSNGEETPRRGFRRLSLDIQSPPNIGLRRSGQVEGVRQMHQNAPRSQIATERDLQAWKRRVVVPEVPLGIFRKLEDFRLEKGEEERNLYIIGRKRKTLQLSHKSDSVVLVSQSRQRTCRRKYPNYGRRNRSWRELSSGNESSSSVRHETSCDQSEGSGSSEEDEWRSDRKSESYSESSSDSSSRYSDWTADAGINLQPPLRTSCRRRITRFCSSSEDEISTENLSPPKRRRKRKKENKPKKENLRRMTPAELANMEHLYEFHPPVWITDTTLRKSPFVPQMGDEVIYFRQGHEAYIEAVRRNNIYELNPNKEPWRKMDLRDQELVKIVGIRYEVGPPTLCCLKLAFIDPATGKLMDKSFSIRYHDMPDVIDFLVLRQFYDEARQRNWQSCDRFRSIIDDAWWFGTVLSQEPYQPQYPDSHFQCYIVRWDNTEIEKLSPWDMEPIPDNVDPPEELGASISVTTDELEKLLYKPQAGEWGQKSRDEECDRIISGIDQLLNLDIAAAFAGPVDLCTYPKYCTVVAYPTDLYTIRMRLVNRFYRRLSALVWEVRYIEHNARTFNEPESVIARSAKKITDQLLKFIKNQHCTNISELSNTSENDEQNAEDLDDSDLPKTSSGRRRVHDGKKSIRATNYVESNWKKQCKELVNLIFQCEDSEPFRQPVDLVEYPDYRDIIDTPMDFGTVRETLDAGNYDSPLEFCKDIRLIFSNAKAYTPNKRSKIYSMTLRLSALFEEKMKKISSDFKIGQKFNEKLRRSQRFKQRQNCKGDSQPNKSIRNLKPKRLKSQTKIIPELVGSPTQSTSSRTAYLGTHKTSAGISSGVTSGDSSDSAESSERRKRNRPITNGSTLSESEVEDSLATSLSSSASSSSEESKESSRARESSSRSGLSRSSNLRVTRTRAAQRKTGPVSLANGCGRKATRKRVYLSDSDNNSLETGEILKARAGNNRKVLRKCAAVAANKIKLMSDVEENSSSESVCSGRKLPHRNASAVARKKLLHNSEDEQSLKSEIEEEELKDENQPLPVSSSHTAQSNVDESENRDSESESDLRVARKNWHANGYKSHTPAPSKTKFLKIESSEEDSKSHDSDHACNRTAGPSTSVQKLKAESISEEADSEPGRSGGRKYNTFHKNASFFKKTKILSDSEDSESEEQDREDGKCHKMEMNPISGNLNCDPIAMSQCSSDHGCETDLDSDDDKIEKPNNFMKDSASQDNGLSRKISRKRVCSSDSDSSLQVVKKSSKARTGLLRITRRCAATAANKIKLMSDVEDVSLENVHTRSKNGRKKPLHLACTTAKKKLSDCEGSVHCEVPSEQYACEGKPPDPDSEGSTKVLSQALNGDSDSEDMLNSEHKHRHTNIHKIDAPSKRKSSSVTSSGEDSKSHIPGSETDRTFSSESTLAQKATAENNFEVELNYGLRRWNGRRLRTYGKAPFSKTKVIHDSQETAEKEVKRKRSHPELENVKISETTGNSKFRPDTSSKSSDLGSVTESDIDCTDNTKTKRRKTKGKAKVVRKGKTFTANISKTVRRQRQSKRPRLSVDDNDWEDLDYAKSKRVLRRSKIKTRNQGRRTVRYHDGDDDRSLENVLDFNGCTL

SEQ ID NO: 838764 - protein, 169 aa, Homo sapiens; identical to SEQ ID NO: 838762

SEQ ID NO: 838765 - protein, 1361 aa, Homo sapiens
GPGGAHGIGGGGGGGGARLRRGDASPVRPRRGLHAPLARSLPPPAPRPAMAEPSSARRPVPLIESELYFLIARYLSAGPCRRAAQVLVQELEQYQLLPKRLDWEGNEHNRSYEELVLSNKHVAPDHLLQICQRIGPMLDKEIPPSISRVTSLLGAGRQSLLRTAKDCRHTVWKGSAFAALHRGRPPEMPVNYGSPPNLVEIHRGKQLTGCSTFSTAFPGTMYQHIKMHRRILGHLSAVYCVAFDRTGHRIFTGSDDCLVKIWSTHNGRLLSTLRGHSAEISDMAVNYENTMIAAGSCDKIIRVWCLRTCAPVAVLQGHTGSITSLQFSPMAKGSQRYMVSTGADGTVCFWQWDLESLKFSPRPLKFTEKPRPGVQMLCSSFSVGGMFLATGSTDHVIRMYFLGFEAPEKIAELESHTDKVDSIQFCNNGDRFLSGSRDGTARIWRFEQLEWRSILLDMATRISGDLSSEEERFMKPKVTMIAWNQNDSIVVTAVNDHVLKVWNSYTGQLLHNLMVGNFWYNVTNEDFLKYDCNFEAIKIIYGTSCFSHVNYEMIRNFYNYKLLSNTFLKVYAVTVCIFKFSICNLKTLLNVMTLLNKGHADEVFVLETHPFDSRIMLSAGHDGSIFIWDITKGTKMKHYFNMIEGQGHGAVFDCKFSQDGQHFACTDSHGHLLIFGFGCSKPYEKIPDQMFFHTDYRPLIRDSNNYVLDEQTQQAPHLMPPPFLVDVDGNPHPTKYQRLVPGRENSADEHLIPQLGYVATSDGEVIEQIISLQTNDNDERSPESSILDGMIRQLQQQQDQRMGADQDTIPRGLSNGEETPRRGFRRLSLDIQSPPNIGLRRSGQVEGVRQMHQNAPRSQIATERDLQAWKRRVVVPEVPLGIFRKLEDFRLEKGEEERNLYIIGRKRKTLQLSHKSDSVVLVSQSRQRTCRRKYPNYGRRNRSWRELSSGNESSSSVRHETSCDQSEGSGSSEEDEWRSDRKSESYSESSSDSSSRYSDWTADAGINLQPPLRTSCRRRITRFCSSSEDEISTENLSPPKRRRKRKKENKPKKENLRRMTPAELANMEHLYEFHPPVWITDTTLRKSPFVPQMGDEVIYFRQGHEAYIEAVRRNNIYELNPNKEPWRKMDLRDQELVKIVGIRYEVGPPTLCCLKLAFIDPATGKLMDKSFSIRYHDMPDVIDFLVLRQFYDEARQRNWQSCDRFRSIIDDAWWFGTVLSQEPYQPQYPDSHFQCYIVRWDNTEIEKLSPWDMEPIPDNVDPPEELGASISVTTDELEKLLYKPQAGEWGQKSRDEECDRIISGIDQLLNLDIAAAFAGPVDLCTYPKYCTVVAYPTDLYTIRMRLVNRFYRLVETCFQNV

SEQ ID NO: 838766 - protein, 2369 aa, Homo sapiens
GPGGAHGMGGGGGGGGARLRRGDASPVRPRRGLHAPLARSLPPPAPRPAMAEPSSARRPVPLIESELYFLIARYLSAGPCRRAAQVLVQELEQYQLLPKRLDWEGNEHNRSYEELVLSNKHVAPDHLLQICQRIGPMLDKEIPPSISRVTSLLGAGRQSLLRTAKDCRHTVWKGSAFAALHRGRPPEMPVNYGSPPNLVEIHRGKQLTGCSTFSTAFPGTMYQHIKMHRRILGHLSAVYCVAFDRTGHRIFTGSDDCLVKIWSTHNGRLLSTLRGHSAEISDMAVNYENTMIAAGSCDKIIRVWCLRTCAPVAVLQGHTGSITSLQFSPMAKGSQRYMVSTGADGTVCFWQWDLESLKFSPRPLKFTEKPRPGVQMLCSSFSVGGMFLATGSTDHVIRMYFLGFEAPEKIAELESHTDKVDSIQFCNNGDRFLSGSRDGTARIWRFEQLEWRSILLDMATRISGDLSSEEERFMKPKVTMIAWNQNDSIVVTAVNDHVLKVWNSYTGQLLHNLMGHADEVFVLETHPFDSRIMLSAGHDGSIFIWDITKGTKMKHYFNMIEGQGHGAVFDCKFSQDGQHFACTDSHGHLLIFGFGCSKPYEKIPDQMFFHTDYRPLIRDSNNYVLDEQTQQAPHLMPPPFLVDVDGNPHPTKYQRLVPGRENSADEHLIPQLGYVATSDGEVIEQIISLQTNDNDERSPESSILDGMIRQLQQQQDQRMGADQDTIPRGLSNGEETPRRGFRRLSLDIQSPPNIGLRRSGQVEGVRQMHQNAPRSQIATERDLQAWKRRVVVPEVPLGIFRKLEDFRLEKGEEERNLYIIGRKRKTLQLSHKSDSVVLVSQSRQRTCRRKYPNYGRRNRSWRELSSGNESSSSVRHETSCDQSEGSGSSEEDEWRSDRKSESYSESSSDSSSRYSDWTADAGINLQPPLRTSCRRRITRFCSSSEDEISTENLSPPKRRRKRKKENKPKKENLRRMTPAELANMEHLYEFHPPVWITDTTLRKSPFVPQMGDEVIYFRQGHEAYIEAVRRNNIYELNPNKEPWRKMDLRDQELVKIVGIRYEVGPPTLCCLKLAFIDPATGKLMDKSFSIRYHDMPDVIDFLVLRQFYDEARQRNWQSCDRFRSIIDDAWWFGTVLSQEPYQPQYPDSHFQCYIVRWDNTEIEKLSPWDMEPIPDNVDPPEELGASISVTTDELEKLLYKPQAGEWGQKSRDEECDRIISGIDQLLNLDIAAAFAGPVDLCTYPKYCTVVAYPTDLYTIRMRLVNRFYRRLSALVWEVRYIEHNARTFNEPESVIARSAKKITDQLLKFIKNQHCTNISELSNTSENDEQNAEDLDDSDLPKTSSGRRRVHDGKKSIRATNYVESNWKKQCKELVNLIFQCEDSEPFRQPVDLVEYPDYRDIIDTPMDFGTVRETLDAGNYDSPLEFCKDIRLIFSNAKAYTPNKRSKIYSMTLRLSALFEEKMKKISSDFKIGQKFNEKLRRSQRFKQRQNCKGDSQPNKSIRNLKPKRLKSQTKIIPELVGSPTQSTSSRTAYLGTHKTSAGISSGVTSGDSSDSAESSERRKRNRPITNGSTLSESEVEDSLATSLSSSASSSSEESKESSRARESSSRSGLSRSSNLRVTRTRAAQRKTGPVSLANGCGRKATRKRVYLSDSDNNSLETGEILKARAGNNRKVLRKCAAVAANKIKLMSDVEENSSSESVCSGRKLPHRNASAVARKKLLHNSEDEQSLKSEIEEEELKDENQPLPVSSSHTAQSNVDESENRDSESESDLRVARKNWHANGYKSHTPAPSKTKFLKIESSEEDSKSHDSDHACNRTAGPSTSVQKLKAESISEEADSEPGRSGGRKYNTFHKNASFFKKTKILSDSEDSESEEQDREDGKCHKMEMNPISGNLNCDPIAMSQCSSDHGCETDLDSDDDKIEKPNNFMKDSASQDNGLSRKISRKRVCSSDSDSSLQVVKKSSKARTGLLRITRRCAATAANKIKLMSDVEDVSLENVHTRSKNGRKKPLHLACTTAKKKLSDCEGSVHCEVPSEQYACEGKPPDPDSEGSTKVLSQALNGDSDSEDMLNSEHKHRHTNIHKIDAPSKRKSSSVTSSGEDSKSHIPGSETDRTFSSESTLAQKATAENNFEVELNYGLRRWNGRRLRTYGKAPFSKTKVIHDSQETAEKEVKRKRSHPELENVKISETTGNSKFRPDTSSKSSDLGSVTESDIDCTDNTKTKRRKTKGKAKVVRKEFVPRDREPNTKVRTCMHNQKDAVQMPSETLKAKMVPEKVPRRCATVAANKIKIMSNLKETISGPENVWIRKSSRKLPHRNASAAAKKKLLNVYKEDDTTINSESEKELEDINRKMLFLRGFRSWKENAQ

SEQ ID NO: 838767 - protein, 2318 aa, Homo sapiens; identical to SEQ ID NO: 838761

SEQ ID NO: 838768 - protein, 169 aa, Homo sapiens; identical to SEQ ID NO: 838762

SEQ ID NO: 838769 - protein, 169 aa, Homo sapiens; identical to SEQ ID NO: 838762

SEQ ID NO: 838770 - protein, 392 aa, Homo sapiens
GPGGAHGMGGGGGGGGARLRRGDASPVRPRRGLHAPLARSLPPPAPRPAMAEPSSARRPVPLIESELYFLIARYLSAGPCRRAAQVLVQELEQYQLLPKRLDWEGNEHNRSYEELVLSNKHVAPDHLLQICQRIGPMLDKEIPPSISRVTSLLGAGRQSLLRTAKDCRHTVWKGSAFAALHRGRPPEMPVNYGSPPNLVEIHRGKQLTGCSTFSTAFPGTMYQHIKMHRRILGHLSAVYCVAFDRTGHRIFTGSDDCLVKIWSTHNGRLLSTLRGHSAEISDMAVNYENTMIAAGSCDKIIRVWCLRTCAPVAVLQGHTGSITSLQFSPMAKGSQRYMVSTGADGTVCFWQWDLESLKFSPRPLKFTEKPRPGVQMLCSSFSVGKNFFTFFS

SEQ ID NO: 838771 - protein, 1446 aa, Homo sapiens
PLSPSTPTRRPPFTRGRLRLLSFRSMEEARLVPTVKEKYPVLKDVMDFIKDQSLSHRSVVKVLSLRKAQAQSILEVLKITQHCAESLGQPHCFHPPFILFLLELLTCQKDFTNYFGHLEGCGADLHKEIRDTYYQLVLFLVKAVKGFSSLNDRSLLPALSCVQTALLHLLDMGWEPNDLAFFVDIQLPDLLMKMSQENISVHDSVISQWSEEDELADAKQNSEWMDECQDGMFEAWYEKIAQEDPEKQRKMHMFIARYCDLLNVDISCDGCDEIAPWHRYRCLQCSDMDLCKTCFLGGVKPEGHGDDHEMVNMEFTCDHCQGLIIGRRMNCNVCDDFDLCYGCYAAKKYSYGHLPTHSITAHPMVTIRISDRQRLIQPYIHNYSWLLFAALALYSAHLASAEDVDGEKLDPQTRSSATTLRSQCMQLVGDCLMKAHQGKGLKALALLGVLPDGDSSLEDQALPVTVPTGASEEQLEKKAVQGAELSEAGNGKRAVHEEIRPVDFKQRNKADKGVSLSKDPSCQTQISDSPADASPPTGLPDAEDSEVSSQKPIEEKAVTPSPEQVFAECSQKRILGLLAAMLPPLKSGPTVPLIDLEHVLPLMFQVVISNAGHLNETYHLTLGLLGQLIIRLLPAEVDAAVIKVLSAKHNLFAAGDSSIVPDGWKTTHLLFSLGAVCLDSRVGLDWACSMAEILRSLNSAPLWRDVIATFTDHCIKQLPFQLKHTNIFTLLVLVGFPQVLCVGTRCVYMDNANEPHNVIILKHFTEKNRAVIVDVKTRKRKTVKDYQLVQKGGGQECGDSRAQLSQYSQHFAFIASHLLQSSMDSHCPEAVEATWVLSLALKGLYKTLKAHGFEEIRATFLQTDLLKLLVKKCSKGTGFSKTWLLRDLEILSIMLYSSKKEINALAEHGDLELDERGDREEEVERPVSSPGDPEQKKLDPLEGLDEPTRICFLMAHDALNAPLHILRAIYELQMKKTDYFFLEVQKRFDGDELTTDERIRSLAQRWQPSKSLRLEEQSAKAVDTDMIILPCLSRPARCDQATAESNPVTQKLISSTESELQQSYAKQRRSKSAALLHKELNCKSKRAVRDYLFRVNEATAVLYARHVLASLLAEWPSHVPVSEDILELSGPAHMTYILDMFMQLEEKHEWEKILQKVLQGCREDMLGTMALAACQFMEEPGMEVQVRESKHPYNNNTNFEDKVHIPGAIYLSIKFDSQCNTEEGCDELAMSSSSDFQQDRHSFSGSQQKWKDFELPGDTLYYRFTSDMSNTEWGYRFTVTAGHLGRFQTGFEILKQMLSEERVVPHLPLAKIWEWLVGVACRQTGHQRLKAIHLLLRIVRCCGHSDLCDLALLKPLWQLFTHMEYGLFEDVTQPGILLPLHRALTELFFVTENRAQELGVLQDYLLALTTDDHLLRCAAQALQNIAAISLAINYPNKATRLWNVEC

SEQ ID NO: 838772 - protein, 1403 aa, Homo sapiens
PLSPSTPTRRPPFTRGRLRLLSFRSMEEARLVPTVKEKYPVLKDVMDFIKDQSLSHRSVVKVLSLRKAQAQSILEVLKITQHCAESLGQPHCFHPPFILFLLELLTCQKDFTNYFGHLEGCGADLHKEIRDTYYQLVLFLVKAVKGFSSLNDRSLLPALSCVQTALLHLLDMGWEPNDLAFFVDIQLPDLLMKMSQENISVHDSVISMHMFIARYCDLLNVDISCDGCDEIAPWHRYRCLQCSDMDLCKTCFLGGVKPEGHGDDHEMVNMEFTCDHCQGLIIGRRMNCNVCDDFDLCYGCYAAKKYSYGHLPTHSITAHPMVTIRISDRQRLIQPYIHNYSWLLFAALALYSAHLASAEDVDGEKLDPQTRSSATTLRSQCMQLVGDCLMKAHQGKGLKALALLGVLPDGDSSLEDQALPVTVPTGASEEQLEKKAVQGAELSEAGNGKRAVHEEIRPVDFKQRNKADKGVSLSKDPSCQTQISDSPADASPPTGLPDAEDSEVSSQKPIEEKAVTPSPEQVFAECSQKRILGLLAAMLPPLKSGPTVPLIDLEHVLPLMFQVVISNAGHLNETYHLTLGLLGQLIIRLLPAEVDAAVIKVLSAKHNLFAAGDSSIVPDGWKTTHLLFSLGAVCLDSRVGLDWACSMAEILRSLNSAPLWRDVIATFTDHCIKQLPFQLKHTNIFTLLVLVGFPQVLCVGTRCVYMDNANEPHNVIILKHFTEKNRAVIVDVKTRKRKTVKDYQLVQKGGGQECGDSRAQLSQYSQHFAFIASHLLQSSMDSHCPEAVEATWVLSLALKGLYKTLKAHGFEEIRATFLQTDLLKLLVKKCSKGTGFSKTWLLRDLEILSIMLYSSKKEINALAEHGDLELDERGDREEEVERPVSSPGDPEQKKLDPLEGLDEPTRICFLMAHDALNAPLHILRAIYELQMKKTDYFFLEVQKRFDGDELTTDERIRSLAQRWQPSKSLRLEEQSAKAVDTDMIILPCLSRPARCDQATAESNPVTQKLISSTESELQQSYAKQRRSKSAALLHKELNCKSKRAVRDYLFRVNEATAVLYARHVLASLLAEWPSHVPVSEDILELSGPAHMTYILDMFMQLEEKHEWEKILQKVLQGCREDMLGTMALAACQFMEEPGMEVQVRESKHPYNNNTNFEDKVHIPGAIYLSIKFDSQCNTEEGCDELAMSSSSDFQQDRHSFSGSQQKWKDFELPGDTLYYRFTSDMSNTEWGYRFTVTAGHLGRFQTGFEILKQMLSEERVVPHLPLAKIWEWLVGVACRQTGHQRLKAIHLLLRIVRCCGHSDLCDLALLKPLWQLFTHMEYGLFEDVTQPGILLPLHRALTELFFVTENRAQELGVLQDYLLALTTDDHLLRCAAQALQNIAAISLAINYPNKATRLWNVEC

SEQ ID NO: 838773 - protein, 1348 aa, Homo sapiens
MFWQLSESVISSVSSYFGHLEGCGADLHKEIRDTYYQLVLFLVKAVKGFSSLNDRSLLPALSCVQTALLHLLDMGWEPNDLAFFVDIQLPDLLMKMSQENISVHDSVISQWSEEDELADAKQNSEWMDECQDGMFEAWYEKIAQEDPEKQRKMHMFIARYCDLLNVDISCDGCDEIAPWHRYRCLQCSDMDLCKTCFLGGVKPEGHGDDHEMVNMEFTCDHCQGLIIGRRMNCNVCDDFDLCYGCYAAKKYSYGHLPTHSITAHPMVTIRISDRQRLIQPYIHNYSWLLFAALALYSAHLASAEDVDGEKLDPQTRSSATTLRSQCMQLVGDCLMKAHQGKGLKALALLGVLPDGDSSLEDQALPVTVPTGASEEQLEKKAVQGAELSEAGNGKRAVHEEIRPVDFKQRNKADKGVSLSKDPSCQTQISDSPADASPPTGLPDAEDSEVSSQKPIEEKAVTPSPEQVFAECSQKRILGLLAAMLPPLKSGPTVPLIDLEHVLPLMFQVVISNAGHLNETYHLTLGLLGQLIIRLLPAEVDAAVIKVLSAKHNLFAAGDSSIVPDGWKTTHLLFSLGAVCLDSRVGLDWACSMAEILRSLNSAPLWRDVIATFTDHCIKQLPFQLKHTNIFTLLVLVGFPQVLCVGTRCVYMDNANEPHNVIILKHFTEKNRAVIVDVKTRKRKTVKDYQLVQKGGGQECGDSRAQLSQYSQHFAFIASHLLQSSMDSHCPEAVEATWVLSLALKGLYKTLKAHGFEEIRATFLQTDLLKLLVKKCSKGTGFSKTWLLRDLEILSIMLYSSKKEINALAEHGDLELDERGDREEEVERPVSSPGDPEQKKLDPLEGLDEPTRICFLMAHDALNAPLHILRAIYELQMKKTDYFFLEVQKRFDGDELTTDERIRSLAQRWQPSKSLRLEEQSAKAVDTDMIILPCLSRPARCDQATAESNPVTQKLISSTESELQQSYAKQRRSKSAALLHKELNCKSKRAVRDYLFRVNEATAVLYARHVLASLLAEWPSHVPVSEDILELSGPAHMTYILDMFMQLEEKHEWEKILQKVLQGCREDMLGTMALAACQFMEEPGMEVQVRESKHPYNNNTNFEDKVHIPGAIYLSIKFDSQCNTEEGCDELAMSSSSDFQQDRHSFSGSQQKWKDFELPGDTLYYRFTSDMSNTEWGYRFTVTAGHLGRFQTGFEILKQMLSEERVVPHLPLAKIWEWLVGVACRQTGHQRLKAIHLLLRIVRCCGHSDLCDLALLKPLWQLFTHMEYGLFEDVTQPGILLPLHRALTELFFVTENRAQELGVLQDYLLALTTDDHLLRCAAQALQNIAAISLAINYPNKATRLWNVEC

SEQ ID NO: 838774 - protein, 1427 aa, Homo sapiens
PLSPSTPTRRPPFTRGRLRLLSFRSMEEARLVPTVKEKYPVLKDVMDFIKDQSLSHRSVVKVLSLRKAQAQSILEVLKITQHCAESLGQPHCFHPPFILFLLELLTCQKDFTNYFGHLEGCGADLHKEIRDTYYQLVLFLVKAVKGFSSLNDRSLLPALSCVQTALLHLLDMGWEPNDLAFFVDIQLPDLLMKMSQENISVHDSVISQWSEEDELADAKQNSEWMDECQDGMFEAWYEKIAQEDPEKQRKMHMFIARYCDLLNVDISCDGCDEIAPWHRYRCLQCSDMDLCKTCFLGGVKPEGHGDDHEMVNMEFTCDHCQGLIIGRRMNCNVCDDFDLCYGCYAAKKYSYGHLPTHSITAHPMVTIRISDRQRLIQPYIHNYSWLLFAALALYSAHLASAEDVDGEKLDPQTRSSATTLRSQCMQLVGDCLMKAHQGKGLKALALLGVLPDGDSSLEDQALPVTVPTGASEEQLEKKAVQGAELSEAGNGKRAVHEEIRPVDFKQRNKADKGVSLSKDPSCQTQISDSPADASPPTGLPDAEDSEVSSQKPIEEKAVTPSPEQVFAECSQKRILGLLAAMLPPLKSGPTVPLIDLEHVLPLMFQVVISNAGHLNETYHLTLGLLGQLIIRLLPAEVDAAVIKVLSAKHNLFAAGDSSIVPDGWKTTHLLFSLGAVCLDSRVGLDWACSMAEILRSLNSAPLWRDVIATFTDHCIKQLPFQLKHTNIFTLLVLVGFPQVLCVGTRCVYMDNANEPHNVIILKHFTEKNRAVIVDVKTRKRKTVKDYQLVQKGGGQECGDSRAQLSQYSQHFAFIASHLLQSSMDSHCPEAVEATWVLSLALKGLYKTLKAHGFEEIRATFLQTDLLKLLVKKCSKGTGFSKTWLLRDLEILSIMLYSSKKEINALAEHGDLELDERGDREEEVERPVSSPGDPEQKKLDPLEGLDEPTRICFLMAHDALNAPLHILRAIYELQMKKTDYFFLEVQKRFDGDELTTDERIRSLAQRWQPSKSLRLEEQSAKAVDTDMIILPCLSRPARCDQATAESNPVTQKLISSTESELQQSYAKQRRSKSAALLHKELNCKSKRAVRDYLFRVNEATAVLYARHVLASLLAEWPSHVPVSEDILELSGPAHMTYILDMFMQLEEKHEWEKILQKVLQGCREDMLGTMALAACQFMEEPGMEVQVRESKHPYNNNTNFEDKVHIPGAIYLSIKFDSQCNTEEGCDELAMSSSSDFQQDRHSFSGSQQKWKDFELPGDTLYYRFTSDMSNTEWGYRFTVTAGHLGRFQTGFEILKQMLSEERVVPHLPLAKIWEWLVGVACRQTGHQRLKAIHLLLRIVRCCGHSDLCDLALLKPLWQLFTHMEYGLFEDVTQPGILLPLHRALTELFFVTENRAQVRPEVWAGSPVPPCAFAPSATQGRSCCLIRA

SEQ ID NO: 838775 - protein, 754 aa, Homo sapiens
MELLPSSRVGLDWACSMAEILRSLNSAPLWRDVIATFTDHCIKQLPFQLKHTNIFTLLVLVGFPQVLCVGTRCVYMDNANEPHNVIILKHFTEKNRAVIVDVKTRKRKTVKDYQLVQKGGGQECGDSRAQLSQYSQHFAFIASHLLQSSMDSHCPEAVEATWVLSLALKGLYKTLKAHGFEEIRATFLQTDLLKLLVKKCSKGTGFSKTWLLRDLEILSIMLYSSKKEINALAEHGDLELDERGDREEEVERPVSSPGDPEQKKLDPLEGLDEPTRICFLMAHDALNAPLHILRAIYELQMKKTDYFFLEVQKRFDGDELTTDERIRSLAQRWQPSKSLRLEEQSAKAVDTDMIILPCLSRPARCDQATAESNPVTQKLISSTESELQQSYAKQRRSKSAALLHKELNCKSKRAVRDYLFRVNEATAVLYARHVLASLLAEWPSHVPVSEDILELSGPAHMTYILDMFMQLEEKHEWEKILQKVLQGCREDMLGTMALAACQFMEEPGMEVQVRESKHPYNNNTNFEDKVHIPGAIYLSIKFDSQCNTEEGCDELAMSSSSDFQQDRHSFSGSQQKWKDFELPGDTLYYRFTSDMSNTEWGYRFTVTAGHLGRFQTGFEILKQMLSEERVVPHLPLAKIWEWLVGVACRQTGHQRLKAIHLLLRIVRCCGHSDLCDLALLKPLWQLFTHMEYGLFEDVTQPGILLPLHRALTELFFVTENRAQVRPEVWAGSPVPPCAFAPSATQGRSCCLIRA

SEQ ID NO: 838776 - protein, 909 aa, Homo sapiens
PLSPSTPTRRPPFTRGRLRLLSFRSMEEARLVPTVKEKYPVLKDVMDFIKDQSLSHRSVVKVLSLRKAQAQSILEVLKITQHCAESLGQPHCFHPPFILFLLELLTCQKDFTNYFGHLEGCGADLHKEIRDTYYQLVLFLVKAVKGFSSLNDRSLLPALSCVQTALLHLLDMGWEPNDLAFFVDIQLPDLLMKMSQENISVHDSVISQWSEEDELADAKQNSEWMDECQDGMFEAWYEKIAQEDPEKQRKMHMFIARYCDLLNVDISCDGCDEIAPWHRYRCLQCSDMDLCKTCFLGGVKPEGHGDDHEMVNMEFTCDHCQGLIIGRRMNCNVCDDFDLCYGCYAAKKYSYGHLPTHSITAHPMVTIRISDRQRLIQPYIHNYSWLLFAALALYSAHLASAEDVDGEKLDPQTRSSATTLRSQCMQLVGDCLMKAHQGKGLKALALLGVLPDGDSSLEDQALPVTVPTGASEEQLEKKAVQGAELSEAGNGKRAVHEEIRPVDFKQRNKADKGVSLSKDPSCQTQISDSPADASPPTGLPDAEDSEVSSQKPIEEKAVTPSPEQVFAECSQKRILGLLAAMLPPLKSGPTVPLIDLEHVLPLMFQVVISNAGHLNETYHLTLGLLGQLIIRLLPAEVDAAVIKVLSAKHNLFAAGDSSIVPDGWKTTHLLFSLGAVCLDSRVGLDWACSMAEILRSLNSAPLWRDVIATFTDHCIKQLPFQLKHTNIFTLLVLVGFPQVLCVGTRCVYMDNANEPHNVIILKHFTEKNRAVIVDVKTRKRKTVKDYQLVQKGGGQECGDSRAQLSQYSQHFAFIASHLLQSSMDSHCPEAVEATWVLSLALKGLYKTLKAHGFEEIRATFLQTDLLKLLVKKCSKGTGFSKTWLLRDLEVRDERDSCSSFLVQMCWPRS

SEQ ID NO: 838777 - protein, 1427 aa, Homo sapiens; identical to SEQ ID NO: 838774

SEQ ID NO: 838778 - protein, 77 aa, Homo sapiens
PPPSCCPDPEGLTGLASPPGHLSALLALFSLLPLVPSTGCSFPVSALPFPTCIFALFSPGPEEAKPAEQRWKHVPTL

SEQ ID NO: 838779 - protein, 1247 aa, Homo sapiens
MSKMIGSMSEALVEERDFDGQKGESRKDKIFQKLKTQIGLEPEQILQKQRTMHMFIARYCDLLNVDISCDGCDEIAPWHRYRCLQCSDMDLCKTCFLGGVKPEGHGDDHEMVNMEFTCDHCQGLIIGRRMNCNVCDDFDLCYGCYAAKKYSYGHLPTHSITAHPMVTIRISDRQRLIQPYIHNYSWLLFAALALYSAHLASAEDVDGEKLDPQTRSSATTLRSQCMQLVGDCLMKAHQGKGLKALALLGVLPDGDSSLEDQALPVTVPTGASEEQLEKKAVQGAELSEAGNGKRAVHEEIRPVDFKQRNKADKGVSLSKDPSCQTQISDSPADASPPTGLPDAEDSEVSSQKPIEEKAVTPSPEQVFAECSQKRILGLLAAMLPPLKSGPTVPLIDLEHVLPLMFQVVISNAGHLNETYHLTLGLLGQLIIRLLPAEVDAAVIKVLSAKHNLFAAGDSSIVPDGWKTTHLLFSLGAVCLDSRVGLDWACSMAEILRSLNSAPLWRDVIATFTDHCIKQLPFQLKHTNIFTLLVLVGFPQVLCVGTRCVYMDNANEPHNVIILKHFTEKNRAVIVDVKTRKRKTVKDYQLVQKGGGQECGDSRAQLSQYSQHFAFIASHLLQSSMDSHCPEAVEATWVLSLALKGLYKTLKAHGFEEIRATFLQTDLLKLLVKKCSKGTGFSKTWLLRDLEILSIMLYSSKKEINALAEHGDLELDERGDREEEVERPVSSPGDPEQKKLDPLEGLDEPTRICFLMAHDALNAPLHILRAIYELQMKKTDYFFLEVQKRFDGDELTTDERIRSLAQRWQPSKSLRLEEQSAKAVDTDMIILPCLSRPARCDQATAESNPVTQKLISSTESELQQSYAKQRRSKSAALLHKELNCKSKRAVRDYLFRVNEATAVLYARHVLASLLAEWPSHVPVSEDILELSGPAHMTYILDMFMQLEEKHEWEKILQKVLQGCREDMLGTMALAACQFMEEPGMEVQVRESKHPYNNNTNFEDKVHIPGAIYLSIKFDSQCNTEEGCDELAMSSSSDFQQDRHSFSGSQQKWKDFELPGDTLYYRFTSDMSNTEWGYRFTVTAGHLGRFQTGFEILKQMLSEERVVPHLPLAKIWEWLVGVACRQTGHQRLKAIHLLLRIVRCCGHSDLCDLALLKPLWQLFTHMEYGLFEDVTQPGILLPLHRALTELFFVTENRAQELGVLQDYLLALTTDDHLLRCAAQALQNIAAISLAINYPNKATRLWNVEC

SEQ ID NO: 838780 - protein, 169 aa, Homo sapiens
MGLVLPWSADDDSPSRATLGNMKQVWRVGCVPALVGPVGLEHAFRGSVWAEARPTTQCQSQRRGPTTKAKLDQVSIAMAQCAPWPLKIPLCRVCRDLDCKGPSLQVWKHLPIRALSPSGSGLQGAAGFTALQLGSQLSPRVLVEPSRGGWRVGFKGDGNTWGRSWNLVA

SEQ ID NO: 838781 - protein, 1427 aa, Homo sapiens; identical to SEQ ID NO: 838774

SEQ ID NO: 838782 - protein, 1157 aa, Homo sapiens
PLSPSTPTRRPPFTRGRLRLLSFRSMEEARLVPTVKEKYPVLKDVMDFIKDQSLSHRSVVKVLSLRKAQAQSILEVLKITQHCAESLGQPHCFHPPFILFLLELLTCQKDFTNYFGHLEGCGADLHKEIRDTYYQLVLFLVKAVKGFSSLNDRSLLPALSCVQTALLHLLDMGWEPNDLAFFVDIQLPDLLMKMSQENISVHDSVISQWSEEDELADAKQNSEWMDECQDGMFEAWYEKIAQEDPEKQRKMHMFIARYCDLLNVDISCDGCDEIAPWHRYRCLQCSDMDLCKTCFLGGVKPEGHGDDHEMVNMEFTCDHCQGLIIGRRMNCNVCDDFDLCYGCYAAKKYSYGHLPTHSITAHPMVTIRISDRQRLIQPYIHNYSWLLFAALALYSAHLASAEDVDGEKLDPQTRSSATTLRSQCMQLVGDCLMKAHQGKGLKALALLGVLPDGDSSLEDQALPVTVPTGASEEQLEKKAVQGAELSEAGNGKRAVHEEIRPVDFKQRNKADKGVSLSKDPSCQTQISDSPADASPPTGLPDAEDSEVSSQKPIEEKAVTPSPEQVFAECSQKRILGLLAAMLPPLKSGPTVPLIDLEHVLPLMFQVVISNAGHLNETYHLTLGLLGQLIIRLLPAEVDAAVIKVLSAKHNLFAAGDSSIVPDGWKTTHLLFSLGAVCLDSRVGLDWACSMAEILRSLNSAPLWRDVIATFTDHCIKQLPFQLKHTNIFTLLVLVGFPQVLCVGTRCVYMDNANEPHNVIILKHFTEKNRAVIVDVKTRKRKTVKDYQLVQKGGGQECGDSRAQLSQYSQHFAFIASHLLQSSMDSHCPEAVEATWVLSLALKGLYKTLKAHGFEEIRATFLQTDLLKLLVKKCSKGTGFSKTWLLRDLEILSIMLYSSKKEINALAEHGDLELDERGDREEEVERPVSSPGDPEQKKLDPLEGLDEPTRICFLMAHDALNAPLHILRAIYELQMKKTDYFFLEVQKRFDGDELTTDERIRSLAQRWQPSKSLRLEEQSAKAVDTDMIILPCLSRPARCDQATAESNPVTQKLISSTESELQQSYAKQRRSKSAALLHKELNCKSKRAVRDYLFRVNEATAVLYARHVLASLLAEWPSHVPVSEDIQGHGPQHVSRQPWSTFCRIFSHSCFSSSCMNI

SEQ ID NO: 838783 - protein, 862 aa, Homo sapiens
PLSPSTPTRRPPFTRGRLRLLSFRSMEEARLVPTVKEKYPVLKDVMDFIKDQSLSHRSVVKVLSLRKAQAQSILEVLKITQHCAESLGQPHCFHPPFILFLLELLTCQKDFTNYFGHLEGCGADLHKEIRDTYYQLVLFLVKAVKGFSSLNDRSLLPALSCVQTALLHLLDMGWEPNDLAFFVDIQLPDLLMKMSQENISVHDSVISQWSEEDELADAKQNSEWMDECQDGMFEAWYEKIAQEDPEKQRKMHMFIARYCDLLNVDISCDGCDEIAPWHRYRCLQCSDMDLCKTCFLGGVKPEGHGDDHEMVNMEFTCDHCQGLIIGRRMNCNVCDDFDLCYGCYAAKKYSYGHLPTHSITAHPMVTIRISDRQRLIQPYIHNYSWLLFAALALYSAHLASAEDVDGEKLDPQTRSSATTLRSQCMQLVGDCLMKAHQGKGLKALALLGVLPDGDSSLEDQALPVTVPTGASEEQLEKKAVQGAELSEAGNGKRAVHEEIRPVDFKQRNKADKGVSLSKDPSCQTQISDSPADASPPTGLPDAEDSEVSSQKPIEEKAVTPSPEQVFAECSQKRILGLLAAMLPPLKSGPTVPLIDLEHVLPLMFQVVISNAGHLNETYHLTLGLLGQLIIRLLPAEVDAAVIKVLSAKHNLFAAGDSSIVPDGWKTTHLLFSLGAVCLDSRVGLDWACSMAEILRSLNSAPLWRDVIATFTDHCIKQLPFQLKHTNIFTLLVLVGFPQVLCVGTRCVYMDNANEPHNVIILKHFTEKNRAVIVDVKTRKRKTVKDYQLVQKGGGQECGDSRAQLSQYSQHFAFIASHLLQSSMDSHCPEAVEATWVLSLALKGLYKTLKVMGSFSSWQWIWL

SEQ ID NO: 838784 - protein, 158 aa, Homo sapiens
MFWQLSESVISSVSSYFGHLEGCGADLHKEIRDTYYQLVLFLVKAVKGFSSLNDRSLLPALSCVQTALLHLLDMGWEPNDLAFFVDIQLPDLLMKMSQENISVHDSVISQWSEEDELADAKQNSEWMDECQDGMFEAWYEKIAQEDPEKQRKGCLNTG

SEQ ID NO: 838785 - protein, 482 aa, Homo sapiens
GGGQTCTGPGKMAAMETETAPLTLESLPTDPLLLILSFLDYRDLINCCYVSRRLSQLSSHDPLWRRHCKKYWLISEEEKTQKNQCWKSLFIDTYSDVGRYIDHYAAIKKAWDDLKKYLEPRCPRMVLSLKEGAREEDLDAVEAQIGCKLPDDYRCSYRIHNGQKLVVPGLLGSMALSNHYRSEDLLDVDTAAGGFQQRQGLKYCLPLTFCIHTGLSQYIAVEAAEGRNKNEVFYQCPDQMARNPAAIDMFIIGATFTDWFTSYVKNVVSGGFPIIRDQIFRYVHDPECVATTGDITVSVSTSFLPELSSVHPPHYFFTYRIRIEMSKDALPEKACQLDSRYWRITNAKGDVEEVQGPGVVGEFPIISPGRVYEYTSCTTFSTTSGYMEGYYTFHFLYFKDKIFNVAIPRFHMACPTFRVSIARLEMGPDEYEEMEEEEEEEEEEDEDDDSADMDESDEDDEEERRRRVFDVPIRRRRCSRLF

SEQ ID NO: 838786 - protein, 426 aa, Homo sapiens
GGGQTCTGPGKMAAMETETAPLTLESLPTDPLLLILSFLDYRDLINCCYVSRRLSQLSSHDPLWRRHCKKYWLISEEEKTQKNQCWKSLFIDTYSDVGRYIDHYAAIKKAWDDLKKYLEPRCPRMVLSLKEGAREEDLDAVEAQIGCKLPDDYRCSYRIHNGQKLVVPGLLGSMALSNHYRSEDLLDVDTAAGGFQQRQGLKYCLPLTFCIHTGLSQYIAVEAAEGRNKNEVFYQCPDQMARNPAAIDMFIIGATFTDWFTSYVKNVVSGGFPIIRDQIFRYVHDPECVATTGDITVSVSTSFLPELSSVHPPHYFFTYRIRIEMSKDALPEKACQLDSRYWRITNAKGDVEEVQGPGVVGEFPIISPGRVYEYTSCTTFSTTSGYMEGYYTFHFLYFKDKIFNVAIPRFHMACPTFRVSIARLVS

SEQ ID NO: 838787 - protein, 309 aa, Homo sapiens
MALSNHYRSEDLLDVDTAAGGFQQRQGLKYCLPLTFCIHTGLSQYIAVEAAEGRNKNEVFYQCPDQMARNPAAIDMFIIGATFTDWFTSYVKNVVSGGFPIIRDQIFRYVHDPECVATTGDITVSVSTSFLPELSSVHPPHYFFTYRIRIEMSKDALPEKACQLDSRYWRITNAKGDVEEVQGPGVVGEFPIISPGRVYEYTSCTTFSTTSGYMEGYYTFHFLYFKDKIFNVAIPRFHMACPTFRVSIARLEMGPDEYEEMEEEEEEEEEEDEDDDSADMDESDEDDEEERRRRVFDVPIRRRRCSRLF

SEQ ID NO: 838788 - protein, 225 aa, Homo sapiens
STLYTSSRLYIPGGFPIIRDQIFRYVHDPECVATTGDITVSVSTSFLPELSSVHPPHYFFTYRIRIEMSKDALPEKACQLDSRYWRITNAKGDVEEVQGPGVVGEFPIISPGRVYEYTSCTTFSTTSGYMEGYYTFHFLYFKDKIFNVAIPRFHMACPTFRVSIARLEMGPDEYEEMEEEEEEEEEEDEDDDSADMDESDEDDEEERRRRVFDVPIRRRRCSRLF

SEQ ID NO: 838789 - protein, 426 aa, Homo sapiens
GGGQTCTGPGKMAAMETETAPLTLESLPTDPLLLILSFLDYRDLINCCYVSRRLSQLSSHDPLWRRHCKKYWLISEEEKTQKNQCWKSLFIDTYSDVGRYIDHYAAIKKAWDDLKKYLEPRCPRMVLSLKEGAREEDLDAVEAQIGCKLPDDYRCSYRIHNGQKLVVPGLLGSMALSNHYRSEDLLDVDTAAGGFQQRQGLKYCLPLTFCIHTGLSQYIAVEAAEGRNKNEVFYQCPDQMARNPAAIDMFIIGATFTDWFTSYVKNVVSGGFPIIRDQIFRYVHDPECVATTGDITVSVSTSFLPELSSVHPPHYFFTYRIRIEMSKDALPEKACQLDSRYWRITNAKGDVEEVQGPGVVGEFPIISPGRVYEYTSCTTFSTTSGYMEGYYTFHFLYFKDKIFNVAIPRFHMACPTFRVSIARLFW

SEQ ID NO: 838790 - protein, 67 aa, Homo sapiens
YQKIVFSFKEMGPDEYEEMEEEEEEEEEEDEDDDSADMDESDEDDEEERRRRVFDVPIRRRRCSRLF

SEQ ID NO: 838791 - protein, 426 aa, Homo sapiens; identical to SEQ ID NO: 838789

SEQ ID NO: 838792 - protein, 482 aa, Homo sapiens; identical to SEQ ID NO: 838785

SEQ ID NO: 838793 - protein, 148 aa, Homo sapiens
GGGQTCTGPGKMAAMETETAPLTLESLPTDPLLLILSFLDYRDLINCCYVSRRLSQLSSHDPLWRRHCKKYWLISEEEKTQKNQCWKSLFIDTYSDVGRYIDHYAAIKKAWDDLKKYLEPRCPRMVLSLKGACSRASPRCLRMPPSSA

SEQ ID NO: 838794 - protein, 158 aa, Homo sapiens
MSKDALPEKACQLDSRYWRITNAKGDVEEVQGPGVVGEFPIISPGRVYEYTSCTTFSTTSGYMEGYYTFHFLYFKDKIFNVAIPRFHMACPTFRVSIARLEMGPDEYEEMEEEEEEEEEEDEDDDSADMDESDEDDEEERRRRVFDVPIRRRRCSRLF

SEQ ID NO: 838795 - protein, 482 aa, Homo sapiens; identical to SEQ ID NO: 838785

SEQ ID NO: 838796 - protein, 426 aa, Homo sapiens; identical to SEQ ID NO: 838786

SEQ ID NO: 838797 - protein, 842 aa, Homo sapiens
MSRPLSDQEKRKQISVRGLAGVENVTELKKNFNRHLHFTLVKDRNVATPRDYYFALAHTVRDHLVGRWIRTQQHYYEKDPKRIYYLSLEFYMGRTLQNTMVNLALENACDEATYQLGLDMEELEEIEEDAGLGNGGLGRLAACFLDSMATLGLAAYGYGIRYEFGIFNQKISGGWQMEEADDWLRYGNPWEKARPEFTLPVHFYGHVEHTSQGAKWVDTQVVLAMPYDTPVPGYRNNVVNTMRLWSAKAPNDFNLKDFNVGGYIQAVLDRNLAENISRVLYPNDNFFEGKELRLKQEYFVVAATLQDIIRRFKSSKFGCRDPVRTNFDAFPDKVAIQLNDTHPSLAIPELMRILVDLERMDWDKAWDVTVRTCAYTNHTVLPEALERWPVHLLETLLPRHLQIIYEINQRFLNRVAAAFPGDVDRLRRMSLVEEGAVKRINMAHLCIAGSHAVNGVARIHSEILKKTIFKDFYELEPHKFQNKTNGITPRRWLVLCNPGLAEVIAERIGEDFISDLDQLRKLLSFVDDEAFIRDVAKVKQENKLKFAAYLEREYKVHINPNSLFDIQVKRIHEYKRQLLNCLHVITLYNRIKREPNKFFVPRTVMIGGKAAPGYHMAKMIIRLVTAIGDVVNHDPAVGDRLRVIFLENYRVSLAEKVIPAADLSEQISTAGTEASGTGNMKFMLNGALTIGTMDGANVEMAEEAGEENFFIFGMRVEDVDKLDQRGYNAQEYYDRIPELRQVIEQLSSGFFSPKQPDLFKDIVNMLMHHDRFKVFADYEDYIKCQEKVSALYKNPREWTRMVIRNIATSGKFSSDRTIAQYAREIWGVEPSRQRLPAPDEAI

SEQ ID NO: 838798 - protein, 842 aa, Homo sapiens; identical to SEQ ID NO: 838797

SEQ ID NO: 838799 - protein, 833 aa, Homo sapiens
MSRPLSDQEKRKQISVRGLAGVENVTELKKNFNRHLHFTLVKDRNVATPRDYYFALAHTVRDHLVGRWIRTQQHYYEKDPKRIYYLSLEFYMGRTLQNTMVNLALENACDEATYQLGLDMEELEEIEEDAGLGNGGLGRLAACFLDSMATLGLAAYGYGIRYEFGIFNQKISGGWQMEEADDWLRYGNPWEKARPEFTLPVHFYGHVEHTSQGAKWVDTQVVLAMPYDTPVPGYRNNVVNTMRLWSAKAPNDFNLKDFNVGGYIQAVLDRNLAENISRVLYPNDNFFEGKELRLKQEYFVVAATLQDIIRRFKSSKFGCRDPVRTNFDAFPDKVAIQLNDTHPSLAIPELMRILVDLERMDWDKAWDVTVRTCAYTNHTVLPEALERWPVHLLETLLPRHLQIIYEINQRFLNRVAAAFPGDVDRLRRMSLVEEGAVKRINMAHLCIAGSHAVNGVARIHSEILKKTIFKDFYELEPHKFQNKTNGITPRRWLVLCNPGLAEVIAERIGEDFISDLDQLRKLLSFVDDEAFIRDVAKVKQENKLKFAAYLEREYKVHINPNSLFDIQVKRIHEYKRQLLNCLHVITLYNRIKREPNKFFVPRTVMIGGKAAPGYHMAKMIIRLVTAIVGDRLRVIFLENYRVSLAEKVIPAADLSEQISTAGTEASGTGNMKFMLNGALTIGTMDGANVEMAEEAGEENFFIFGMRVEDVDKLDQRGYNAQEYYDRIPELRQVIEQLSSGFFSPKQPDLFKDIVNMLMHHDRFKVFADYEDYIKCQEKVSALYKNPREWTRMVIRNIATSGKFSSDRTIAQYAREIWGVEPSRQRLPAPDEAI

SEQ ID NO: 838800 - protein, 122 aa, Homo sapiens
QLCPGRYNAQEYYDRIPELRQVIEQLSSGFFSPKQPDLFKDIVNMLMHHDRFKVFADYEDYIKCQEKVSALYKNPREWTRMVIRNIATSGKFSSDRTIAQYAREIWGVEPSRQRLPAPDEAI

SEQ ID NO: 838801 - protein, 581 aa, Homo sapiens
RSPPCGLLRWFGGPLLASWCRCHLRFRAFGTSAGWYRAFPAPPPLLPPACPSPRDYRPHVSLSPFLSRPSRGGSSSSSSSRRRSPVAAVAGEPMAYSQGGGKKKVCYYYDGDIGNYYYGQGHPMKPHRIRMTHNLLLNYGLYRKMEIYRPHKATAEEMTKYHSDEYIKFLRSIRPDNMSEYSKQMQRFNVGEDCPVFDGLFEFCQLSTGGSVAGAVKLNRQQTDMAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNFPMRDGIDDESYGQIFKPIISKVMEMYQPSAVVLQCGADSLSGDRLGCFNLTVKGHAKCVEVVKTFNLPLLMLGGGGYTIRNVARCWTYETAVALDCEIPNELPYNDYFEYFGPDFKLHISPSNMTNQNTPEYMEKIKQRLFENLRMLPHAPGVQMQAIPEDAVHEDSGDEDGEDPDKRISIRASDKRIACDEEFSDSEDEGEGGRRNVADHKKGAKKARIEEDKKETEDKKTDVKEEDKSKDNSGEKTDTKGTKSEQLSNP

SEQ ID NO: 838802 - protein, 581 aa, Homo sapiens; identical to SEQ ID NO: 838801

SEQ ID NO: 838803 - protein, 581 aa, Homo sapiens; identical to SEQ ID NO: 838801

SEQ ID NO: 838804 - protein, 663 aa, Homo sapiens
RSPPCGLLRWFGGPLLASWCRCHLRFRAFGTSAGWYRAFPAPPPLLPPACPSPRDYRPHVSLSPFLSRPSRGGSSSSSSSRRRSPVAAVAGEPMAYSQGGGKKKVCYYYDGDIGNYYYGQGHPMKPHRIRMTHNLLLNYGLYRKMEIYRPHKATAEEMTKYHSDEYIKFLRSIRPDNMSEYSKQMQRFNVGEDCPVFDGLFEFCQLSTGGSVAGAVKLNRQQTDMAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNFPMRDGIDDESYGQIFKPIISKVMEMYQPSAVVLQCGADSLSGDRLGCFNLTVKGHAKCVEVVKTFNLPLLMLGGGGYTIRNVARCWTYETAVALDCEIPNELPYNDYFEYFGPDFKLHISPSNMTNQNTPEYMEKIKQRLFENLRMLPHAPGVQMQAIPEDAVHEDSGDEDGEDPDKRISIRASDKRIACDEEFSDSEDEGEGGRRNVADHKKKKKKKKKKKKKKKKKRRGGAAPEEIPPEGGPRVKAATPFLCGKKGGPKERERIYRYGCSAREGRARYYNKSGAWRGRKEVCDSRGENTFVGGEDDPLNCGGGEETPIWGEQHSPPRERYYKQRSEGRRKI

SEQ ID NO: 838805 - protein, 533 aa, Homo sapiens
RSPPCGLLRWFGGPLLASWCRCHLRFRAFGTSAGWYRAFPAPPPLLPPACPSPRDYRPHVSLSPFLSRPSRGGSSSSSSSRRRSPVAAVAGEPMAYSQGGGKKKVCYYYDGDIGNYYYGQGHPMKPHRIRMTHNLLLNYGLYRKMEIYRPHKATAEEMTKYHSDEYIKFLRSIRPDNMSEYSKQMQRFNVGEDCPVFDGLFEFCQLSTGGSVAGAVKLNRQQTDMAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNFPMRDGIDDESYGQIFKPIISKVMEMYQPSAVVLQCGADSLSGDRLGCFNLTVKGHAKCVEVVKTFNLPLLMLGGGGYTIRNVARCWTYETAVALDCEIPNELPYNDYFEYFGPDFKLHISPSNMTNQNTPEYMEKIKQRLFENLRMLPHAPGVQMQAIPEDAVHEDSGDEDGEDPDKRISIRASDKRIACDEEFSDSEDEGEGGHGSEISKKP

SEQ ID NO: 838806 - protein, 264 aa, Homo sapiens
RSPPCGLLRWFGGPLLASWCRCHLRFRAFGTSAGWYRAFPAPPPLLPPACPSPRDYRPHVSLSPFLSRPSRGGSSSSSSSRRRSPVAAVAGEPMAYSQGGGKKKVCYYYDGDIGNYYYGQGHPMKPHRIRMTHNLLLNYGLYRKMEIYRPHKATAEEMTKYHSDEYIKFLRSIRPDNMSEYSKQMQRFNVGEDCPVFDGLFEFCQLSTGGSVAGAVKLNRQQTDMAVNWAGGLHHAKKSEASGFCYVNDIVLAILELLKYVNLY

SEQ ID NO: 838807 - protein, 581 aa, Homo sapiens; identical to SEQ ID NO: 838801

SEQ ID NO: 838808 - protein, 240 aa, Homo sapiens
ALTSLRPPEVVWWPPPRELVPLPPPIPSFRHLCRVVPSLPGAPSSPPTGSSSSSSSRRRSPVAAVAGEPMAYSQGGGKKKVCYYYDGDIGNYYYGQGHPMKPHRIRMTHNLLLNYGLYRKMEIYRPHKATAEEMTKYHSDEYIKFLRSIRPDNMSEYSKQMQRFNVGEDCPVFDGLFEFCQLSTGGSVAGAVKLNRQQTDMAVNWAGGLHHAKKSEASGFCYVNDIVLAILELLKYVNLY

SEQ ID NO: 838809 - protein, 294 aa, Homo sapiens [sequence omitted]

SEQ ID NO: 838810 - protein, 77 aa, Homo sapiens
AAAYYYYNCSEFKLLTMYGDMDCIYFQMAFSFLFFLASFIVSFSNYEAKFLFSTMLYVIVFKIDVSYYVKKTDLLKK

SEQ ID NO: 838811 - protein, 54 aa, Homo sapiens
MTKMAIVPQYAFHDLCFVNRIPWFSRGQGYLPVGVFKFWLMGAEEMYTTSRLYS

SEQ ID NO: 838812 - protein, 44 aa, Homo sapiens
MDLHKLNKVTFIFHLSIPPPPTTMYLLVTTLEPSMVTHTCNPST

SEQ ID NO: 838813 - protein, 1615 aa, Homo sapiens
MEAAPPGPPWPLLLLLLLLLALCGCPAPAAASPLLLFANRRDVRLVDAGGVKLESTIVVSGLEDAAAVDFQFSKGAVYWTDVSEEAIKQTYLNQTGAAVQNVVISGLVSPDGLACDWVGKKLYWTDSETNRIEVANLNGTSRKVLFWQDLDQPRAIALDPAHGYMYWTDWGETPRIERAGMDGSTRKIIVDSDIYWPNGLTIDLEEQKLYWADAKLSFIHRANLDGSFRQKVVEGSLTHPFALTLSGDTLYWTDWQTRSIHACNKRTGGKRKEILSALYSPMDIQVLSQERQPFFHTRCEEDNGGCSHLCLLSPSEPFYTCACPTGVQLQDNGRTCKAGAEEVLLLARRTDLRRISLDTPDFTDIVLQVDDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIALHPVMGLMYWTDWGENPKIECANLDGQERRVLVNASLGWPNGLALDLQEGKLYWGDAKTDKIEVINVDGTKRRTLLEDKLPHIFGFTLLGDFIYWTDWQRRSIERVHKVKASRDVIIDQLPDLMGLKAVNVAKVVGTNPCADRNGGCSHLCFFTPHATRCGCPIGLELLSDMKTCIVPEAFLVFTSRAAIHRISLETNNNDVAIPLTGVKEASALDFDVSNNHIYWTDVSLKTISRAFMNGSSVEHVVEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERVVIADDLPHPFGLTQYSDYIYWTDWNLHSIERADKTSGRNRTLIQGHLDFVMDILVFHSSRQDGLNDCMHNNGQCGQLCLAIPGGHRCGCASHYTLDPSSRNCSPPTTFLLFSQKSAISRMIPDDQHSPDLILPLHGLRNVKAIDYDPLDKFIYWVDGRQNIKRAKDDGTQPFVLTSLSQGQNPDRQPHDLSIDIYSRTLFWTCEATNTINVHRLSGEAMGVVLRGDRDKPRAIVVNAERGYLYFTNMQDRAAKIERAALDGTEREVLFTTGLIRPVALVVDNTLGKLFWVDADLKRIESCDLSGANRLTLEDANIVQPLGLTILGKHLYWIDRQQQMIERVEKTTGDKRTRIQGRVAHLTGIHAVEEVSLEEFSAHPCARDNGGCSHICIAKGDGTPRCSCPVHLVLLQNLLTCGEPPTCSPDQFACATGEIDCIPGAWRCDGFPECDDQSDEEGCPVCSAAQFPCARGQCVDLRLRCDGEADCQDRSDEADCDAICLPNQFRCASGQCVLIKQQCDSFPDCIDGSDELMCEITKPPSDDSPAHSSAIGPVIGIILSLFVMGGVYFVCQRVVCQRYAGANGPFPHEYVSGTPHVPLNFIAPGGSQHGPFTGIACGKSMMSSVSLMGGRGGVPLYDRNHVTGASSSSSSSTKATLYPPILNPPPSPATDPSLYNMDMFYSSNIPATARPYRPYIIRGMAPPTTPCSTDVCDSDYSASRWKASKYYLDLNSDSDPYPPPPTPHSQYLSAEDSCPPSPATERSYFHLFPPPPSPCTDSS

SEQ ID NO: 838814 - protein, 85 aa, Homo sapiens
KAIISRRTSPVMTWVVAWQSQHVIRPFFHPSIPPMYFGGSDPYPPPPTPHSQYLSAEDSCPPSPATERSYFHLFPPPPSPCTDSS

SEQ ID NO: 838815 - protein, 144 aa, Homo sapiens
LDSAPFGLTQYSDYIYWTDWNLHSIERADKTERRVLVNASLGWPNGLALDLQEGKLYWGDAKTDKIEVINVDGTKRRTLLEDKLPHIFGFTLLGDFIYWTDWQRRSIERVHKVKASRDVIIDQLPDLMGLKAVNVAKVVGESGG

SEQ ID NO: 838816 - protein, 1184 aa, Homo sapiens
RDLATALQPGQQSETLSQNLKQTNKQKTNKQSVIYPAPLGNHATWCFMVPGKVQVKLLLLGIEPVLFGAAQAPGRVRVGSRVVWPWPIQTYISAVLQVINVDGTKRRTLLEDKLPHIFGFTLLGDFIYWTDWQRRSIERVHKVKASRDVIIDQLPDLMGLKAVNVAKVVGTNPCADRNGGCSHLCFFTPHATRCGCPIGLELLSDMKTCIVPEAFLVFTSRAAIHRISLETNNNDVAIPLTGVKEASALDFDVSNNHIYWTDVSLKTISRAFMNGSSVEHVVEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERVVIADDLPHPFGLTQYSDYIYWTDWNLHSIERADKTSGRNRTLIQGHLDFVMDILVFHSSRQDGLNDCMHNNGQCGQLCLAIPGGHRCGCASHYTLDPSSRNCSPPTTFLLFSQKSAISRMIPDDQHSPDLILPLHGLRNVKAIDYDPLDKFIYWVDGRQNIKRAKDDGTQPFVLTSLSQGQNPDRQPHDLSIDIYSRTLFWTCEATNTINVHRLSGEAMGVVLRGDRDKPRAIVVNAERGYLYFTNMQDRAAKIERAALDGTEREVLFTTGLIRPVALVVDNTLGKLFWVDADLKRIESCDLSGANRLTLEDANIVQPLGLTILGKHLYWIDRQQQMIERVEKTTGDKRTRIQGRVAHLTGIHAVEEVSLEEFSAHPCARDNGGCSHICIAKGDGTPRCSCPVHLVLLQNLLTCGEPPTCSPDQFACATGEIDCIPGAWRCDGFPECDDQSDEEGCPVCSAAQFPCARGQCVDLRLRCDGEADCQDRSDEADCDAICLPNQFRCASGQCVLIKQQCDSFPDCIDGSDELMCEITKPPSDDSPAHSSAIGPVIGIILSLFVMGGVYFVCQRVVCQRYAGANGPFPHEYVSGTPHVPLNFIAPGGSQHGPFTGIACGKSMMSSVSLMGGRGGVPLYDRNHVTGASSSSSSSTKATLYPPILNPPPSPATDPSLYNMDMFYSSNIPATARPYRPYIIRGMAPPTTPCSTDVCDSDYSASRWKASKYYLDLNSDSDPYPPPPTPHSQYLSAEDSCPPSPATERSYFHLFPPPPSPCTDSS

SEQ ID NO: 838817 - protein, 1034 aa, Homo sapiens
MKDERTEDVMLAAALPAVLGTNPCADRNGGCSHLCFFTPHATRCGCPIGLELLSDMKTCIVPEAFLVFTSRAAIHRISLETNNNDVAIPLTGVKEASALDFDVSNNHIYWTDVSLKTISRAFMNGSSVEHVVEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERVVIADDLPHPFGLTQYSDYIYWTDWNLHSIERADKTSGRNRTLIQGHLDFVMDILVFHSSRQDGLNDCMHNNGQCGQLCLAIPGGHRCGCASHYTLDPSSRNCSPPTTFLLFSQKSAISRMIPDDQHSPDLILPLHGLRNVKAIDYDPLDKFIYWVDGRQNIKRAKDDGTQPFVLTSLSQGQNPDRQPHDLSIDIYSRTLFWTCEATNTINVHRLSGEAMGVVLRGDRDKPRAIVVNAERGYLYFTNMQDRAAKIERAALDGTEREVLFTTGLIRPVALVVDNTLGKLFWVDADLKRIESCDLSGANRLTLEDANIVQPLGLTILGKHLYWIDRQQQMIERVEKTTGDKRTRIQGRVAHLTGIHAVEEVSLEEFSAHPCARDNGGCSHICIAKGDGTPRCSCPVHLVLLQNLLTCGEPPTCSPDQFACATGEIDCIPGAWRCDGFPECDDQSDEEGCPVCSAAQFPCARGQCVDLRLRCDGEADCQDRSDEADCDAICLPNQFRCASGQCVLIKQQCDSFPDCIDGSDELMCEITKPPSDDSPAHSSAIGPVIGIILSLFVMGGVYFVCQRVVCQRYAGANGPFPHEYVSGTPHVPLNFIAPGGSQHGPFTGIACGKSMMSSVSLMGGRGGVPLYDRNHVTGASSSSSSSTKATLYPPILNPPPSPATDPSLYNMDMFYSSNIPATARPYRPYIIRGMAPPTTPCSTDVCDSDYSASRWKASKYYLDLNSDSDPYPPPPTPHSQYLSAEDSCPPSPATERSYFHLFPPPPSPCTDSS

SEQ ID NO: 838818 - protein, 1508 aa, Homo sapiens
MEAAPPGPPWPLLLLLLLLLALCGCPAPAAASPLLLFANRRDVRLVDAGGVKLESTIVVSGLEDAAAVDFQFSKGAVYWTDVSEEAIKQTYLNQTGAAVQNVVISGLVSPDGLACDWVGKKLYWTDSETNRIEVANLNGTSRKVLFWQDLDQPRAIALDPAHGYMYWTDWGETPRIERAGMDGSTRKIIVDSDIYWPNGLTIDLEEQKLYWADAKLSFIHRANLDGSFRQKVVEGSLTHPFALTLSGDTLYWTDWQTRSIHACNKRTGGKRKEILSALYSPMDIQVLSQERQPFFHTRCEEDNGGCSHLCLLSPSEPFYTCACPTGVQLQDNGRTCKAGAEEVLLLARRTDLRRISLDTPDFTDIVLQVDDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIALHPVMGLMYWTDWGENPKIECANLDGQERRVLVNASLGWPNGLALDLQEGKLYWGDAKTDKIEVINVDGTKRRTLLEDKLPHIFGFTLLGDFIYWTDWQRRSIERVHKVKASRDVIIDQLPDLMGLKAVNVAKVVGTNPCADRNGGCSHLCFFTPHATRCGCPIGLELLSDMKTCIVPEAFLVFTSRAAIHRISLETNNNDVAIPLTGVKEASALDFDVSNNHIYWTDVSLKTISRAFMNGSSVEHVVEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERVVIADDLPHPFGLTQYSDYIYWTDWNLHSIERADKTSGRNRTLIQGHLDFVMDILVFHSSRQDGLNDCMHNNGQCGQLCLAIPGGHRCGCASHYTLDPSSRNCSPPTTFLLFSQKSAISRMIPDDQHSPDLILPLHGLRNVKAIDYDPLDKFIYWVDGRQNIKRAKDDGTQPFVLTSLSQGQNPDRQPHDLSIDIYSRTLFWTCEATNTINVHRLSGEAMGVVLRGDRDKPRAIVVNAERGYLYFTNMQDRAAKIERAALDGTEREVLFTTGLIRPVALVVDNTLGKLFWVDADLKRIESCDLSGANRLTLEDANIVQPLGLTILGKHLYWIDRQQQMIERVEKTTGDKRTRIQGRVAHLTGIHAVEEVSLEEFSAHPCARDNGGCSHICIAKGDGTPRCSCPVHLVLLQNLLTCGEPPTCSPDQFACATGEIDCIPGAWRCDGFPECDDQSDEEGCPVCSAAQFPCARGQCVDLRLRCDGEADCQDRSDEADCDAICLPNQFRCASGQCVLIKQQCDSFPDCIDGSDELMCEITKPPSDDSPAHSSAIGPVIGIILSLFVMGGVYFVCQRVVCQRYAGANGPFPHEYVSGTPHVPLNFIAPGGSQHGPFTGIACGKSMMSSVSLMGGRGGVPLYDRNHVTGASSSSSSSTKATLYPPVRGGAGEGRGGM

SEQ ID NO: 838819 - protein, 401 aa, Homo sapiens
ADLWTGHEHRGVPSPLAIQMWEQPPLSRAHGWAENLLTCGEPPTCSPDQFACATGEIDCIPGAWRCDGFPECDDQSDEEGCPVCSAAQFPCARGQCVDLRLRCDGEADCQDRSDEADCDAICLPNQFRCASGQCVLIKQQCDSFPDCIDGSDELMCEITKPPSDDSPAHSSAIGPVIGIILSLFVMGGVYFVCQRVVCQRYAGANGPFPHEYVSGTPHVPLNFIAPGGSQHGPFTGIACGKSMMSSVSLMGGRGGVPLYDRNHVTGASSSSSSSTKATLYPPILNPPPSPATDPSLYNMDMFYSSNIPATARPYRPYIIRGMAPPTTPCSTDVCDSDYSASRWKASKYYLDLNSDSDPYPPPPTPHSQYLSAEDSCPPSPATERSYFHLFPPPPSPCTDSS

SEQ ID NO: 838820 - protein, 837 aa, Homo sapiens
MEAAPPGPPWPLLLLLLLLLALCGCPAPAAASPLLLFANRRDVRLVDAGGVKLESTIVVSGLEDAAAVDFQFSKGAVYWTDVSEEAIKQTYLNQTGAAVQNVVISGLVSPDGLACDWVGKKLYWTDSETNRIEVANLNGTSRKVLFWQDLDQPRAIALDPAHGYMYWTDWGETPRIERAGMDGSTRKIIVDSDIYWPNGLTIDLEEQKLYWADAKLSFIHRANLDGSFRQKVVEGSLTHPFALTLSGDTLYWTDWQTRSIHACNKRTGGKRKEILSALYSPMDIQVLSQERQPFFHTRCEEDNGGCSHLCLLSPSEPFYTCACPTGVQLQDNGRTCKAGAEEVLLLARRTDLRRISLDTPDFTDIVLQVDDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIALHPVMGLMYWTDWGENPKIECANLDGQERRVLVNASLGWPNGLALDLQEGKLYWGDAKTDKIEVINVDGTKRRTLLEDKLPHIFGFTLLGDFIYWTDWQRRSIERVHKVKASRDVIIDQLPDLMGLKAVNVAKVVGTNPCADRNGGCSHLCFFTPHATRCGCPIGLELLSDMKTCIVPEAFLVFTSRAAIHRISLETNNNDVAIPLTGVKEASALDFDVSNNHIYWTDVSLKTISRAFMNGSSVEHVVEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGTA

SEQ ID NO: 838821 - protein, 726 aa, Homo sapiens
MEAAPPGPPWPLLLLLLLLLALCGCPAPAAASPLLLFANRRDVRLVDAGGVKLESTIVVSGLEDAAAVDFQFSKGAVYWTDVSEEAIKQTYLNQTGAAVQNVVISGLVSPDGLACDWVGKKLYWTDSETNRIEVANLNGTSRKVLFWQDLDQPRAIALDPAHGYMYWTDWGETPRIERAGMDGSTRKIIVDSDIYWPNGLTIDLEEQKLYWADAKLSFIHRANLDGSFRQKVVEGSLTHPFALTLSGDTLYWTDWQTRSIHACNKRTGGKRKEILSALYSPMDIQVLSQERQPFFHTRCEEDNGGCSHLCLLSPSEPFYTCACPTGVQLQDNGRTCKAGAEEVLLLARRTDLRRISLDTPDFTDIVLQVDDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIALHPVMGLMYWTDWGENPKIECANLDGQERRVLVNASLGWPNGLALDLQEGKLYWGDAKTDKIEVINVDGTKRRTLLEDKLPHIFGFTLLGDFIYWTDWQRRSIERVHKVKASRDVIIDQLPDLMGLKAVNVAKVVGTNPCADRNGGCSHLCFFTPHATRCGCPIGLELLSDMKTCIVPEAFLVFTSRAAIHRISLETNNNDVAIPLTGVKEASALDFDVSNNHIYWTDVSLKVAWARTCTQAAFMGKPCLCSCLKGFRHFS

SEQ ID NO: 838822 - protein, 140 aa, Homo sapiens
MSPGDTAGWVQSPACIFWSWPVDRPFPFTAPGLLCPPGRMCLPESHSSVCVPFRPYIIRGMAPPTTPCSTDVCDSDYSASRWKASKYYLDLNSDSDPYPPPPTPHSQYLSAEDSCPPSPATERSYFHLFPPPPSPCTDSS

SEQ ID NO: 838823 - protein, 88 aa, Homo sapiens
EGMAVDWMGKNLYWADTGTNRIEVARLDGQFRQVLVWRDLDNPRSLALDPTKGYSVCLSRASLCSPRMRQCGGANWARWQAVRVALSD

SEQ ID NO: 838824 - protein, 1615 aa, Homo sapiens; identical to SEQ ID NO: 838813

SEQ ID NO: 838825 - protein, 1382 aa, Homo sapiens
MEAAPPGPPWPLLLLLLLLLALCGCPAPAAASPLLLFANRRDVRLVDAGGVKLESTIVVSGLEDAAAVDFQFSKGAVYWTDVSEEAIKQTYLNQTGAAVQNVVISGLVSPDGLACDWVGKKLYWTDSETNRIEVANLNGTSRKVLFWQDLDQPRAIALDPAHGYMYWTDWGETPRIERAGMDGSTRKIIVDSDIYWPNGLTIDLEEQKLYWADAKLSFIHRANLDGSFRQKVVEGSLTHPFALTLSGDTLYWTDWQTRSIHACNKRTGGKRKEILSALYSPMDIQVLSQERQPFFHTRCEEDNGGCSHLCLLSPSEPFYTCACPTGVQLQDNGRTCKAGAEEVLLLARRTDLRRISLDTPDFTDIVLQVDDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIALHPVMGLMYWTDWGENPKIECANLDGQERRVLVNASLGWPNGLALDLQEGKLYWGDAKTDKIEVINVDGTKRRTLLEDKLPHIFGFTLLGDFIYWTDWQRRSIERVHKVKASRDVIIDQLPDLMGLKAVNVAKVVGTNPCADRNGGCSHLCFFTPHATRCGCPIGLELLSDMKTCIVPEAFLVFTSRAAIHRISLETNNNDVAIPLTGVKEASALDFDVSNNHIYWTDVSLKTISRAFMNGSSVEHVVEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERVVIADDLPHPFGLTQYSDYIYWTDWNLHSIERADKTSGRNRTLIQGHLDFVMDILVFHSSRQDGLNDCMHNNGQCGQLCLAIPGGHRCGCASHYTLDPSSRNCSPPTTFLLFSQKSAISRMIPDDQHSPDLILPLHGLRNVKAIDYDPLDKFIYWVDGRQNIKRAKDDGTQPFVLTSLSQGQNPDRQPHDLSIDIYSRTLFWTCEATNTINVHRLSGEAMGVVLRGDRDKPRAIVVNAERGYLYFTNMQDRAAKIERAALDGTEREVLFTTGLIRPVALVVDNTLGKLFWVDADLKRIESCDLSGANRLTLEDANIVQPLGLTILGKHLYWIDRQQQMIERVEKTTGDKRTRIQGRVAHLTGIHAVEEVSLEEFSAHPCARDNGGCSHICIAKGDGTPRCSCPVHLVLLQNLLTCGEPPTCSPDQFACATGEIDCIPGAWRCDGFPECDDQSDEEGCPVCSAAQFPCARGQCVDLRLRCDGEADCQDRSDEADCDAICLPNQFRCASGQCVPLHGLILTSAGPLWLLCAPVNSFKYEQRKKYIL

SEQ ID NO: 838826 - protein, 1301 aa, Homo sapiens
MEAAPPGPPWPLLLLLLLLLALCGCPAPAAASPLLLFANRRDVRLVDAGGVKLESTIVVSGLEDAAAVDFQFSKGAVYWTDVSEEAIKQTYLNQTGAAVQNVVISGLVSPDGLACDWVGKKLYWTDSETNRIEVANLNGTSRKVLFWQDLDQPRAIALDPAHGYMYWTDWGETPRIERAGMDGSTRKIIVDSDIYWPNGLTIDLEEQKLYWADAKLSFIHRANLDGSFRQKVVEGSLTHPFALTLSGDTLYWTDWQTRSIHACNKRTGGKRKEILSALYSPMDIQVLSQERQPFFHTRCEEDNGGCSHLCLLSPSEPFYTCACPTGVQLQDNGRTCKAGAEEVLLLARRTDLRRISLDTPDFTDIVLQVDDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIALHPVMGLMYWTDWGENPKIECANLDGQERRVLVNASLGWPNGLALDLQEGKLYWGDAKTDKIEVINVDGTKRRTLLEDKLPHIFGFTLLGDFIYWTDWQRRSIERVHKVKASRDVIIDQLPDLMGLKAVNVAKVVGTNPCADRNGGCSHLCFFTPHATRCGCPIGLELLSDMKTCIVPEAFLVFTSRAAIHRISLETNNNDVAIPLTGVKEASALDFDVSNNHIYWTDVSLKTISRAFMNGSSVEHVVEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERVVIADDLPHPFGLTQYSDYIYWTDWNLHSIERADKTSGRNRTLIQGHLDFVMDILVFHSSRQDGLNDCMHNNGQCGQLCLAIPGGHRCGCASHYTLDPSSRNCSPPTTFLLFSQKSAISRMIPDDQHSPDLILPLHGLRNVKAIDYDPLDKFIYWVDGRQNIKRAKDDGTQPFVLTSLSQGQNPDRQPHDLSIDIYSRTLFWTCEATNTINVHRLSGEAMGVVLRGDRDKPRAIVVNAERGYLYFTNMQDRAAKIERAALDGTEREVLFTTGLIRPVALVVDNTLGKLFWVDADLKRIESCDLSGANRLTLEDANIVQPLGLTILGKHLYWIDRQQQMIERVEKTTGDKRTRIQGRVAHLTGIHAVEEVSLEEFSAHPCARDNGGCSHICIAKGDGTPRCSCPVHPEQLAQCVVYHQGHRADEAGGEEDLALGAVQGCAFDLGCPVLHVGEVQVPSLRVDDDG

SEQ ID NO: 838827 - protein, 908 aa, Homo sapiens
MEAAPPGPPWPLLLLLLLLLALCGCPAPAAASPLLLFANRRDVRLVDAGGVKLESTIVVSGLEDAAAVDFQFSKGAVYWTDVSEEAIKQTYLNQTGAAVQNVVISGLVSPDGLACDWVGKKLYWTDSETNRIEVANLNGTSRKVLFWQDLDQPRAIALDPAHGYMYWTDWGETPRIERAGMDGSTRKIIVDSDIYWPNGLTIDLEEQKLYWADAKLSFIHRANLDGSFRQKVVEGSLTHPFALTLSGDTLYWTDWQTRSIHACNKRTGGKRKEILSALYSPMDIQVLSQERQPFFHTRCEEDNGGCSHLCLLSPSEPFYTCACPTGVQLQDNGRTCKAGAEEVLLLARRTDLRRISLDTPDFTDIVLQVDDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIALHPVMGLMYWTDWGENPKIECANLDGQERRVLVNASLGWPNGLALDLQEGKLYWGDAKTDKIEVINVDGTKRRTLLEDKLPHIFGFTLLGDFIYWTDWQRRSIERVHKVKASRDVIIDQLPDLMGLKAVNVAKVVGTNPCADRNGGCSHLCFFTPHATRCGCPIGLELLSDMKTCIVPEAFLVFTSRAAIHRISLETNNNDVAIPLTGVKEASALDFDVSNNHIYWTDVSLKTISRAFMNGSSVEHVVEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGEGRAGAFWSWRAGQPGVGHLPASPHVPCGLQVPQPGRSCGHTHDCPAASPSAVGVVPVHPWVPLLQLCRERLW

SEQ ID NO: 838828 - protein, 756 aa, Homo sapiens
MEAAPPGPPWPLLLLLLLLLALCGCPAPAAASPLLLFANRRDVRLVDAGGVKLESTIVVSGLEDAAAVDFQFSKGAVYWTDVSEEAIKQTYLNQTGAAVQNVVISGLVSPDGLACDWVGKKLYWTDSETNRIEVANLNGTSRKVLFWQDLDQPRAIALDPAHGYMYWTDWGETPRIERAGMDGSTRKIIVDSDIYWPNGLTIDLEEQKLYWADAKLSFIHRANLDGSFRQKVVEGSLTHPFALTLSGDTLYWTDWQTRSIHACNKRTGGKRKEILSALYSPMDIQVLSQERQPFFHTRCEEDNGGCSHLCLLSPSEPFYTCACPTGVQLQDNGRTCKAGAEEVLLLARRTDLRRISLDTPDFTDIVLQVDDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIALHPVMGLMYWTDWGENPKIECANLDGQERRVLVNASLGWPNGLALDLQEGKLYWGDAKTDKIEVINVDGTKRRTLLEDKLPHIFGFTLLGDFIYWTDWQRRSIERVHKVKASRDVIIDQLPDLMGLKAVNVAKVVGTNPCADRNGGCSHLCFFTPHATRCGCPIGLELLSDMKTCIVPEAFLVFTSRAAIHRISLETNNNDVAIPLTGVKEASALDFDVSNNHIYWTDVSLKTISRAFMNGSSVEHVVEFGLDYPEGMAVDWMGKNLYWAGDAKTDKIEVINVDGTQRRTL

SEQ ID NO: 838829 - protein, 214 aa, Homo sapiens
MEAAPPGPPWPLLLLLLLLLALCGCPAPAAASPLLLFANRRDVRLVDAGGVKLESTIVVSGLEDAAAVDFQFSKGAVYWTDVSEEAIKQTYLNQTILNPPPSPATDPSLYNMDMFYSSNIPATARPYRPYIIRGMAPPTTPCSTDVCDSDYSASRWKASKYYLDLNSDSDPYPPPPTPHSQYLSAEDSCPPSPATERSYFHLFPPPPSPCTDSS

SEQ ID NO: 838830 - protein, 38 aa, Homo sapiens
PPVLRSLGFFVLQPFVLTSLSQGQNPDRQPHDLSIDIY

SEQ ID NO: 838831 - protein, 112 aa, Homo sapiens [sequence omitted]

SEQ ID NO: 838832 - protein, 655 aa, Homo sapiens
GGAGVGAGAGAMEAERGPERRPAERSSPGQTPEEGAQALAEFAALHGPALRASGVPERYWGRLLHKLEHEVFDAGEVFGIMQVEEVEEEEDEAAREVRKQQPNPGNELCYKVIVTRESGLQAAHPNSIFLIDHAWTCRVEHARQQLQQVPGLLHRMANLMGIEFHGELPSTEAVALVLEEMWKFNQTYQLAHGTAEEKMPVWYIMDEFGSRIQHADVPSFATAPFFYMPQQVAYTLLWPLRDLDTGEEVTRDFAYGETDPLIRKCMLLPWAPTDMLDLSSCTPEPPAEHYQAILEENKEKLPLDINPVVHPHGHIFKVYTDVQQVASSLTHPRFTLTQSEADADILFNFSHFKDYRKLSQERPGVLLNQFPCENLLTVKDCLASIARRAGGPEGPPWLPRTFNLRTELPQFVSYFQQRERWGEDNHWICKPWNLARSLDTHVTKSLHSIIRHRESTPKVVSKYIESPVLFLREDVGKVKFDIRYIVLLRSVRPLRLFVYDVFWLRFSNRAFALNDLDDYEKHFTVMNYDPDVVLKQVHCEEFIPEFEKQYPEFPWTDVQAEIFRAFTELFQVACAKPPPLGLCDYPSSRAMYAVDLMLKWDNGPDGRRVMQPQILEVNFNPDCERACRYHPTFFNDVFSTLFLDQPGGCHVTCLV

SEQ ID NO: 838833 - protein, 655 aa, Homo sapiens; identical to SEQ ID NO: 838832

SEQ ID NO: 838834 - protein, 655 aa, Homo sapiens; identical to SEQ ID NO: 838832

SEQ ID NO: 838835 - protein, 226 aa, Homo sapiens
GGAGVGAGAGAMEAERGPERRPAERSSPGQTPEEGAQALAEFAALHGPALRASGVPERYWGRLLHKLEHEVFDAGEVFGIMQVEEVEEEEDEAAREVRKQQPNPGNELCYKVIVTRESGLQAAHPNSIFLIDHAWTCRVEHARQQLQQVPGLLHRMANLMGIEFHGELPSTEAVALVLEEMWKFNQTYQLAHGHVCRRPHAEVGQRPRWKAGDAAADPGGELQPRL

SEQ ID NO: 838836 - protein, 655 aa, Homo sapiens; identical to SEQ ID NO: 838832

SEQ ID NO: 838837 - protein, 655 aa, Homo sapiens; identical to SEQ ID NO: 838832

SEQ ID NO: 838838 - protein, 837 aa, Homo sapiens
MGDKAGLLGGGLRLFLGPCRIEPCGCSVGPHSRPGVVLMHKSRDPGRETRLPRVIQGSQTLPGGTLLPRTPCLAPRNPSPSTPWKHSSQEQILHARNEALGYNWRLISAQMVVRGEEQGVGWCSALGTPSLSCSDPQVRGGCCAPGVWRREDGSAGQRPGAEAMPRAGVGRDMGAFAEAAQRTEVGILPQSTGFGDSECLDKAGNVAATGLVQKQGAEDVVEEGGVVPAGSLTVGVEVHLQDLRLHHPPSIWAVVPLQHEVDGIHGPGGGVVAEAQGWWLGTGHLEQLREGPEDLSLDVRPGKFWVLLLKLGDELFTVHLLQHHIRVIVHDREVLLVVIQVLSAKARLENRSQNTSYTNNRRGLTDLQQHDVADVELDLSHVFSKEQHGTFDVLGHNLGGALSVPDDAVQALGDVGVQAARQVPGLADPVVVLAPPFPLLEVADKLGQLSAQVEGSGQPGWALGATCPARDGGQAVLDSQQVLAGELVQQHAWPLLAEFPVVLEVGEVEEDVGVRLTLGEGEARVGEAAGHLLHVRVDLEDVAVGVHHGVDVKWQLLLVFLQNGLVVLGGRLGCARAEVQHVGGGPGQQHALPDQGVRLSVGKVSGHLLASVQVPQGPQQRVGHLLRHVEEGCRGEAGHVRVLDPRTELVHDIPHRHLLLSCPMGQLVGLVELPHLLQHQGHSLCTGQLTVELNAHQVGHAVQQPGHLLQLLARVLHTARPGVVDEEDAVGVGCLEPALPGHDDLVAQLVPRVGLLLPHLPGCLVLLLFYLLHLHDPKHFPSVENLVLQLVQEAAPVTFGDPRSAQRRAVQRRELGQGLRALLRRLARAATLRRPAL

SEQ ID NO: 838839 - protein, 99 aa, Homo sapiens
INSGKPLAAWQVKCKNAAGGWRVCSVPGPSSRAVGGPNCPGRRELLPEPSSAWEGRARCSGVSSLKLRTIFLVAKLHMMMLPLLSVLSGPLFTSTRYPS

SEQ ID NO: 838840 - protein, 196 aa, Homo sapiens
GGAGVGAGAGAMEAERGPERRPAERSSPGQTPEEGAQALAEFAALHGPALRASGVPERYWGRLLHKLEHEVFDAGEVFGIMQVEEVEEEEDEAAREVRKQQPNPGNELCYKVIVTRESGLQAAHPNSIFLIDHAWTCRVEHARQQLQQVPGLLWQTPANGPKNRGNWGATLERFQRWKLPVPEAVALVLEAETHLC

SEQ ID NO: 838841 - protein, 595 aa, Homo sapiens
TPADGNSGPQVFDAGEVFGIMQVEEVEEEEDEAAREVRKQQPNPGNELCYKVIVTRESGLQAAHPNSIFLIDHAWTCRVEHARQQLQQVPGLLHRMANLMGIEFHGELPSTEAVALVLEEMWKFNQTYQLAHGTAEEKMPVWYIMDEFGSRIQHADVPSFATAPFFYMPQQVAYTLLWPLRDLDTGEEVTRDFAYGETDPLIRKCMLLPWAPTDMLDLSSCTPEPPAEHYQAILEENKEKLPLDINPVVHPHGHIFKVYTDVQQVASSLTHPRFTLTQSEADADILFNFSHFKDYRKLSQERPGVLLNQFPCENLLTVKDCLASIARRAGGPEGPPWLPRTFNLRTELPQFVSYFQQRERWGEDNHWICKPWNLARSLDTHVTKSLHSIIRHRESTPKVVSKYIESPVLFLREDVGKVKFDIRYIVLLRSVRPLRLFVYDVFWLRFSNRAFALNDLDDYEKHFTVMNYDPDVVLKQVHCEEFIPEFEKQYPEFPWTDVQAEIFRAFTELFQVACAKPPPLGLCDYPSSRAMYAVDLMLKWDNGPDGRRVMQPQILEVNFNPDCERACRYHPTFFNDVFSTLFLDQPGGCHVTCLV

SEQ ID NO: 838842 - protein, 154 aa, Homo sapiens [sequence omitted]

SEQ ID NO: 838843 - protein, 33 aa, Homo sapiens
MAVNGGTRKRSGGKRTRDESVNPHRESVPHRES

SEQ ID NO: 838844 - protein, 284 aa, Homo sapiens
WERRQAGSGGGGSWERRHPGPNPLDPQDPSPDAYCNLVILAVANRDAAEESCALICQVFQIIYGDQSIECVDRAGYHYTSTPERPWLCSRINGSQDTFEACYSGTSTPSFHGSHCSGSDHSSLGLEQLQDYMVTLRSKLGPLEIQQFAMLLREYRLGLPIQDYCTGLLKLYGDRRKFLLLGMRPFIPDQDIGYFEGFLEGVGIREGGILTDSFGRIKRSMSSTSASAVRSYDGAAQRPEAQAFHRLLADITHDIEALAPDDDDDDEDEPRGSRGGSDAAEDNYL

SEQ ID NO: 838845 - protein, 305 aa, Homo sapiens
WERRQAGSGGGGSWERRHPGPNPLDPQDPSPDAYCNLVILAVANRDAAEESCALICQVFQIIYGDQSIECVDRAGYHYTSTPERPWLCSRSESCHTDGTYAYDADFSCCSSFNGSQDTFEACYSGTSTPSFHGSHCSGSDHSSLGLEQLQDYMVTLRSKLGPLEIQQFAMLLREYRLGLPIQDYCTGLLKLYGDRRKFLLLGMRPFIPDQDIGYFEGFLEGVGIREGGILTDSFGRIKRSMSSTSASAVRSYDGAAQRPEAQAFHRLLADITHDIEALAPDDDDDDEDEPRGSRGGSDAAEDNYL

SEQ ID NO: 838846 - protein, 113 aa, Homo sapiens [sequence omitted]

SEQ ID NO: 838847 - protein, 1268 aa, Homo sapiens
CRWPLWPSRLAAARRRRGERLSHLVLRLWPPPARGVEGVLPETSAGLCSSAGGRAAMEPRPTAPSSGAPGLAGVGETPSAAALAAARVELPGTAVPSVPEDAAPASRDGGGVRDEGPAAAGDGLGRPLGPTPSQSRFQVDLVSENAGRAAAAAAAAAAAAAAAGAGAGAKQTPADGEASGESEPAKGSEEAKGRFRVNFVDPAASSSAEDSLSDAAGVGVDGPNVSFQNGGDTVLSEGSSLHSGGGGGSGHHQHYYYDTHTNTYYLRTFGHNTMDAVPRIDHYRHTAAQLGEKLLRPSLAELHDELEKEPFEDGFANGEESTPTRDAVVTYTAESKGVVKFGWIKGVLVRCMLNIWGVMLFIRLSWIVGQAGIGLSVLVIMMATVVTTITGLSTSAIATNGFVRGGGAYYLISRSLGPEFGGAIGLIFAFANAVAVAMYVVGFAETVVELLKEHSILMIDEINDIRIIGAITVVILLGISVAGMEWEAKAQIVLLVILLLAIGDFVIGTFIPLESKKPKGFFGYKSEIFNENFGPDFREEETFFSVFAIFFPAATGILAGANISGDLADPQSAIPKGTLLAILITTLVYVGIAVSVGSCVVRDATGNVNDTIVTELTNCTSAACKLNFDFSSCESSPCSYGLMNNFQVMSMVSGFTPLISAGIFSATLSSALASLVSAPKIFQALCKDNIYPAFQMFAKGYGKNNEPLRGYILTFLIALGFILIAELNVIAPIISNFFLASYALINFSVFHASLAKSPGWRPAFKYYNMWISLLGAILCCIVMFVINWWAALLTYVIVLGLYIYVTYKKPDVNWGSSTQALTYLNALQHSIRLSGVEDHVKNFRPQCLVMTGAPNSRPALLHLVHDFTKNVGLMICGHVHMGPRRQAMKEMSIDQAKYQRWLIKNKMKAFYAPVHADDLREGAQYLMQAAGLGRMKPNTLVLGFKKDWLQADMRDVDMYINLFHDAFDIQYGVVVIRLKEGLDISHLQGQEELLSSQEKSPGTKDVVVSVEYSKKSDLDTSKPLSEKPITHKVEEEDGKTATQPLLKKESKGPIVPLNVADQKLLEASTQFQKKQGKNTIDVWWLFDDGGLTLLIPYLLTTKKKWKDCKIRVFIGGKINRIDHDRRAMATLLSKFRIDFSDIMVLGDINTKPKKENIIAFEEIIEPYRLHEDDKEQDIADKMKEDEPWRITDNELELYKTKTYRQIRLNELLKEHSSTANIIVMSLPVARKGAVSSALYMAWLEALSKDLPPILLVRGNHQSVLTFYS

SEQ ID NO: 838848 - protein, 1268 aa, Homo sapiens; identical to SEQ ID NO: 838847

SEQ ID NO: 838849 - protein, 1268 aa, Homo sapiens; identical to SEQ ID NO: 838847

SEQ ID NO: 838850 - protein, 717 aa, Homo sapiens
SRLCTYCSDPPIYGDLADPQSAIPKGTLLAILITTLVYVGIAVSVGSCVVRDATGNVNDTIVTELTNCTSAACKLNFDFSSCESSPCSYGLMNNFQVMSMVSGFTPLISAGIFSATLSSALASLVSAPKIFQALCKDNIYPAFQMFAKGYGKNNEPLRGYILTFLIALGFILIAELNVIAPIISNFFLASYALINFSVFHASLAKSPGWRPAFKYYNMWISLLGAILCCIVMFVINWWAALLTYVIVLGLYIYVTYKKPDVNWGSSTQALTYLNALQHSIRLSGVEDHVKNFRPQCLVMTGAPNSRPALLHLVHDFTKNVGLMICGHVHMGPRRQAMKEMSIDQAKYQRWLIKNKMKAFYAPVHADDLREGAQYLMQAAGLGRMKPNTLVLGFKKDWLQADMRDVDMYINLFHDAFDIQYGVVVIRLKEGLDISHLQGQEELLSSQEKSPGTKDVVVSVEYSKKSDLDTSKPLSEKPITHKVEEEDGKTATQPLLKKESKGPIVPLNVADQKLLEASTQFQKKQGKNTIDVWWLFDDGGLTLLIPYLLTTKKKWKDCKIRVFIGGKINRIDHDRRAMATLLSKFRIDFSDIMVLGDINTKPKKENIIAFEEIIEPYRLHEDDKEQDIADKMKEDEPWRITDNELELYKTKTYRQIRLNELLKEHSSTANIIVMSLPVARKGAVSSALYMAWLEALSKDLPPILLVRGNHQSVLTFYS

SEQ ID NO: 838851 - protein, 314 aa, Homo sapiens
AVVSTQSAHYGRGLAAVEKWLTVAELKAVLKDTLEKKGVLGHLKARIRAEVFNALDDDREPRPSLSHENLLINELIREYLEFNKYKYTASVLIAESKGPIVPLNVADQKLLEASTQFQKKQGKNTIDVWWLFDDGGLTLLIPYLLTTKKKWKDCKIRVFIGGKINRIDHDRRAMATLLSKFRIDFSDIMVLGDINTKPKKENIIAFEEIIEPYRLHEDDKEQDIADKMKEDEPWRITDNELELYKTKTYRQIRLNELLKEHSSTANIIVMSLPVARKGAVSSALYMAWLEALSKDLPPILLVRGNHQSVLTFYS

SEQ ID NO: 838852 - protein, 1268 aa, Homo sapiens; identical to SEQ ID NO: 838847

SEQ ID NO: 838853 - protein, 1268 aa, Homo sapiens; identical to SEQ ID NO: 838847

SEQ ID NO: 838854 - protein, 141 aa, Homo sapiens [sequence omitted]

SEQ ID NO: 838855 - protein, 420 aa, Homo sapiens
MPGGCSRGPAAGDGRLRLARLALVLLGWVSSSSPTSSASSFSSSAPFLASAVSAQPPLPDQCPALCECSEAARTVKCVNRNLTEVPTDLPAYVRNLFLTGNQLAVLPAGAFARRPPLAELAALNLSGSRLDEVRAGAFEHLPSLRQLDLSHNPLADLSPFAFSGSNASVSAPSPLVELILNHIVPPEDERQNRSFEGMVVAALLAGRALQGLRRLELASNHFLYLPRDVLAQLPSLRHLDLSNNSLVSLTYVSFRNLTHLESLHLEDNALKVLHNGTLAELQGLPHIRVFLDNNPWVCDCHMADMVTWLKETEVVQGKDRLTCAYPEKMRNRVLLELNSADLDCDPILPPSLQTSYVFLGIVLALIGAIFLLVLYLNRKGIKKWMHNIRDACRDHMEGYHYRYEINADPRLTNLSSNSDV

SEQ ID NO: 838856 - protein, 420 aa, Homo sapiens; identical to SEQ ID NO: 838855

SEQ ID NO: 838857 - protein, 267 aa, Homo sapiens
DESPRERRRAGGRSGLFSVGQGRRKTLRSGCRMRVPLRSKSDRRGWGGEAGAGFWKEVSGTDWRRLDSKRPVFALRKPRQPPLFTPLSCLSQVPQRIQRGAPTRGEEVAPGRRQEEEREQERGAERPDPPCVLSGGKGRGNRPLREAPGGEGVSQVPAAAPLPRFHERKVFFFQTLPPARALRAQPPEPSERAPSQPSSGETRAAMPGGCSRGPAAGDGRLRLARLALVLLGWVSSSSPTSSASSFSSSAPFLASAVSAQPPLPDQC

SEQ ID NO: 838858 - protein, 420 aa, Homo sapiens; identical to SEQ ID NO: 838855

SEQ ID NO: 838859 - protein, 129 aa, Homo sapiens
MPGGCSRGPAAGDGRLRLARLALVLLGWVSSSSPTSSASSFSSSAPFLASAVSAQPPLPDQCPALCECSEAARTVKCVNRNLTEVPTDLPAYVRNLFLTGNQAWSWPATTSFTCRGMCWPNCPASGTWT

SEQ ID NO: 838860 - protein, 165 aa, Homo sapiens
MAASVVCRAATAGAQVLLRARRSPALLRTPALRSTATFAQALQFVPETQVSLLDNGLRVASEQSSQPTCTVGVWIDVGSRFETEKNNGAGYFLEHLAFKGTKNRPGSALEKEVESMGAHLNAYSTREHTAYYIKALSKDLPKAVELLGDIVQNCSLEDSQIDEGT

SEQ ID NO: 838861 - protein, 136 aa, Homo sapiens
STDVPTVAVCNLNEEGTRCVDVDECAPPAEPCGKGHRCVNSPGSFRCECKTGYYFDGISRTCVDVNECQRYPGRLCDHKCGPVRMSMGAHLNAYSTREHTAYYIKALSKDLPKAVELLGDIVQNCSLEDSQIDEGT

SEQ ID NO: 838862 - protein, 165 aa, Homo sapiens; identical to SEQ ID NO: 838860

SEQ ID NO: 838863 - protein, 165 aa, Homo sapiens; identical to SEQ ID NO: 838860

SEQ ID NO: 838864 - protein, 165 aa, Homo sapiens; identical to SEQ ID NO: 838860

SEQ ID NO: 838865 - protein, 165 aa, Homo sapiens; identical to SEQ ID NO: 838860

SEQ ID NO: 838866 - protein, 165 aa, Homo sapiens; identical to SEQ ID NO: 838860

SEQ ID NO: 838867 - protein, 124 aa, Homo sapiens
MKIDDMMFVLQGQWMRLCTSATESEVARGKNILRNALVSHLDGTTPVCEDIGRSLLTYGRRIPLAEWESRIAEVDASVVREICSKYIYDQCPAVAGYGPIEQLPDYNRIRSGMFWRALLGGKPM

SEQ ID NO: 838868 - protein, 165 aa, Homo sapiens; identical to SEQ ID NO: 838860

SEQ ID NO: 838869 - protein, 124 aa, Homo sapiens; identical to SEQ ID NO: 838867

SEQ ID NO: 838870 - protein, 124 aa, Homo sapiens; identical to SEQ ID NO: 838867

SEQ ID NO: 838871 - protein, 367 aa, Homo sapiens
MCAGTGGSAVRASQPKPGQHNRLSRFPPGGGRAPTVRYCACAATANAPSLRLRGATGPTAAGRWRRPWSVGPLPPGHKCYCAPAARRPCCGRQPCGVRQPSLRRSSSCRRRRLACWTTACVWPPSSPLSPLARWECGLMLAAVLRLRRIMGQATFWSIWLSREQRIGLAVPWRRRWRAWGPILMPTAPGSTQLTTSRRCPRICRKLWSSWVTLCRTVVWKTHRLTKERDVILREMQENDASMRDVVFNYLHATAFQGTPLAQAVEGPSENVRKLSRADLTEYLSTHYKGPLEMVLAAAGEWAQHCVTSAKKLGGSPGLCEERCPLSLRSGGNPRGVPWPARKACGPQSAGRTPQCLWGHPLASHPRG

SEQ ID NO: 838872 - protein, 133 aa, Homo sapiens
MCAGTGGSAVRASQPKPGQHNRLSRFPPGGGRAPTVRYCACAATANAPSLRLRGATGPTAAGRWRRPWSVGPLPPGHKCYCAPAARRPCCGRQPCGVRQPSLRRSSSCRRRRLACWTTACVWPPDLWPPHPPG

SEQ ID NO: 838873 - protein, 140 aa, Homo sapiens
MAASVVCRAATAGAQVLLRARRSPALLRTPALRSTATFAQALQFVPETQVSLLDNGLRVASEQSSQPTCTVGVWIDVGSRFETEKNNGAGYFLEHLAFKRHVLACASRREAYVSKRAGPGFVVPPPPQTQHFGSSNLCHR

SEQ ID NO: 838874 - protein, 167 aa, Homo sapiens
MAASVVCRAATAGAQVLLRARRSPALLRTPALRSTATFAQALQFVPETQVSLLDNGLRVASEQSSQPTCTGVWIDVAHAFRATCSKNHGAQCIAVLVSHLAFHTGNNRIVLCSCPVEKGRWMMQWECPSLNCLQQIRKFNHMGIPTIKRADCRNGICRQKLVFKLLA

SEQ ID NO: 838875 - protein, 165 aa, Homo sapiens; identical to SEQ ID NO: 838860

SEQ ID NO: 838876 - protein, 165 aa, Homo sapiens; identical to SEQ ID NO: 838860

SEQ ID NO: 838877 - protein, 182 aa, Homo sapiens
TVQYSYGLRSRLGASWKMAASVVCRAATAGAQVLLRARRSPALLRTPALRSTATFAQALQFVPETQVSLLDNGLRVASEQSSQPTCTVGVWIDVGSRFETEKNNGAGYFLEHLAFKGTKNRPGSALEKEVESMGAHLNAYSTREHTAYYIKALSKDLPKAVELLGDIVQNCSLEDSQIDEGT

SEQ ID NO: 838878 - protein, 165 aa, Homo sapiens; identical to SEQ ID NO: 838860

SEQ ID NO: 838879 - protein, 165 aa, Homo sapiens; identical to SEQ ID NO: 838860

SEQ ID NO: 838880 - protein, 165 aa, Homo sapiens; identical to SEQ ID NO: 838860

SEQ ID NO: 838881 - protein, 124 aa, Homo sapiens; identical to SEQ ID NO: 838867

SEQ ID NO: 838882 - protein, 124 aa, Homo sapiens; identical to SEQ ID NO: 838867

SEQ ID NO: 838883 - protein, 165 aa, Homo sapiens; identical to SEQ ID NO: 838860

SEQ ID NO: 838884 - protein, 520 aa, Homo sapiens
MCAGTGGSAVRASQPKPGQHNRLSRFPPGGGRAPTVRYCACAATANAPSLRLRGATGPTAAGRWRRPWSVGPLPPGHKCYCAPAARRPCCGRQPCGVRQPSLRRSSSCRRRRLACWTTACVWPPSSPLSPLARWECGLMLAAVLRLRRIMGQATFWSIWLSREQRIGLAVPWRRRWRAWGPILMPTAPGSTQLTTSRRCPRICRKLWSSWVTLCRTVVWKTHRLTKERDVILREMQENDASMRDVVFNYLHATAFQGTPLAQAVEGPSENVRKLSRADLTEYLSTHYKGPLEMGVEHQQLVRPRPEAPRWHPMDICSLTPCRFTGSEIRHRDDALPFAHVAIAVEARTMWPCKWPMPSSATMTALMVVACTCPAHWLQVLWPTSYARVSRPSASAMQRRACWVHTLSVTWMRLCTSATESEVARGKNILRNALVSHLDGTTPVCEDIGRSLLTYGRRIPLAEWESRIAEVDASVVREICSKYIYDQCPAVAGYGPIEQLPDYNRIRSGMFWRALLGGKPM

SEQ ID NO: 838885 - protein, 310 aa, Homo sapiens
MCAGTGGSAVRASQPKPGQHNRLSRFPPGGGRAPTVRYCACAATANAPSLRLRGATGPTAAGRWRRPWSVGPLPPGHKCYCAPAARRPCCGRQPCGVRQPSLRRSSSCRRRRLACWTTACVWPPSSPLSPLARWECGLMLAAVLRLRRIMGQATFWSIWLSREQRIGLAVPWRRRWRAWGPILMPTAPGSTQLTTSRRCPRICRKLWSSWVTLCRTVVWKTHRLTKERDVILREMQENDASMRDVVFNYLAEWESRIAEVDASVVREICSKYIYDQCPAVAGYGPIEQLPDYNRIRSGMFWRALLGGKPM

SEQ ID NO: 838886 - protein, 116 aa, Homo sapiens
MAASVVCRAATAGAQVLLRARRSPALLRTPALRSTATFAQALQFVPETQVSLLDNGLRVASEQSSQPTCTVGVWIDVGSRFETEKNNGAGYFLEHLAFKGTKNRPGSALEKEVEPH

SEQ ID NO: 838887 - protein, 69 aa, Homo sapiens
FEDHAMPHHPTLGDAGRCETGPQPITAIIGDHRREGCDLSQHEVREVLVNLRLEIVCVPVGPGLGWVDL

SEQ ID NO: 838888 - protein, 2962 aa, Homo sapiens
IDQLKSSLNKLETEGTLRICAVMGCIMTEALENKSVHFPLRSKYNRLTKVARFLQENPSCLLCNILHHYLHQANYSIIDDATMSDGLPALVTLKKGLVALARQWMKFIVVTPAFKGVSLHRPAQPLKPQIAMDHEHEDGLGLDNGGGLQSDTSADGAEFEFDAATVSEHTMLLEGTANRPPPGSSGPVTGAEIMRKLSKTHTHSDSALKIKGIHPYHSLSYTSGDTATDSPVHVGRAGMPVKDSPRKESLLSYLTGSFPSLHNLLEGTPQRSSAAVKSSSLTRTGNTVATDMLSEHPLLSEPSSVSFYNWMSNAVGNRGSVLQESPVTKSGHNSLPTGVAPNLPTIPSASDFNTVLSSDQNTLDGTHSQHSTSQDDVAGVEEANQGFPAVQLADAQVVFKPLLSHTGIQSQDTMPFCYRMYFGEHLSFSGTLDCLRADIVDSDTAKERKGKRARRQGHVNLPPLEFKPALMLGTFSISAVVMEKSVCTPQNSTSALSFHDLSKRYYNTFHCNFTISCQSISQHVDMALVRLIHQFSTMIDDIKATQTDIKLSRYTAGSASPTPTFKTRKHRDFRSSDFSRSSRGSLNGGNRVNNAKNKRTNNENNKKESRNKNSLGRSERRTSKVSRKGSKDVVDHMTIHMDDSDSITVSEQSEPSAECWQNMYKLLNFYSLISDPTGILEKSSETFGPAGVRSPTEPTCKVVFENEQDNSSLTKTQRKRSLVTSEPQHVTLIVFGIGMVNRTHLEADIGGLTMESELKRIHGSFTLKEKMKDVLHQKMTETCATAHIGGVNIVLLEGITPNIQLEDFPTSPTSTAKQEFLTVVKCSIAKSQALYSAQRGLKTNNAAVFKVGAISINIPQHPATLHSMMVRSSHQLSKQISDLIRQPSTAPQPVKEDIATPLPSEKTPTSVNQTPVETNEFPQLPEGLEKKPIVLKFSAMLDGIAIGAALLPSLKAEYKMGRMRSHGMTGAQTRFTFELPNHRLRFTSKVSATDMSTIPPSASLNLPPVTMSGKYIMEEHDSYSDQVWSIDELPSKQGYYLQGNYLRCVAEVGSFEHNLTTDLLNHLVFVQKVFMKEVNEVIQKVSGGEQPIPLWNEHDGTADGDKPKILLYSLNLQFKGIQVTATTPSMRAVRFETGLIELELSNRLQTKASPGSSSYLKLFGKCQVDLNLALGQIVKHQVYEEAGSDFHQVAYFKTRIGLRNALREEISGSSDREAVLITLNRPIVYAQPVAFDRAVLFWLNYKAAYDNWNEQRMALHKDIHMATKEVVDMLPGIQQTSAQAFGTLFLQLTVNDLGICLPITNTAQSNHTGDLDTGSALVLTIESTLITACSSESLVSKGHFKNFCIRFADGFETSWDDWKPEIHGDLVMNACVVPDGTYEVCSRTTGQAAAESSSAGTWTLNVLWKMCGIDVHMDPNIGKRLNALGNTLTTLTGEEDIDDIADLNSVNIADLSDEDEVDTMSPTIHTEATDYRRQAASASQPGELRGRKIMKRIVDIRELNEQAKVIDDLKKLGASEGTINQEIQRYQQLESVAVNDIRRDVRKKLRRSSMRAASLKDKWGLSYKPSYSRSKSISASGRPPLKRMERASSRVGETEELPEIRVDAASPGPRVTFNIQDTFPEETELDLLSVTIEGPSHYSSNSEGSCSVFSSPKTPGGFSPGIPFQTEEGRRDDSLSSTSEDSEKDEKDEDHERERFYIYRKPSHTSRKKATGFAAVHQLFTERWPTTPVNRSLSGTATERNIDFELDIRVEIDSGKCVLHPTTLLQEHDDISLRRSYDRSSRSLDQDSPSKKKKFQTNYASTTHLMTGKKVPSSLQTKPSDLETTVFYIPGVDVKLHYNSKTLKTESPNASRGSSLPRTLSKESKLYGMKDSATSPPSPPLPSTVQSKTNTLLPPQPPPIPAAKGKGSGGVKTAKLYAWVALQSLPEEMVISPCLLDFLEKALETIPITPVERNYTAVSSQDEDMGHFEIPDPMEESTTSLVSSSTSAYSSFPVDVVVYVRVQPSQIKFSCLPVSRVECMLKLPSLDLVFSSNRGELETLGTTYPAETLSPGGNATQSGTKTSASKTGIPGSSGLGSPLGRSRHSSSQSDLTSSSSSSSGLSFTACMSDFSLYVFHPYGAGKQKTAVSGLTPGSGGLGNVDEEPTSVTGRKDSLSINLEFVKVSLSRIRRSGGASFFESQSVSKSASKMDTTLINISAVCDIGSASFKYDMRRLSEILAFPRAWYRRSIARRLFLGDQTINLPTSGPGTPDSIEGVSQHLSPESSRKAYCKTWEQPSQSASFTHMPQSPNVFNEHMTNSTMSPGTVGQSLKSPASIRSRSVSDSSVPRRDSLSKTSTPFNKSNKAASQQGTPWETLVVFAINLKQLNVQMNMSNVMGNTTWTTSGLKSQGRLSVGSNRDREISMSVGLGRSQLDSKGGVVGGTIDVNALEMVAHISEHPNQQPSHKIQITMGSTEARVDYMGSSILMGIFSNADLKLQDEWKVNLYNTLDSSITDKSEIFVHGDLKWDIFQVMISRSTTPDLIKIGMKLQEFFTQQFDTSKRALSTWGPVPYLPPKTMTSNLEKSSQEQLLDAAHHRHWPGVLKVVSGCHISLFQIPLPEDGMQFGGSMSLHGNHMTLACFHGPNFRSKSWALFHLEEPNIAFWTEAQKIWEDGSSDHSTYIVQTLDFHLGHNTMVTKPCGALESPMATITKITRRRHENPPHGVASVKEWFNYVTATRNEELNLLRNVDANNTENSTTVKNSSLLSGFRGGSSYNHETETIFALPRMQLDFKSIHVQEPQEPSLQDASLKPKVECSVVTEFTDHICVTMDAELIMFLHDLVSAYLKEKEKAIFPPRILSTRPGQKSPIIIHDDNSSDKDREDSITYTTVDWRDFMCNTWHLEPTLRLISWTGRKIDPVGVDYILQKLGFHHARTTIPKWLQRGVMDPLDKVLSVLIKKLGTALQDEKEKKGKDKEEH

SEQ ID NO: 838889 - protein, 2952 aa, Homo sapiens
IDQLKSSLNKLETEGTLRICAVMGCIMTEALENKSVHFPLRSKYNRLTKVARFLQENPSCLLCNILHHYLHQANYSIIDDATMSDGLPALVTLKKGLVALARQWMKFIVVTPAFKGVSLHRPAQPLKPQIAMDHEHEDGLGLDNGGGLQSDTSADGAEFEFDAATVSEHTMLLEGTANRPPPGSSGPVTGAEIMRKLSKTHTHSDSALKIKGIHPYHSLSYTSGDTATDSPVHVGRAGMPVKDSPRKESLLSYLTGSFPSLHNLLEGTPQRSSAAVKSSSLTRTGNTVATDMLSEHPLLSEPSSVSFYNWMSNAVGNRGSVLQESPVTKSGHNSLPTGVAPNLPTIPSASDFNTVLSSDQNTLDGTHSQHSTSQDDVAGVEEANQGFPAVQLADAQVVFKPLLSHTGIQSQDTMPFCYRMYFGEHLSFSGTLDCLRADIVDSDTAKERKGKRARRQGHVNLPPLEFKPALMLGTFSISAVVMEKSVCTPQNSTSALSFHDLSKRYYNTFHCNFTISCQSISQHVDMALVRLIHQFSTMIDDIKATQTDIKLSRYTAGSASPTPTFKTRKHRDFRSSDFSRSSRGSLNGGNRVNNAKNKRTNNENNKKESRNKNSLGRSERRTSKVSRKGSKDVVDHMTIHMDDSDSITVSEQSEPSAECWQNMYKLLNFYSLISDPTGILEKSSETFGPAGVRSPTEPTCKVVFENEQDNSSLTKTQRKRSLVTSEPQHVTLIVFGIGMVNRTHLEADIGGLTMESELKRIHGSFTLKEKMKDVLHQKMTETCATAHIGGVNIVLLEGITPNIQLEDFPTSPTSTAKQEFLTVVKCSIAKSQALYSAQRGLKTNNAAVFKVGAISINIPQHPATLHSMMVRSSHQLSKQISDLIRQPSTAPQPVKEDIATPLPSEKTPTSVNQTPVETNEFPQLPEGLEKKPIVLKFSAMLDGIAIGAALLPSLKAEYKMGRMRSHGMTGAQTRFTFELPNHRLRFTSKVSATDMSTIPPSASLNLPPVTMSGKYIMEEHDSYSDQVWSIDELPSKQGYYLQGNYLRCVAEVGSFEHNLTTDLLNHLVFVQKVFMKEVNEVIQKVSGGEQPIPLWNEHDGTADGDKPKILLYSLNLQFKGIQVTATTPSMRAVRFETGLIELELSNRLQTKASPGSSSYLKLFGKCQVDLNLALGQIVKHQVYEEAGSDFHQVAYFKTRIGLRNALREEISGSSDREAVLITLNRPIVYAQPVAFDRAVLFWLNYKAAYDNWNEQRMALHKDIHMATKEVVDMLPGIQQTSAQAFGTLFLQLTVNDLGICLPITNTAQSNHTGDLDTGSALVLTIESTLITACSSESLVSKGHFKNFCIRFADGFETSWDDWKPEIHGDLVMNACVVPDGTYEVCSRTTGQAAAGEEDIDDIADLNSVNIADLSDEDEVDTMSPTIHTSSDGSSISGDGHKLTFGQRLVNHLLGLTPPNQRHSVPAEYLCDPEMWGSPQSSQSHLKACRAHSWGNEATDYRRQAASASQPGELRGRKIMKRIVDIRELNEQAKVIDDLKKLGASEGTINQEIQRYQQLESVAVNDIRRDVRKKLRRSSMRAASLKDKWGLSYKPSYSRSKSISASGRPPLKRMERASSRVGETEELPEIRVDAASPGPRVTFNIQDTFPEETELDLLSVTIEGPSHYSSNSEGSCSVFSSPKTPGGFSPGIPFQTEEGRRDDSLSSTSEDSEKDEKDEDHERERFYIYRKPSHTSRKKATGFAAVHQLFTERWPTTPVNRSLSGTATERNIDFELDIRVEIDSGKCVLHPTTLLQEHDDISLRRSYDRSSRSLDQDSPSKKKKFQTNYASTTHLMTGKKVPSSLQTKPSDLETTVFYIPGVDVKLHYNSKTLKTESPNASRGSSLPRTLSKESKLYAKGKGSGGVKTAKLYAWVALQSLPEEMVISPCLLDFLEKALETIPITPVERNYTAVSSQDEDMGHFEIPDPMEESTTSLVSSSTSAYSSFPVDVVVYVRVQPSQIKFSCLPVSRVECMLKLPSLDLVFSSNRGELETLGTTYPAETLSPGGNATQSGTKTSASKTGIPGSSGLGSPLGRSRHSSSQSDLTSSSSSSSGLSFTACMSDFSLYVFHPYGAGKQKTAVSGLTPGSGGLGNVDEEPTSVTGRKDSLSINLEFVKVSLSRIRRSGGASFFESQSVSKSASKMDTTLINISAVCDIGSASFKYDMRRLSEILAFPRAWYRRSIARRLFLGDQTINLPTSGPGTPDSIEGVSQHLSPESSRKAYCKTWEQPSQSASFTHMPQSPNVFNEHMTNSTMSPGTVGQSLKSPASIRSRSVSDSSVPRRDSLSKTSTPFNKSNKAASQQGTPWETLVVFAINLKQLNVQMNMSNVMGNTTWTTSGLKSQGRLSVGSNRDREISMSVGLGRSQLDSKGGVVGGTIDVNALEMVAHISEHPNQQPSHKIQITMGSTEARVDYMGSSILMGIFSNADLKLQDEWKVNLYNTLDSSITDKSEIFVHGDLKWDIFQVMISRSTTPDLIKIGMKLQEFFTQQFDTSKRALSTWGPVPYLPPKTMTSNLEKSSQEQLLDAAHHRHWPGVLKVVSGCHISLFQIPLPEDGMQFGGSMSLHGNHMTLACFHGPNFRSKSWALFHLEEPNIAFWTEAQKIWEDGSSDHSTYIVQTLDFHLGHNTMVTKPCGALESPMATITKITRRRHENPPHGVASVKEWFNYVTATRNEELNLLRNVDANNTENSTTVKNSSLLSGFRGGSSYNHETETIFALPRMQLDFKSIHVQEPQEPSLQDASLKPKVECSVVTEFTDHICVTMDAELIMFLHDLVSAYLKEKEKAIFPPRILSTRPGQKSPIIIHDDNSSDKDREDSITYTTVDWRDFMCNTWHLEPTLRLISWTGRKIDPVGVDYILQKLGFHHARTTIPKWLQRGVMDPLDKVLSVLIKKLGTALQDEKEKKGKDKEEH

SEQ ID NO: 838890 - protein, 2952 aa, Homo sapiens; identical to SEQ ID NO: 838889

SEQ ID NO: 838891 - protein, 2198 aa, Homo sapiens
IDQLKSSLNKLETEGTLRICAVMGCIMTEALENKSVHFPLRSKYNRLTKVARFLQENPSCLLCNILHHYLHQANYSIIDDATMSDGLPALVTLKKGLVALARQWMKFIVVTPAFKGVSLHRPAQPLKPQIAMDHEHEDGLGLDNGGGLQSDTSADGAEFEFDAATVSEHTMLLEGTANRPPPGSSGPVTGAEIMRKLSKTHTHSDSALKIKGIHPYHSLSYTSGDTATDSPVHVGRAGMPVKDSPRKESLLSYLTGSFPSLHNLLEGTPQRSSAAVKSSSLTRTGNTVATDMLSEHPLLSEPSSVSFYNWMSNAVGNRGSVLQESPVTKSGHNSLPTGVAPNLPTIPSASDFNTVLSSDQNTLDGTHSQHSTSQDDVAGVEEANQGFPAVQLADAQVVFKPLLSHTGIQSQDTMPFCYRMYFGEHLSFSGTLDCLRADIVDSDTAKERKGKRARRQGHVNLPPLEFKPALMLGTFSISAVVMEKSVCTPQNSTSALSFHDLSKRYYNTFHCNFTISCQSISQHVDMALVRLIHQFSTMIDDIKATQTDIKLSRYTAGSASPTPTFKTRKHRDFRSSDFSRSSRGSLNGGNRVNNAKNKRTNNENNKKESRNKNSLGRSERRTSKVSRKGSKDVVDHMTIHMDDSDSITVSEQSEPSAECWQNMYKLLNFYSLISDPTGILEKSSETFGPAGVRSPTEPTCKVVFENEQDNSSLTKTQRKRSLVTSEPQHVTLIVFGIGMVNRTHLEADIGGLTMESELKRIHGSFTLKEKMKDVLHQKMTETCATAHIGGVNIVLLEGITPNIQLEDFPTSPTSTAKQEFLTVVKCSIAKSQALYSAQRGLKTNNAAVFKVGAISINIPQHPATLHSMMVRSSHQLSKQISDLIRQPSTAPQPVKEDIATPLPSEKTPTSVNQTPVETNEFPQLPEGLEKKPIVLKFSAMLDGIAIGAALLPSLKAEYKMGRMRSHGMTGAQTRFTFELPNHRLRFTSKVSATDMSTIPPSASLNLPPVTMSGKYIMEEHDSYSDQVWSIDELPSKQGYYLQGNYLRCVAEVGSFEHNLTTDLLNHLVFVQKVFMKEVNEVIQKVSGGEQPIPLWNEHDGTADGDKPKILLYSLNLQFKGIQVTATTPSMRAVRFETGLIELELSNRLQTKASPGSSSYLKLFGKCQVDLNLALGQIVKHQVYEEAGSDFHQVAYFKTRIGLRNALREEISGSSDREAVLITLNRPIVYAQPVAFDRAVLFWLNYKAAYDNWNEQRMALHKDIHMATKEVVDMLPGIQQTSAQAFGTLFLQLTVNDLGICLPITNTAQSNHTGDLDTGSALVLTIESTLITACSSESLVSKGHFKNFCIRFADGFETSWDDWKPEIHGDLVMNACVVPDGTYEVCSRTTGQAAAGEEDIDDIADLNSVNIADLSDEDEVDTMSPTIHTSSDGSSISGDGHKLTFGQRLVNHLLGLTPPNQRHSVPAEYLCDPEMWGSPQSSQSHLKACRAHSWGNEATDYRRQAASASQPGELRGRKIMKRIVDIRELNEQAKVIDDLKKLGASEGTINQEIQRYQQLESVAVNDIRRDVRKKLRRSSMRAASLKDKWGLSYKPSYSRSKSISASGRPPLKRMERASSRVGETEELPEIRVDAASPGPRVTFNIQDTFPEETELDLLSVTIEGPSHYSSNSEGSCSVFSSPKTPGGFSPGIPFQTEEGRRDDSLSSTSEDSEKDEKDEDHERERFYIYRKPSHTSRKKATGFAAVHQLFTERWPTTPVNRSLSGTATERNIDFELDIRVEIDSGKCVLHPTTLLQEHDDISLRRSYDRSSRSLDQDSPSKKKKFQTNYASTTHLMTGKKVPSSLQTKPSDLETTVFYIPGVDVKLHYNSKTLKTESPNASRGSSLPRTLSKESKLYAKGKGSGGVKTAKLYAWVALQSLPEEMVISPCLLDFLEKALETIPITPVERNYTAVSSQDEDMGHFEIPDPMEESTTSLVSSSTSAYSSFPVDVVVYVRVQPSQIKFSCLPVSRVECMLKLPSLDLVFSSNRGELETLGTTYPAETLSPGGNATQSGTKTSASKTGIPGSSGLGSPLGRSRHSSSQSDLTSSSSSSSGLSFTACMSDFSLYVFHPYGAGKQKTAVSGLTPGSGGLGNVDEEPTSVTGRKDSLSINLEFVKVSLSRIRRSGGASFFESQSVSKSASKMDTTLINISGTQFYSF

SEQ ID NO: 838892 - protein, 1637 aa, Homo sapiens
IDQLKSSLNKLETEGTLRICAVMGCIMTEALENKSVHFPLRSKYNRLTKVARFLQENPSCLLCNILHHYLHQANYSIIDDATMSDGLPALVTLKKGLVALARQWMKFIVVTPAFKGVSLHRPAQPLKPQIAMDHEHEDGLGLDNGGGLQSDTSADGAEFEFDAATVSEHTMLLEGTANRPPPGSSGPVTGAEIMRKLSKTHTHSDSALKIKGIHPYHSLSYTSGDTATDSPVHVGRAGMPVKDSPRKESLLSYLTGSFPSLHNLLEGTPQRSSAAVKSSSLTRTGNTVATDMLSEHPLLSEPSSVSFYNWMSNAVGNRGSVLQESPVTKSGHNSLPTGVAPNLPTIPSASDFNTVLSSDQNTLDGTHSQHSTSQDDVAGVEEANQGFPAVQLADAQVVFKPLLSHTGIQSQDTMPFCYRMYFGEHLSFSGTLDCLRADIVDSDTAKERKGKRARRQGHVNLPPLEFKPALMLGTFSISAVVMEKSVCTPQNSTSALSFHDLSKRYYNTFHCNFTISCQSISQHVDMALVRLIHQFSTMIDDIKATQTDIKLSRYTAGSASPTPTFKTRKHRDFRSSDFSRSSRGSLNGGNRVNNAKNKRTNNENNKKESRNKNSLGRSERRTSKVSRKGSKDVVDHMTIHMDDSDSITVSEQSEPSAECWQNMYKLLNFYSLISDPTGILEKSSETFGPAGVRSPTEPTCKVVFENEQDNSSLTKTQRKRSLVTSEPQHVTLIVFGIGMVNRTHLEADIGGLTMESELKRIHGSFTLKEKMKDVLHQKMTETCATAHIGGVNIVLLEGITPNIQLEDFPTSPTSTAKQEFLTVVKCSIAKSQALYSAQRGLKTNNAAVFKVGAISINIPQHPATLHSMMVRSSHQLSKQISDLIRQPSTAPQPVKEDIATPLPSEKTPTSVNQTPVETNEFPQLPEGLEKKPIVLKFSAMLDGIAIGAALLPSLKAEYKMGRMRSHGMTGAQTRFTFELPNHRLRFTSKVSATDMSTIPPSASLNLPPVTMSGKYIMEEHDSYSDQVWSIDELPSKQGYYLQGNYLRCVAEVGSFEHNLTTDLLNHLVFVQKVFMKEVNEVIQKVSGGEQPIPLWNEHDGTADGDKPKILLYSLNLQFKGIQVTATTPSMRAVRFETGLIELELSNRLQTKASPGSSSYLKLFGKCQVDLNLALGQIVKHQVYEEAGSDFHQVAYFKTRIGLRNALREEISGSSDREAVLITLNRPIVYAQPVAFDRAVLFWLNYKAAYDNWNEQRMALHKDIHMATKEVVDMLPGIQQTSAQAFGTLFLQLTVNDLGICLPITNTAQSNHTGDLDTGSALVLTIESTLITACSSESLVSKGHFKNFCIRFADGFETSWDDWKPEIHGDLVMNACVVPDGTYEVCSRTTGQAAAESSSAGTWTLNVLWKMCGIDVHMDPNIGKRLNALGNTLTTLTGEEDIDDIADLNSVNIADLSDEDEVDTMSPTIHTEATDYRRQAASASQPGELRGRKIMKRIVDIRELNEQAKVIDDLKKLGASEGTINQEIQRYQQLESVAVNDIRRDVRKKLRRSSMRAASLKDKWGLSYKPSYSRSKSISASGRPPLKRMERASSRVGETEELPEIRVDAASPGPRVTFNIQDTIAEIRRKKISFKVVF

SEQ ID NO: 838893 - protein, 500 aa, Homo sapiens
MGTARWLALGSLFALAGLLEGRLVGEEEAGFGECDKFFYAGTPPAGLAADSHVKICQRAEGAERFATLYSTRDRIPVYSAFRAPRPAPGGAEQRWLVEPQIDDPNSNLEEAINEAEAITSVNSLGSKQALNTDYLDSDYQRGQLYPFSLSSDVQVATFTLTNSAPMTQSFQERWYVNLHSLMDRALTPQCGSGEDLYILTGTVPSDYRVKDKVAVPEFVWLAACCAVPGGGWAMGFVKHTRDSDIIEDVMVKDLQKLLPFNPQLFQNNCGETEQDTEKMKKILEVVNQIQDEERMVQSQKSSSPLSSTRSKRSTLLPPEASEGSSSFLGKLMGFIATPFIKLFQLIYYLVVAILKNIVYFLWCVTKQVINGIESCLYRLGSATISYFMAIGEELVSIPWKVLKVVAKVIRALLRILCCLLKAICRVLSIPVRVLVDVATFPVYTMGAIPIVCKDIALGLGGTVSLLFDTAFGTLGGLFQVVFSVCKRIGYKVTFDNSGEL

SEQ ID NO: 838894 - protein, 500 aa, Homo sapiens; identical to SEQ ID NO: 838893

SEQ ID NO: 838895 - protein, 500 aa, Homo sapiens; identical to SEQ ID NO: 838893

SEQ ID NO: 838896 - protein, 500 aa, Homo sapiens; identical to SEQ ID NO: 838893

SEQ ID NO: 838897 - protein, 500 aa, Homo sapiens; identical to SEQ ID NO: 838893

SEQ ID NO: 838898 - protein, 489 aa, Homo sapiens
MGTARWLALGSLFALAGLLEGRLVGEEEAGFGECDKFFYAGTPPAGLAADSHVKICQRAEGAERFATLYSTRDRIPVYSAFRAPRPAPGGAEQRWLVEPQIDDPNSNLEEAINEAEAITSVNSLGSKQALNTDYLDSDYQRGQLYPFSLSSDVQVATFTLTNSAPMTQSFQERWYVNLHSLMDRALTPQCGSGEDLYILTGTVPSDYRVKDKVAVPEFVWLAACCAVPGGGWAMGFVKHTRDSDIIEDVMVKDLQKLLPFNPQLFQNNCGETEQDTEKMKKILEVVNQIQDEERMVQSQKRSTLLPPEASEGSSSFLGKLMGFIATPFIKLFQLIYYLVVAILKNIVYFLWCVTKQVINGIESCLYRLGSATISYFMAIGEELVSIPWKVLKVVAKVIRALLRILCCLLKAICRVLSIPVRVLVDVATFPVYTMGAIPIVCKDIALGLGGTVSLLFDTAFGTLGGLFQVVFSVCKRIGYKVTFDNSGEL

SEQ ID NO: 838899 - protein, 500 aa, Homo sapiens; identical to SEQ ID NO: 838893

SEQ ID NO: 838900 - protein, 500 aa, Homo sapiens; identical to SEQ ID NO: 838893

SEQ ID NO: 838901 - protein, 500 aa, Homo sapiens; identical to SEQ ID NO: 838893

SEQ ID NO: 838902 - protein, 500 aa, Homo sapiens; identical to SEQ ID NO: 838893

SEQ ID NO: 838903 - protein, 69 aa, Homo sapiens
EPLSLALRWHLPCARYWAKCFVRTTTLQVVTIIILILQKGKLRHKEHALSYGYLVAETGPTPSGFRVQA

SEQ ID NO: 838904 - protein, 253 aa, Homo sapiens
LLVVLLRTVFLGLVVRFPSFPFFLSFSVMFSVCRPPGGGLFFCILLPPSLGTPLVGDGFPPLCAPPESPLFGVFFTKPLAGGAPARAFYMWWREIPRPVVLFPGGLPLDPLLWPLLAPLPPWAPPAPPPRVLFLKTFFSGPSAARAANGFVFFFFCFFFLIFFFFFFFFIFNCLVFPAFIGSCRNQIGRSSVPAAPNVEKYSRSIPKEPTPMTWTQESYNLRGLFPSVHCRAHATHHLACPDPRRATPCDNSR

SEQ ID NO: 838905 - protein, 491 aa, Homo sapiens
MIATGGVITGLAALKRQDSARSQQHVNLSPSPATQEKKPIRRRPRADVVVVRGKIRLYSPSGFFLILGVLISIIGIAMAVLGYWPQKEHFIDAETTLSTNETQVIRNEGGVVVRFFEQHLHSDKMKMLGPFTMGIGIFIFICANAILHENRDKETKIIHMRDIYSTVIDIHTLRIKEQRQMNGMYTGLMGETEVKQNGSSCASRLAANTIASFSGFRSSFRMDSSVEEDELMLNEGKSSGHLMPPLLSDSSVSVFGLYPPPSKTTDDKTSGSKKCETKSIVSSSISAFTLPVIKLNNCVIDEPSIDNITEDADNLKSRSRNLSMDSLVVPLPNTSESFQPVSTVLPRNNSIGESLSSQYKSSMALGPGAGQLLSPGAARRQFGSNTSLHLLSSHSKSLDLDRGPSTLTVQAEQRKHPSWPRLDRNNSKGYMKLENKEDPMDRLLVPQVAIKKDFTNKEKLLMISRSHNNLSFEHDEFLSNNLKRGTSETRF

SEQ ID NO: 838906 - protein, 491 aa, Homo sapiens; identical to SEQ ID NO: 838905

SEQ ID NO: 838907 - protein, 542 aa, Homo sapiens
MTFSEILDRVGSMGHFQFLHVAILGLPILNMANHNLLQIFTAATPVHHCRPPHNASTGPWVLPMGPNGKPERCLRFVHPPNASLPNDTQRAMEPCLDGWVYNSTKDSIVTEWDLVCNSNKLKEMAQSIFMAGILIGGLVLGDLSDRFGRRPILTCSYLLLAASGSGAAFSPTFPIYMVFRFLCGFGISGITLSTVILNVEWVPTRMRAIMSTALGYCYTFGQFILPGLAYAIPQWRWLQLTVSIPFFVFFLSSWWTPESIRWLVLSGKSSKALKILRRVAVFNGKKEEGERLSLEELKLNLQKEISLAKAKYTASDLFRIPMLRRMTFCLSLAWFATGFAYYSLAMGVEEFGVNLYILQIIFGGVDVPAKFITILSLSYLGRHTTQAAALLLAGGAILALTFVPLDLQTVRTVLAVFGKGCLSSSFSCLFLYTSELYPTVIRQTGMGVSNLWTRVGSMVSPLVKITGEVQPFIPNIIYGITALLGGSAALFLPETLNQPLPETIEDLENWSLRAKKPKQEPEVEKASQRIPLQPHGPGLGSS

SEQ ID NO: 838908 - protein, 533 aa, Homo sapiens
MTFSEILDRVGSMGHFQFLHVAILGLPILNMANHNLLQIFTAATPVHHCRPPHNASTGPWVLPMGPNGKPERCLRFVHPPNASLPNDTQRAMEPCLDGWVYNSTKDSIVTEWDLVCNSNKLKEMAQSIFMAGILIGGLVLGDLSDRFGRRPILTCSYLLLAASGSGAAFSPTFPIYMVFRFLCGFGISGITLSTVILNVEWVPTRMRAIMSTALGYCYTFGQFILPGLAYAIPQWRWLQLTVSIPFFVFFLSSWWTPESIRWLVLSGKSSKALKILRRVAVFNGKKEEGERLSLEELKLNLQKEISLAKAKYTASDLFRIPMLRRMTFCLSLAWFATGFAYYSLAMGVEEFGVNLYILQIIFGGVDVPAKFITILSLSYLGRHTTQAAALLLAGGAILALTFVPLDLQTVRTVLAVFGKGCLSSSFSCLFLYTSELYPTVIRQTGMGVSNLWTRVGSMVSPLVKITGEVQPFIPNIIYGITALLGGSAALFLPETLNQPLPETIEDLENWSVTASGPISAPPWGSRSGPRAFP

SEQ ID NO: 838909 - protein, 533 aa, Homo sapiens; identical to SEQ ID NO: 838908

SEQ ID NO: 838910 - protein, 451 aa, Homo sapiens
MEPCLDGWVYNSTKDSIVTEWDLVCNSNKLKEMAQSIFMAGILIGGLVLGDLSDRFGRRPILTCSYLLLAASGSGAAFSPTFPIYMVFRFLCGFGISGITLSTVILNVEWVPTRMRAIMSTALGYCYTFGQFILPGLAYAIPQWRWLQLTVSIPFFVFFLSSWWTPESIRWLVLSGKSSKALKILRRVAVFNGKKEEGERLSLEELKLNLQKEISLAKAKYTASDLFRIPMLRRMTFCLSLAWFATGFAYYSLAMGVEEFGVNLYILQIIFGGVDVPAKFITILSLSYLGRHTTQAAALLLAGGAILALTFVPLDLQTVRTVLAVFGKGCLSSSFSCLFLYTSELYPTVIRQTGMGVSNLWTRVGSMVSPLVKITGEVQPFIPNIIYGITALLGGSAALFLPETLNQPLPETIEDLENWSLRAKKPKQEPEVEKASQRIPLQPHGPGLGSS

SEQ ID NO: 838911 - protein, 533 aa, Homo sapiens; identical to SEQ ID NO: 838908

SEQ ID NO: 838912 - protein, 533 aa, Homo sapiens; identical to SEQ ID NO: 838908

SEQ ID NO: 838913 - protein, 104 aa, Homo sapiens
MLLPWIFATHVSDPFMSPYHHSLESDTQSCLESQQSSCSGIHRDPRVLHTPALGSLARQEICLYISLGKGLNPRSQTASFCRLHFHGTSQFKTLWLGIPAGQWQ

SEQ ID NO: 838914 - protein, 368 aa, Homo sapiens
MAIKSIASRLRGSRRFLSGFVAGAVVGAAGAGLAALQFFRSQGAEGALTGKQPDGSAEKAVLEQFGFPLTGTEARCYTNHALSYDQAKRVPRWVLEHISKSKIMGDADRKHCKFKPDPNIPPTFSAFNEDYVGSGWSRGHMAPAGNNKFSSKAMAETFYLSNIVPQDFDNNSGYWNRIEMYCRELTERFEDVWVVSGPLTLPQTRGDGKKIVSYQVIGEDNVAVPSHLYKVILARRSSVSTEPLALGAFVVPNEAIGFQPQLTEFQVSLQDLEKLSGLVFFPHLDRTSDIRNICSVDTCKLLDFQEFTLYLSTRKIEGARSVLRLEKIMENLKNAEIEPDDYFMSRYEKKLEELKAKEQSGTQIRKPS

SEQ ID NO: 838915 - protein, 186 aa, Homo sapiens
MAETFYLSNIVPQDFDNNSGYWNRIEMYCRELTERFEDVWVVSGPLTLPQTRGDGKKIVSYQVIGEDNVAVPSHLYKDHAGCCVESPLGTRTSEEATARIQERDDGGSDQRSGLVELGIYFKVEPTGFPAGLDVGCEKQRGGKDDVKGFGLSSWKSSRAPPWGLLSGFNCLLGPVGEAETETEGRG

SEQ ID NO: 838916 - protein, 318 aa, Homo sapiens
MAIKSIASRLRGSRRFLSGFVAGAVVGAAGAGLAALQFFRSQGAEGALTGKQPDGDADRKHCKFKPDPNIPPTFSAFNEDYVGSGWSRGHMAPAGNNKFSSKAMAETFYLSNIVPQDFDNNSGYWNRIEMYCRELTERFEDVWVVSGPLTLPQTRGDGKKIVSYQVIGEDNVAVPSHLYKVILARRSSVSTEPLALGAFVVPNEAIGFQPQLTEFQVSLQDLEKLSGLVFFPHLDRTSDIRNICSVDTCKLLDFQEFTLYLSTRKIEGARSVLRLEKIMENLKNAEIEPDDYFMSRYEKKLEELKAKEQSGTQIRKPS

SEQ ID NO: 838917 - protein, 368 aa, Homo sapiens; identical to SEQ ID NO: 838914

SEQ ID NO: 838918 - protein, 437 aa, Homo sapiens
MAIKSIASRLRGSRRFLSGFVAGAVVGAAGAGLAALQFFRSQGAEGALTGKQPDGSAEKAVLEQFGFPLTGTEARCYTNHALSYDQAKRVPRWVLEHISKSKIMGRFFKFTLLASLFLLSLNLHLWLVLNFWVQVTLLPQPPEYAGITGTTWKVVLALNGERSKGRYKVCSREGDADRKHCKFKPDPNIPPTFSAFNEDYVGSGWSRGHMAPAGNNKFSSKAMAETFYLSNIVPQDFDNNSGYWNRIEMYCRELTERFEDVWVVSGPLTLPQTRGDGKKIVSYQVIGEDNVAVPSHLYKVILARRSSVSTEPLALGAFVVPNEAIGFQPQLTEFQVSLQDLEKLSGLVFFPHLDRTSDIRNICSVDTCKLLDFQEFTLYLSTRKIEGARSVLRLEKIMENLKNAEIEPDDYFMSRYEKKLEELKAKEQSGTQIRKPS

SEQ ID NO: 838919 - protein, 368 aa, Homo sapiens; identical to SEQ ID NO: 838914

SEQ ID NO: 838920 - protein, 165 aa, Homo sapiens
MIYTMKKVHALWASVCLLLNLAPAPLNADSEEDEEHTIITDTELPPLKLMHSFCAFKADDGPCKAIMKRFFFNIFTRQCEEFIYGGCEGNQNRFESLEECKKMCTRDNANRIIKTTLQQEKPDFCFLEEDPGICRGYITRYFYNNQTKQCERFKYGWMPGQYEQF

SEQ ID NO: 838921 - protein, 165 aa, Homo sapiens; identical to SEQ ID NO: 838920

SEQ ID NO: 838922 - protein, 165 aa, Homo sapiens; identical to SEQ ID NO: 838920

SEQ ID NO: 838923 - protein, 165 aa, Homo sapiens; identical to SEQ ID NO: 838920

SEQ ID NO: 838924 - protein, 165 aa, Homo sapiens; identical to SEQ ID NO: 838920

SEQ ID NO: 838925 - protein, 165 aa, Homo sapiens; identical to SEQ ID NO: 838920

SEQ ID NO: 838926 - protein, 165 aa, Homo sapiens; identical to SEQ ID NO: 838920

SEQ ID NO: 838927 - protein, 208 aa, Homo sapiens
MGDVKEIRIDLKVWKSAKKCVQEKSQISAFWKKILEYVEVILPGIFITIRQNSVNVSSMGGCLGNMNNFETLEECKNICEDGPNGFQVDNYGTQLNAVNNSLTPQSTKVPSLFEFHGPSWCLTPADRGLCRANENRFYYNSVIGKCRPFKYSGCGGNENNFTSKQECLRACKKGFIQRISKGGLIKTKRKRKKQRVKIAYEEIFVKNM

SEQ ID NO: 838928 - protein, 165 aa, Homo sapiens; identical to SEQ ID NO: 838920

SEQ ID NO: 838929 - protein, 165 aa, Homo sapiens; identical to SEQ ID NO: 838920

SEQ ID NO: 838930 - protein, 113 aa, Homo sapiens
RFSAFWLRSSVVSVLISLISDTSSIRGQYIKWIFGNRRWNRSLLRPLHASTWYCSTSRNGAPYSTGGWQDGRIGRAPVYSSRRDQRRRWVISAFPAEVSGSSHRDWLDRGCSP

SEQ ID NO: 838931 - protein, 165 aa, Homo sapiens; identical to SEQ ID NO: 838920

SEQ ID NO: 838932 - protein, 165 aa, Homo sapiens; identical to SEQ ID NO: 838920

SEQ ID NO: 838933 - protein, 165 aa, Homo sapiens; identical to SEQ ID NO: 838920

SEQ ID NO: 838934 - protein, 165 aa, Homo sapiens; identical to SEQ ID NO: 838920

SEQ ID NO: 838935 - protein, 208 aa, Homo sapiens; identical to SEQ ID NO: 838927

SEQ ID NO: 838936 - protein, 161 aa, Homo sapiens
MKLPEVCFFNCCTLHESKYEIVTMFIYFNWLYFFPANGFQVDNYGTQLNAVNNSLTPQSTKVPSLFEFHGPSWCLTPADRGLCRANENRFYYNSVIGKCRPFKYSGCGGNENNFTSKQECLRACKKGFIQRISKGGLIKTKRKRKKQRVKIAYEEIFVKNM

SEQ ID NO: 838937 - protein, 68 aa, Homo sapiens
KKHTYRDYIDKVTSCSQDSMYVVTQLINTGDLWEHYDTARGYCVLRFRVRAVEPCKTGTVRRLRNEKS

SEQ ID NO: 838938 - protein, 602 aa, Homo sapiens
GPLAAWLQHQAPGSEWPGSAPRGRGRRARALLGSAGPPRRSASLVPRQTPLYDRRSPRGRGCGGQRGAPAGSPSRLPCPAERPWSTHPDASPATTGDPSGRLKVQVLGPRLKPTNPEPQARGMAAPLEAQDQAPGEGEGLLIVKVEDSSWEQESAQHEDGRDSEACRQRFRQFCYGDVHGPHEAFSQLWELCCRWLRPELRTKEQILELLVLEQFLTVLPGEIQGWVREQHPGSGEEAVALVEDLQKQPVKAWRQGVNSVSPGLARADEHVVVPAQDVPSEEAEPEAAGRGSQATGPPPTVGARRRPSVPQEQHSHSAQPPALLKEGRPGETTDTCFVSGVHGPVALGDIPFYFSREEWGTLDPAQRDLFWDIKRENSRNTTLGFGLKGQSEKSLLQEMVPVVPGQTGSDVTVSWSPEEAEAWESENRPRAALGPVVGARRGRPPTRRRQFRDLAAEKPHSCGQCGKRFRWGSDLARHQRTHTGEKPHKCPECDKSFRSSSDLVRHQGVHTGEKPFSCSECGKSFSRSAYLADHQRIHTGEKPFGCSDCGKSFSLRSYLLDHRRVHTGERPFGCGECDKSFKQRAHLIAHQSLHAKMAQPVG

SEQ ID NO: 838939 - protein, 602 aa, Homo sapiens; identical to SEQ ID NO: 838938

SEQ ID NO: 838940 - protein, 93 aa, Homo sapiens
LFHLTHPVPASAAGRPEPGLLTPFQGPVALGDIPFYFSREEWGTLDPAQRDLFWDIKRENSRNTTLGKHPGPLGPGWPPPILLELQSCFPPHP

SEQ ID NO: 838941 - protein, 575 aa, Homo sapiens
MEKAGSVDERLSGSWGMLAYRSFPASPARTSGAGSSRRKWDLLGRSGRCVFRGRGCGGQRGAPAGSPSRLPCPAERPWSTHPDASPATTGDPSGRLKVQVLGPRLKPTNPEPQARGMAAPLEAQDQAPGEGEGLLIVKVEDSSWEQESAQHEDGRDSEACRQRFRQFCYGDVHGPHEAFSQLWELCCRWLRPELRTKEQILELLVLEQFLTVLPGEIQGWVREQHPGSGEEAVALVEDLQKQPVKAWRQDVPSEEAEPEAAGRGSQATGPPPTVGARRRPSVPQEQHSHSAQPPALLKEGRPGETTDTCFVSGVHGPVALGDIPFYFSREEWGTLDPAQRDLFWDIKRENSRNTTLGFGLKGQSEKSLLQEMVPVVPGQTGSDVTVSWSPEEAEAWESENRPRAALGPVVGARRGRPPTRRRQFRDLAAEKPHSCGQCGKRFRWGSDLARHQRTHTGEKPHKCPECDKSFRSSSDLVRHQGVHTGEKPFSCSECGKSFSRSAYLADHQRIHTGEKPFGCSDCGKSFSLRSYLLDHRRVHTGERPFGCGECDKSFKQRAHLIAHQSLHAKMAQPVG

SEQ ID NO: 838942 - protein, 618 aa, Homo sapiens
PNSRSASPVLFQSRGRRVVRLVTLSVARHFEWPGSAPRGRGRRARALLGSAGPPRRSASLVPRQTPLYDRRSPRGRGCGGQRGAPAGSPSRLPCPAERPWSTHPDASPATTGDPSGRLKVQVLGPRLKPTNPEPQARGMAAPLEAQDQAPGEGEGLLIVKVEDSSWEQESAQHEDGRDSEACRQRFRQFCYGDVHGPHEAFSQLWELCCRWLRPELRTKEQILELLVLEQFLTVLPGEIQGWVREQHPGSGEEAVALVEDLQKQPVKAWRQGVNSVSPGLARADEHVVVPAQDVPSEEAEPEAAGRGSQATGPPPTVGARRRPSVPQEQHSHSAQPPALLKEGRPGETTDTCFVSGVHGPVALGDIPFYFSREEWGTLDPAQRDLFWDIKRENSRNTTLGFGLKGQSEKSLLQEMVPVVPGQTGSDVTVSWSPEEAEAWESENRPRAALGPVVGARRGRPPTRRRQFRDLAAEKPHSCGQCGKRFRWGSDLARHQRTHTGEKPHKCPECDKSFRSSSDLVRHQGVHTGEKPFSCSECGKSFSRSAYLADHQRIHTGEKPFGCSDCGKSFSLRSYLLDHRRVHTGERPFGCGECDKSFKQRAHLIAHQSLHAKMAQPVG

SEQ ID NO: 838943 - protein, 126 aa, Homo sapiens
MGSLKLGAKRVSFGLAVVFTSFCLTGSEDCRDRYCYAEFFMFISGTHCILFFNYMCYSELGDLGWDSKINDLRNSIPYIRTRACSKGCCDMVLTQKDAFGYHPQECLQKVFSEDNKEYLCFHWEEE

SEQ ID NO: 838944 - protein, 139 aa, Homo sapiens
KGCAWEKLDLLIKSKIFPNQFGNDLKCEGKGFIKFRYRRPWKRTFILEGTGGVSLVGEGWGGGFIRVVCLLPFSLFLTPFLSSPAKLLPCPATTFSALSFFPFAHAQLLTHKDFVDFVCIVDGMAALIPSLPVYPRICP

SEQ ID NO: 838945 - protein, 715 aa, Homo sapiens
MWIQVRTIDGSKTCTIEDVSRKATIEELRERVWALFDVRPECQRLFYRGKQLENGYTLFDYDVGLNDIIQLLVRPDPDHLPGTSTQIEAKPCSNSPPKVKKAPRVGPSNQPSTSARARLIDPGFGIYKIPRKRYSRKNVKDLRPRARTILKWNELNVGDVVMVNYNVESPGQRGFWFDAEITTLKTISRTKKELRVKIFLGGSEGTLNDCKIISVDEIFKIERPGAHPLSFADGKFLRRNDPECDLCGGDPEKKCHSCSCRVCGGKHEPNMQLLCDECNVAYHIYCLNPPLDKVPEEEYWYCPSCKTDSSEVVKAGERLKMSKKKAKMPSASTESRRDWGRGMACVGRTRECTIVPSNHYGPIPGIPVGSTWRFRVQVSEAGVHRPHVGGIHGRSNDGAYSLVLAGGFADEVDRGDEFTYTGSGGKNLAGNKRIGAPSADQTLTNMNRALALNCDAPLDDKIGAESRNWRAGKPVRVIRSFKGRKISKYAPEEGNRYDGIYKVVKYWPEISSSHGFLVWRYLLRRDDVEPAPWTSEGIERSRRLCLRLQYPAGYPSDKEGKKPKGQSKKQPSGTTKRPISDDDCPSASKVYKASDSAEAIEAFQLTPQQQHLIREDCQNQKLWDEVLSHLVEGPNFLKKLEQSFMCVCCQELVYQPVTTECFHNVCKDCLQRSFKAQVFSCPACRHDLGQNYIMIPNEILQTLLDLFFPGYSKGR

SEQ ID NO: 838946 - protein, 802 aa, Homo sapiens
MWIQVRTIDGSKTCTIEDVSRKATIEELRERVWALFDVRPECQRLFYRGKQLENGYTLFDYDVGLNDIIQLLVRPDPDHLPGTSTQIEAKPCSNSPPKVKKAPRVGPSNQPSTSARARLIDPGFGIYKVNELVDARDVGLGAWFEAHIHSVTRASDGQSRGKTPLKNGSSCKRTNGNIKHKSKENTNKLDSVPSTSNSDCVAADEDVIYHIQYDEYPESGTLEMNVKDLRPRARTILKWNELNVGDVVMVNYNVESPGQRGFWFDAEITTLKTISRTKKELRVKIFLGGSEGTLNDCKIISVDEIFKIERPGAHPLSFADGKFLRRNDPECDLCGGDPEKKCHSCSCRVCGGKHEPNMQLLCDECNVAYHIYCLNPPLDKVPEEEYWYCPSCKTDSSEVVKAGERLKMSKKKAKMPSASTESRRDWGRGMACVGRTRECTIVPSNHYGPIPGIPVGSTWRFRVQVSEAGVHRPHVGGIHGRSNDGAYSLVLAGGFADEVDRGDEFTYTGSGGKNLAGNKRIGAPSADQTLTNMNRALALNCDAPLDDKIGAESRNWRAGKPVRVIRSFKGRKISKYAPEEGNRYDGIYKVVKYWPEISSSHGFLVWRYLLRRDDVEPAPWTSEGIERSRRLCLRLQYPAGYPSDKEGKKPKGQSKKQPSGTTKRPISDDDCPSASKVYKASDSAEAIEAFQLTPQQQHLIREDCQNQKLWDEVLSHLVEGPNFLKKLEQSFMCVCCQELVYQPVTTECFHNVCKDCLQRSFKAQVFSCPACRHDLGQNYIMIPNEILQTLLDLFFPGYSKGR

SEQ ID NO: 838947 - protein, 485 aa, Homo sapiens
MWIQVRTIDGSKTCTIEDVSRKATIEELRERVWALFDVRPECQRLFYRGKQLENGYTLFDYDVGLNDIIQLLVRPDPDHLPGTSTQIEAKPCSNSPPKVKKAPRVGPSNQPSTSARARLIDPGFGIYKVNELVDARDVGLGAWFEAHIHSVTRASDGQSRGKTPLKNGSSCKRTNGNIKHKSKENTNKLDSVPSTSNSDCVAADEDVIYHIQYDEYPESGTLEMNVKDLRPRARTILKWNELNVGDVVMVNYNVESPGQRGFWFDAEITTLKTISRTKKELRVKIFLGGSEGTLNDCKIISVDEIFKIERPGAHPLSFADGKFLRRNDPECDLCGGDPEKKCHSCSCRVCGGKHEPNMQLLCDECNVAYHIYCLNPPLDKVPEEEYWYCPSCKTDSSEVVKAGERLKMSKKKAKMPSASTESRRDWGRGMACVGRTRECTIVPSNHYGPIPGIPVGSTWRFRVQSLGFTILPRLILNPWGQFLLP

SEQ ID NO: 838948 - protein, 136 aa, Homo sapiens
MWIQVRTIDGSKTCTIEDVSRKATIEELRERVWALFDVRPECQRLFYRGKQLENGYTLFDYDVGLNDIIQLLVRPDPDHLPGTSTQIEAKPCSNSPPKVKKAPRVGPSNQPSTSARARLIDPGFGIYKGLALSPRL

SEQ ID NO: 838949 - protein, 802 aa, Homo sapiens; identical to SEQ ID NO: 838946

SEQ ID NO: 838950 - protein, 797 aa, Homo sapiens
PREARGAGPSPAEWWGVGPCQPQLEVRRAGSEVRASGAQISRRLYLLENGYTLFDYDVGLNDIIQLLVRPDPDHLPGTSTQIEAKPCSNSPPKVKKAPRVGPSNQPSTSARARLIDPGFGIYKVNELVDARDVGLGAWFEAHIHSVTRASDGQSRGKTPLKNGSSCKRTNGNIKHKSKENTNKLDSVPSTSNSDCVAADEDVIYHIQYDEYPESGTLEMNVKDLRPRARTILKWNELNVGDVVMVNYNVESPGQRGFWFDAEITTLKTISRTKKELRVKIFLGGSEGTLNDCKIISVDEIFKIERPGAHPLSFADGKFLRRNDPECDLCGGDPEKKCHSCSCRVCGGKHEPNMQLLCDECNVAYHIYCLNPPLDKVPEEEYWYCPSCKTDSSEVVKAGERLKMSKKKAKMPSASTESRRDWGRGMACVGRTRECTIVPSNHYGPIPGIPVGSTWRFRVQVSEAGVHRPHVGGIHGRSNDGAYSLVLAGGFADEVDRGDEFTYTGSGGKNLAGNKRIGAPSADQTLTNMNRALALNCDAPLDDKIGAESRNWRAGKPVRVIRSFKGRKISKYAPEEGNRYDGIYKVVKYWPEISSSHGFLVWRYLLRRDDVEPAPWTSEGIERSRRLCLRLQYPAGYPSDKEGKKPKGQSKKQPSGTTKRPISDDDCPSASKVYKASDSAEAIEAFQLTPQQQHLIREDCQNQKLWDEVLSHLVEGPNFLKKLEQSFMCVCCQELVYQPVTTECFHNVCKDCLQRSFKAQVFSCPACRHDLGQNYIMIPNEILQTLLDLFFPGYSKGR

SEQ ID NO: 838951 - protein, 594 aa, Homo sapiens
MWIQVRTIDGSKTCTIEDVSRKATIEELRERVWALFDVRPECQRLFYRGKQLENGYTLFDYDVGLNDIIQLLVRPDPDHLPGTSTQIEAKPCSNSPPKVKKAPRVGPSNQPSTSARARLIDPGFGIYKVNELVDARDVGLGAWFEAHIHSVTRASDGQSRGKTPLKNGSSCKRTNGNIKHKSKENTNKLDSVPSTSNSDCVAADEDVIYHIQYDEYPESGTLEMNVKDLRPRARTILKWNELNVGDVVMVNYNVESPGQRGFWFDAEITTLKTISRTKKELRVKIFLGGSEGTLNDCKIISVDEIFKIERPGAHPLSFADGKFLRRNDPECDLCGGDPEKKCHSCSCRVCGGKHEPNMQLLCDECNVAYHIYCLNPPLDKVPEEEYWYCPSCKTDSSEVVKAGERLKMSKKKAKMPSASTESRRDWGRGMACVGRTRECTIVPSNHYGPIPGIPVGSTWRFRVQVSEAGVHRPHVGGIHGRSNDGAYSLVLAGGFADEVDRGDEFTYTGSGGKNLAGNKRIGAPSADQTLTNMNRALALNCDAPLDDKIGAESRNWRAGKPVRVIRSFKGRKISKYAPEEGNRYDGIYKVLYLA

SEQ ID NO: 838952 - protein, 434 aa, Homo sapiens
MWIQVRTIDGSKTCTIEDVSRKATIEELRERVWALFDVRPECQRLFYRGKQLENGYTLFDYDVGLNDIIQLLVRPDPDHLPGTSTQIEAKPCSNSPPKVKKAPRVGPSNQPSTSARARLIDPGFGIYKVNELVDARDVGLGAWFEAHIHSVTRASDGQSRGKTPLKNGSSCKRTNGNIKHKSKENTNKLDSVPSTSNSDCVAADEDVIYHIQYDEYPESGTLEMNVKDLRPRARTILKWNELNVGDVVMVNYNVESPGQRGFWFDAEITTLKTISRTKKELRVKIFLGGSEGTLNDCKIISVDEIFKIERPGAHPLSFADGKFLRRNDPECDLCGGDPEKKCHSCSCRVCGGKHEPNMQLLCDECNVAYHIYCLNPPLDKVPEEEYWYCPSCKTDSSEVVKAGERLKMSKKKAKMPSASTESRRDWGRGGEGRE

SEQ ID NO: 838953 - protein, 1382 aa, Homo sapiens
MPAYFQRPENALKRANEFLEVGKKQPALDVLYDVMKSKKHRTWQKIHEPIMLKYLELCVDLRKSHLAKEGLYQYKNICQQVNIKSLEDVVRAYLKMAEEKTEAAKEESQQMVLDIEDLDNIQTPESVLLSAVSGEDTQDRTDRLLLTPWVKFLWESYRQCLDLLRNNSRVERLYHDIAQQAFKFCLQYTRKAEFRKLCDNLRMHLSQIQRHHNQSTAINLNNPESQSMHLETRLVQLDSAISMELWQEAFKAVEDIHGLFSLSKKPPKPQLMANYYNKVSTVFWKSGNALFHASTLHRLYHLSREMRKNLTQDEMQRMSTRVLLATLSIPITPERTDIARLLDMDGIIVEKQRRLATLLGLQAPPTRIGLINDMVRFNVLQYVVPEVKDLYNWLEVEFNPLKLCERVTKVLNWVREQPEKEPELQQYVPQLQNNTILRLLQQVSQIYQSIEFSRLTSLVPFVDAFQLERAIVDAARHCDLQVRIDHTSRTLSFGSDLNYATREDAPIGPHLQSMPSEQIRNQLTAMSSVLAKALEVIKPAHILQEKEEQHQLAVTAYLKNSRKEHQRILARRQTIEERKERLESLNIQREKEELEQREAELQKVRKAEEERLRQEAKEREKERILQEHEQIKKKTVRERLEQIKKTELGAKAFKDIDIEDLEELDPDFIMAKQVEQLEKEKKELQERLKNQEKKIDYFERAKRLEEIPLIKSAYEEQRIKDMDLWEQQEEERITTMQLEREKALEHKNRMSRMLEDRDLFVMRLKAARQSVYEEKLKQFEERLAEERHNRLEERKRQRKEERRITYYREKEEEEQRRAEEQMLKEREERERAERAKREEELREYQERVKKLEEVERKKRQRELEIEERERRREEERRLGDSSLSRKDSRWGDRDSEGTWRKGPEADSEWRRGPPEKEWRRGEGRDEDRSHRRDEERPRRLGDDEDREPSLRPDDDRVPRRGMDDDRGPRRGPEEDRFSRRGADDDRPSWRNTDDDRPPRRIADEDRGNWRHADDDRPPRRGLDEDRGSWRTADEDRGPRRGMDDDRGPRRGGADDERSSWRNADDDRGPRRGLDDDRGPRRGMDDDRGPRRGMDDDRGPRRGMDDDRGPRRGLDDDRGPWRNADDDRIPRRGAEDDRGPWRNMDDDRLSRRADDDRFPRRGDDSRPGPWRPLVKPGGWREKEKAREESWGPPRESRPSEEREWDREKERDRDNQDREENDKDPERERDRERDVDREDRFRRPRDEGGWRRGPAEESSSWRDSSRRDDRDRDDRRRERDDRRDLRERRDLRDDRDRRGPPLRSEREEVSSWRRADDRKDDRVEERDPPRRVPPPALSRDRERDRDREREGEKEKASWRAEKDRESLRRTKNETDEDGWTTVRR

SEQ ID NO: 838954 - protein, 1382 aa, Homo sapiens; identical to SEQ ID NO: 838953

SEQ ID NO: 838955 - protein, 1509 aa, Homo sapiens
MPAYFQRPENALKRANEFLEVGKKQPALDVLYDVMKSKKHRTWQKIHEPIMLKYLELCVDLRKSHLAKEGLYQYKNICQQVNIKSLEDVVRAYLKMAEEKTEAAKEESQQMVLDIEDLDNIQTPESVLLSAVSGEDTQDRTDRLLLTPWVKFLWESYRQCLDLLRNNSRVERLYHDIAQQAFKFCLQYTRKAEFRKLCDNLRMHLSQIQRHHNQSTAINLNNPESQSMHLETRLVQLDSAISMELWQEAFKAVEDIHGLFSLSKKPPKPQLMANYYNKVSTVFWKSGNALFHASTLHRLYHLSREMRKNLTQDEMQRMSTRVLLATLSIPITPERTDIARLLDMDGIIVEKQRRLATLLGLQAPPTRIGLINDMVRFNVLQYVVPEVKDLYNWLEVEFNPLKLCERVTKEAFVFKFWLLPQSWPSCSFGLYSYLLREKFCPMCWNSVHISLSFFFISREKIYLMCSANLWRLISSMTNLAIAASHLQTSISSFIDTFCISLHWMMFLYIKKKRVLDVLAISYVESVILFQFNGFYEVLNWVREQPEKEPELQQYVPQLQNNTILRLLQQVSQIYQSIEFSRLTSLVPFVDAFQLERAIVDAARHCDLQVRIDHTSRTLSFGSDLNYATREDAPIGPHLQSMPSEQIRNQLTAMSSVLAKALEVIKPAHILQEKEEQHQLAVTAYLKNSRKEHQRILARRQTIEERKERLESLNIQREKEELEQREAELQKVRKAEEERLRQEAKEREKERILQEHEQIKKKTVRERLEQIKKTELGAKAFKDIDIEDLEELDPDFIMAKQVEQLEKEKKELQERLKNQEKKIDYFERAKRLEEIPLIKSAYEEQRIKDMDLWEQQEEERITTMQLEREKALEHKNRMSRMLEDRDLFVMRLKAARQSVYEEKLKQFEERLAEERHNRLEERKRQRKEERRITYYREKEEEEQRRAEEQMLKEREERERAERAKREEELREYQERVKKLEEVERKKRQRELEIEERERRREEERRLGDSSLSRKDSRWGDRDSEGTWRKGPEADSEWRRGPPEKEWRRGEGRDEDRSHRRDEERPRRLGDDEDREPSLRPDDDRVPRRGMDDDRGPRRGPEEDRFSRRGADDDRPSWRNTDDDRPPRRIADEDRGNWRHADDDRPPRRGLDEDRGSWRTADEDRGPRRGMDDDRGPRRGGADDERSSWRNADDDRGPRRGLDDDRGPRRGMDDDRGPRRGMDDDRGPRRGMDDDRGPRRGLDDDRGPWRNADDDRIPRRGAEDDRGPWRNMDDDRLSRRADDDRFPRRGDDSRPGPWRPLVKPGGWREKEKAREESWGPPRESRPSEEREWDREKERDRDNQDREENDKDPERERDRERDVDREDRFRRPRDEGGWRRGPAEESSSWRDSSRRDDRDRDDRRRERDDRRDLRERRDLRDDRDRRGPPLRSEREEVSSWRRADDRKDDRVEERDPPRRVPPPALSRDRERDRDREREGEKEKASWRAEKDRESLRRTKNETDEDGWTTVRR

SEQ ID NO: 838956 - protein, 1382 aa, Homo sapiens; identical to SEQ ID NO: 838953

SEQ ID NO: 838957 - protein, 1224 aa, Homo sapiens
MPAYFQRPENALKRANEFLEVGKKQPALDVLYDVMKSKKHRTWQKIHEPIMLKYLELCVDLRKSHLAKEGLYQYKNICQQVNIKSLEDVVRAYLKMAEEKTEAAKEESQQMVLDIEDLDNIQTPESVLLSAVSGEDTQDRTDRLLLTPWVKFLWESYRQCLDLLRNNSRVERLYHDIAQQAFKFCLQYTRKAEFRKLCDNLRMHLSQIQRHHNQSTAINLNNPESQSMHLETRLVQLDSAISMELWQEAFKAVEDIHGLFSLSKKPPKPQLMANYYNKVSTVFWKSGNALFHASTLHRLYHLSREMRKNLTQDEMQRMSTRVLLATLSIPITPERTDIARLLDMDGIIVEKQRRLATLLGLQAPPTRIGLINDMVRFNVLQYVVPEVKDLYNWLEVEFNPLKLCERVTKVLNWVREQPEKEPELQQYVPQLQNNTILRLLQQVSQIYQSIEFSRLTSLVPFVDAFQLERAIVDAARHCDLQVRIDHTSRTLSFGSDLNYATREDAPIGPHLQSMPSEQIRNQLTAMSSVLAKALEVIKPAHILQEKEEQHQLAVTAYLKNSRKEHQRILARRQTIEERKERLESLNIQREKEELEQREAELQKVRKAEEERLRQEAKEREKERILQEHEQIKKKTVRERLEQIKKTELGAKAFKDIDIEDLEELDPDFIMAKQVEQLEKEKKELQERLKNQEKKIDYFERAKRLEEIPLIKSAYEEQRIKDMDLWEQQEEERITTMQLEREKALEHKNRMSRMLEDRDLFVMRLKAARQSVYEEKLKQFEERLAEERHNRLEERKRQRKEERRITYYREKEEEEQRRAEEQMLKEREERERAERAKREEELREYQERVKKLEEVERKKRQRELEIEERERRREEERRLGDSSLSRKDSRWGDRDSEGTWRKGPEADSEWRRGPPEKEWRRGEGRDEDRSHRRDEERPRRLGDDEDREPSLRPDDDRVPRRGMDDDRGPRRGPEEDRFSRRGADDDRPSWRNTDDDRPPRRIADEDRGNWRHADDDRPPRRGLDEDRGSWRTADEDRGPRRGMDDDRGPRRGGADDERSSWRNADDDRGPRRGLDDDRGPRRGMDDDRGPRRGMDDDRGPRRGMDDDRGPRRGLDDDRGPWRNADDDRIPRRGAEDDRGPWRNMDDDRLSRRADDDRFPRRGDDSRPGPWRPLVKPGGWREKEKAREESWGPPRESRPSEEREWDREERKGQRERCGSRGSLQKT

SEQ ID NO: 838958 - protein, 1382 aa, Homo sapiens; identical to SEQ ID NO: 838953

SEQ ID NO: 838959 - protein, 755 aa, Homo sapiens
LEDPGCFPLSPFGVVPEFYCPIFIRIHWGMGRFCFCFLARNRVILKVCEKTWRAAESRTHHDGGERKIDYFERAKRLEEIPLIKSAYEEQRIKDMDLWEQQEEERITTMQLEREKALEHKNRMSRMLEDRDLFVMRLKAARQSVYEEKLKQFEERLAEERHNRLEERKRQRKEERRITYYREKEEEEQRRAEEQMLKEREERERAERAKREEELREYQERVKKLEEVERKKRQRELEIEERERRREEERRLGDSSLSRKDSRWGDRDSEGTWRKGPEADSEWRRGPPEKEWRRGEGRDEDRSHRRDEERPRRLGDDEDREPSLRPDDDRVPRRGMDDDRGPRRGPEEDRFSRRGADDDRPSWRNTDDDRPPRRIADEDRGNWRHADDDRPPRRGLDEDRGSWRTADEDRGPRRGMDDDRGPRRGGADDERSSWRNADDDRGPRRGLDDDRGPRRGMDDDRGPRRGMDDDRGPRRGMDDDRGPRRGLDDDRGPWRNADDDRIPRRGAEDDRGPWRNMDDDRLSRRADDDRFPRRGDDSRPGPWRPLVKPGGWREKEKAREESWGPPRESRPSEEREWDREKERDRDNQDREENDKDPERERDRERDVDREDRFRRPRDEGGWRRGPAEESSSWRDSSRRDDRDRDDRRRERDDRRDLRERRDLRDDRDRRGPPLRSEREEVSSWRRADDRKDDRVEERDPPRRVPPPALSRDRERDRDREREGEKEKASWRAEKDRESLRRTKNETDEDGWTTVRR

SEQ ID NO: 838960 - protein, 626 aa, Homo sapiens
MLSRIILCDSTARSRYGEKLKQFEERLAEERHNRLEERKRQRKEERRITYYREKEEEEQRRAEEQMLKEREERERAERAKREEELREYQERVKKLEEVERKKRQRELEIEERERRREEERRLGDSSLSRKDSRWGDRDSEGTWRKGPEADSEWRRGPPEKEWRRGEGRDEDRSHRRDEERPRRLGDDEDREPSLRPDDDRVPRRGMDDDRGPRRGPEEDRFSRRGADDDRPSWRNTDDDRPPRRIADEDRGNWRHADDDRPPRRGLDEDRGSWRTADEDRGPRRGMDDDRGPRRGGADDERSSWRNADDDRGPRRGLDDDRGPRRGMDDDRGPRRGMDDDRGPRRGMDDDRGPRRGLDDDRGPWRNADDDRIPRRGAEDDRGPWRNMDDDRLSRRADDDRFPRRGDDSRPGPWRPLVKPGGWREKEKAREESWGPPRESRPSEEREWDREKERDRDNQDREENDKDPERERDRERDVDREDRFRRPRDEGGWRRGPAEESSSWRDSSRRDDRDRDDRRRERDDRRDLRERRDLRDDRDRRGPPLRSEREEVSSWRRADDRKDDRVEERDPPRRVPPPALSRDRERDRDREREGEKEKASWRAEKDRESLRRTKNETDEDGWTTVRR

SEQ ID NO: 838961 - protein, 421 aa, Homo sapiens
MDDDRGPRRGPEEDRFSRRGADDDRPSWRNTDDDRPPRRIADEDRGNWRHADDDRPPRRGLDEDRGSWRTADEDRGPRRGMDDDRGPRRGGADDERSSWRNADDDRGPRRGLDDDRGPRRGMDDDRGPRRGMDDDRGPRRGMDDDRGPRRGLDDDRGPWRNADDDRIPRRGAEDDRGPWRNMDDDRLSRRADDDRFPRRGDDSRPGPWRPLVKPGGWREKEKAREESWGPPRESRPSEEREWDREKERDRDNQDREENDKDPERERDRERDVDREDRFRRPRDEGGWRRGPAEESSSWRDSSRRDDRDRDDRRRERDDRRDLRERRDLRDDRDRRGPPLRSEREEVSSWRRADDRKDDRVEERDPPRRVPPPALSRDRERDRDREREGEKEKASWRAEKDRESLRRTKNETDEDGWTTVRR

SEQ ID NO: 838962 - protein, 341 aa, Homo sapiens
MDDDRGPRRGGADDERSSWRNADDDRGPRRGLDDDRGPRRGMDDDRGPRRGMDDDRGPRRGMDDDRGPRRGLDDDRGPWRNADDDRIPRRGAEDDRGPWRNMDDDRLSRRADDDRFPRRGDDSRPGPWRPLVKPGGWREKEKAREESWGPPRESRPSEEREWDREKERDRDNQDREENDKDPERERDRERDVDREDRFRRPRDEGGWRRGPAEESSSWRDSSRRDDRDRDDRRRERDDRRDLRERRDLRDDRDRRGPPLRSEREEVSSWRRADDRKDDRVEERDPPRRVPPPALSRDRERDRDREREGEKEKASWRAEKDRESLRRTKNETDEDGWTTVRR

SEQ ID NO: 838963 - protein, 341 aa, Homo sapiens; identical to SEQ ID NO: 838962

SEQ ID NO: 838964 - protein, 1096 aa, Homo sapiens
MPAYFQRPENALKRANEFLEVGKKQPALDVLYDVMKSKKHRTWQKIHEPIMLKYLELCVDLRKSHLAKEGLYQYKNICQQVNIKSLEDVVRAYLKMAEEKTEAAKEESQQMVLDIEDLDNIQTPESVLLSAVSGEDTQDRTDRLLLTPWVKFLWESYRQCLDLLRNNSRVERLYHDIAQQAFKFCLQYTRKAEFRKLCDNLRMHLSQIQRHHNQSTAINLNNPESQSMHLETRLVQLDSAISMELWQEAFKAVEDIHGLFSLSKKPPKPQLMANYYNKVSTVFWKSGNALFHASTLHRLYHLSREMRKNLTQDEMQRMSTRVLLATLSIPITPERTDIARLLDMDGIIVEKQRRLATLLGLQAPPTRIGLINDMVRFNVLQYVVPEVKDLYNWLEVEFNPLKLCERVTKVLNWVREQPEKEPELQQYVPQLQNNTILRLLQQVSQIYQSIEFSRLTSLVPFVDAFQLERAIVDAARHCDLQVRIDHTSRTLSFGSDLNYATREDAPIGPHLQSMPSEQIRNQLTAMSSVLAKALEVIKPAHILQEKEEQHQLAVTAYLKNSRKEHQRILARRQTIEERKERLESLNIQREKEELEQREAELQKVRKAEEERLRQEAKEREKERILQEHEQIKKKTVRERLEQIKKTELGAKAFKDIDIEDLEELDPDFIMAKQVEQLEKEKKELQERLKNQEKKIDYFERAKRLEEIPLIKSAYEEQRIKDMDLWEQQEEERITTMQLEREKALEHKNRMSRMLEDRDLFVMRLKAARQSVYEEKLKQFEERLAEERHNRLEERKRQRKEERRITYYREKEEEEQRRAEEQMLKEREERERAERAKREEELREYQERVKKLEEVERKKRQRELEIEERERRREEERRLGDSSLSRKDSRWGDRDSEGTWRKGPEADSEWRRGPPEKEWRRGEGRDEDRSHRRDEERPRRLGDDEDREPSLRPDDDRVPRRGMDDDRGPRRGPEEDRFSRRGADDDRPSWRNTDDDRPPRRIADEDRGNWRHADDDRPPRRGLDEDRGSWRTADEDRGPRRGMDDDRGPRRGGADDERSSWRNADDDRGPRRKNHAIFWNLRVLHYFINHLLTKKKN

SEQ ID NO: 838965 - protein, 121 aa, Homo sapiens [sequence omitted]

SEQ ID NO: 838966 - protein, 1262 aa, Homo sapiens
MPAYFQRPENALKRANEFLEVGKKQPALDVLYDVMKSKKHRTWQKIHEPIMLKYLELCVDLRKSHLAKEGLYQYKNICQQVNIKSLEDVVRAYLKMAEEKTEAAKEESQQMVLDIEDLDNIQTPESVLLSAVSGEDTQDRTDRLLLTPWVKFLWESYRQCLDLLRNNSRVERLYHDIAQQAFKFCLQYTRKAEFRKLCDNLRMHLSQIQRHHNQSTAINLNNPESQSMHLETRLVQLDSAISMELWQEAFKAVEDIHGLFSLSKKPPKPQLMANYYNKVSTVFWKSGNALFHASTLHRLYHLSREMRKNLTQDEMQRMSTRVLLATLSIPITPERTDIARLLDMDGIIVEKQRRLATLLGLQAPPTRIGLINDMVRFNVLQYVVPEVKDLYNWLEVEFNPLKLCERVTKVLNWVREQPEKEPELQQYVPQLQNNTILRLLQQVSQIYQSIEFSRLTSLVPFVDAFQLERAIVDAARHCDLQVRIDHTSRTLSFGSDLNYATREDAPIGPHLQSMPSEQIRNQLTAMSSVLAKALEVIKPAHILQEKEEQHQLAVTAYLKNSRKEHQRILARRQTIEERKERLESLNIQREKEELEQREAELQKVRKAEEERLRQEAKEREKERILQEHEQIKKKTVRERLEQIKKTELGAKAFKDIDIEDLEELDPDFIMAKQVEQLEKEKKELQERLKNQEKKIDYFERAKRLEEIPLIKSAYEEQRIKDMDLWEQQEEERITTMQLEREKALEHKNRMSRMLEDRDLFVMRLKAARQSVYEEKLKQFEERLAEERHNRLEERKRQRKEERRITYYREKEEEEQRRAEEQMLKEREERERAERAKREEELREYQERVKKLEEVERKKRQRELEIEERERRREEERRLGDSSLSRKDSRWGDRDSEGTWRKGPEADSEWRRGPPEKEWRRGEGRDEDRSHRRDEERPRRLGDDEDREPSLRPDDDRVPRRGMDDDRGPRRGPEEDRFSRRGADDDRPSWRNTDDDRPPRRIADEDRGNWRHADDDRPPRRGLDEDRGSWRTADEDRGPRRGMDDDRGPRRGGADDERSSWRNADDDRGPRRGLDDDRGPRRGMDDDRGPRRGMDDDRGPRRGMDDDRGPRRGLDDDRGPWRNADDDRIPRRGAEDDRGPWRNMDDDRLSRRADDDRFPRRGDDSRPGPWRPLVKPGGWREKEKAREESWGPPRESRPSEEREWDREKERDRDNHTGEMKGLRRRTDQWPEPSTQESVKRRRPRRTRDRGRRGTARGPERAEG

SEQ ID NO: 838967 - protein, 1185 aa, Homo sapiens
MPAYFQRPENALKRANEFLEVGKKQPALDVLYDVMKSKKHRTWQKIHEPIMLKYLELCVDLRKSHLAKEGLYQYKNICQQVNIKSLEDVVRAYLKMAEEKTEAAKEESQQMVLDIEDLDNIQTPESVLLSAVSGEDTQDRTDRLLLTPWVKFLWESYRQCLDLLRNNSRVERLYHDIAQQAFKFCLQYTRKAEFRKLCDNLRMHLSQIQRHHNQSTAINLNNPESQSMHLETRLVQLDSAISMELWQEAFKAVEDIHGLFSLSKKPPKPQLMANYYNKVSTVFWKSGNALFHASTLHRLYHLSREMRKNLTQDEMQRMSTRVLLATLSIPITPERTDIARLLDMDGIIVEKQRRLATLLGLQAPPTRIGLINDMVRFNVLQYVVPEVKDLYNWLEVEFNPLKLCERVTKVLNWVREQPEKEPELQQYVPQLQNNTILRLLQQVSQIYQSIEFSRLTSLVPFVDAFQLERAIVDAARHCDLQVRIDHTSRTLSFGSDLNYATREDAPIGPHLQSMPSEQIRNQLTAMSSVLAKALEVIKPAHILQEKEEQHQLAVTAYLKNSRKEHQRILARRQTIEERKERLESLNIQREKEELEQREAELQKVRKAEEERLRQEAKEREKERILQEHEQIKKKTVRERLEQIKKTELGAKAFKDIDIEDLEELDPDFIMAKQVEQLEKEKKELQERLKNQEKKIDYFERAKRLEEIPLIKSAYEEQRIKDMDLWEQQEEERITTMQLEREKALEHKNRMSRMLEDRDLFVMRLKAARQSVYEEKLKQFEERLAEERHNRLEERKRQRKEERRITYYREKEEEEQRRAEEQMLKEREERERAERAKREEELREYQERVKKLEEVERKKRQRELEIEERERRREEERRLGDSSLSRKDSRWGDRDSEGTWRKGPEADSEWRRGPPEKEWRRGEGRDEDRSHRRDEERPRRLGDDEDREPSLRPDDDRVPRRGMDDDRGPRRGPEEDRFSRRGADDDRPSWRNTDDDRPPRRIADEDRGNWRHADDDRPPRRGLDEDRGSWRTADEDRGPRRGMDDDRGPRRGGADDERSSWRNADDDRGPRRGLDDDRGPRRGMDDDRGPRRGMDDDRGPRRGMDDDRGPRRGLDDDRGPWRNADDDRIPRRGAEANNFLWPFKLSSPRGGMKKKTTHFVEGGDAGNREDQINRLIRRMIQGCGTM

SEQ ID NO: 838968 - protein, 845 aa, Homo sapiens [sequence omitted]

SEQ ID NO: 838969 - protein, 824 aa, Homo sapiens
MPAYFQRPENALKRANEFLEVGKKQPALDVLYDVMKSKKHRTWQKIHEPIMLKYLELCVDLRKSHLAKEGLYQYKNICQQVNIKSLEDVVRAYLKMAEEKTEAAKEESQQMVLDIEDLDNIQTPESVLLSAVSGEDTQDRTDRLLLTPWVKFLWESYRQCLDLLRNNSRVERLYHDIAQQAFKFCLQYTRKAEFRKLCDNLRMHLSQIQRHHNQSTAINLNNPESQSMHLETRLVQLDSAISMELWQEAFKAVEDIHGLFSLSKKPPKPQLMANYYNKVSTVFWKSGNALFHASTLHRLYHLSREMRKNLTQDEMQRMSTRVLLATLSIPITPERTDIARLLDMDGIIVEKQRRLATLLGLQAPPTRIGLINDMVRFNVLQYVVPEVKDLYNWLEVEFNPLKLCERVTKVLNWVREQPEKEPELQQYVPQLQNNTILRLLQQVSQIYQSIEFSRLTSLVPFVDAFQLERAIVDAARHCDLQVRIDHTSRTLSFGSDLNYATREDAPIGPHLQSMPSEQIRNQLTAMSSVLAKALEVIKPAHILQEKEEQHQLAVTAYLKNSRKEHQRILARRQTIEERKERLESLNIQREKEELEQREAELQKVRKAEEERLRQEAKEREKERILQEHEQIKKKTVRERLEQIKKTELGAKAFKDIDIEDLEELDPDFIMAKQVEQLEKEKKELQERLKNQEKKIDYFERAKRLEEIPLIKSAYEEQRIKDMDLWEQQEEERITTMQLEREKALEHKNRMSRMLEDRDLFVMRLKAARQSVYEEKLKQFEERLAEERHNRLEERKRRCRLRRCRLRRCGLRRCRLRRCRLRRCR

SEQ ID NO: 838970 - protein, 795 aa, Homo sapiens
MPAYFQRPENALKRANEFLEVGKKQPALDVLYDVMKSKKHRTWQKIHEPIMLKYLELCVDLRKSHLAKEGLYQYKNICQQVNIKSLEDVVRAYLKMAEEKTEAAKEESQQMVLDIEDLDNIQTPESVLLSAVSGEDTQDRTDRLLLTPWVKFLWESYRQCLDLLRNNSRVERLYHDIAQQAFKFCLQYTRKAEFRKLCDNLRMHLSQIQRHHNQSTAINLNNPESQSMHLETRLVQLDSAISMELWQEAFKAVEDIHGLFSLSKKPPKPQLMANYYNKVSTVFWKSGNALFHASTLHRLYHLSREMRKNLTQDEMQRMSTRVLLATLSIPITPERTDIARLLDMDGIIVEKQRRLATLLGLQAPPTRIGLINDMVRFNVLQYVVPEVKDLYNWLEVEFNPLKLCERVTKVLNWVREQPEKEPELQQYVPQLQNNTILRLLQQVSQIYQSIEFSRLTSLVPFVDAFQLERAIVDAARHCDLQVRIDHTSRTLSFGSDLNYATREDAPIGPHLQSMPSEQIRNQLTAMSSVLAKALEVIKPAHILQEKEEQHQLAVTAYLKNSRKEHQRILARRQTIEERKERLESLNIQREKEELEQREAELQKVRKAEEERLRQEAKEREKERILQEHEQIKKKTVRERLEQIKKTELGAKAFKDIDIEDLEELDPDFIMAKQVEQLEKEKKELQERLKNQEKKIDYFERAKRLEEIPLIKSAYEEQRGCARKQRRERRSVSYRNMNKSKRKLSESVWSRSRKQKWVPKHSKILILKTLRNWMQILSWLNRLNNWRKKSKNFKNA

SEQ ID NO: 838971 - protein, 186 aa, Homo sapiens
MPAYFQRPENALKRANEFLEVGKKQPALDVLYDVMKSKKHRTWQKIHEPIMLKYLELCVDLRKSHLAKEGLYQYKNICQQVNIKSLEDVVRAYLKMAEEKTEAAKEESQQMVLDIEDLDNIQTPESVLLSAVSGEDTQDRTDRLLYTENPKDCTQNYSNSSTDQLKVEGYKYNIQKLVAFCYRVAH

SEQ ID NO: 838972 - protein, 1382 aa, Homo sapiens; identical to SEQ ID NO: 838953

SEQ ID NO: 838973 - protein, 1065 aa, Homo sapiens
MSTRVLLATLSIPITPERTDIARLLDMDGIIVEKQRRLATLLGLQAPPTRIGLINDMVRFNVLQYVVPEVKDLYNWLEVEFNPLKLCERVTKVLNWVREQPEKEPELQQYVPQLQNNTILRLLQQVSQIYQSIEFSRLTSLVPFVDAFQLERAIVDAARHCDLQVRIDHTSRTLSFGSDLNYATREDAPIGPHLQSMPSEQIRNQLTAMSSVLAKALEVIKPAHILQEKEEQHQLAVTAYLKNSRKEHQRILARRQTIEERKERLESLNIQREKEELEQREAELQKVRKAEEERLRQEAKEREKERILQEHEQIKKKTVRERLEQIKKTELGAKAFKDIDIEDLEELDPDFIMAKQVEQLEKEKKELQERLKNQEKKIDYFERAKRLEEIPLIKSAYEEQRIKDMDLWEQQEEERITTMQLEREKALEHKNRMSRMLEDRDLFVMRLKAARQSVYEEKLKQFEERLAEERHNRLEERKRQRKEERRITYYREKEEEEQRRAEEQMLKEREERERAERAKREEELREYQERVKKLEEVERKKRQRELEIEERERRREEERRLGDSSLSRKDSRWGDRDSEGTWRKGPEADSEWRRGPPEKEWRRGEGRDEDRSHRRDEERPRRLGDDEDREPSLRPDDDRVPRRGMDDDRGPRRGPEEDRFSRRGADDDRPSWRNTDDDRPPRRIADEDRGNWRHADDDRPPRRGLDEDRGSWRTADEDRGPRRGMDDDRGPRRGGADDERSSWRNADDDRGPRRGLDDDRGPRRGMDDDRGPRRGMDDDRGPRRGMDDDRGPRRGLDDDRGPWRNADDDRIPRRGAEDDRGPWRNMDDDRLSRRADDDRFPRRGDDSRPGPWRPLVKPGGWREKEKAREESWGPPRESRPSEEREWDREKERDRDNQDREENDKDPERERDRERDVDREDRFRRPRDEGGWRRGPAEESSSWRDSSRRDDRDRDDRRRERDDRRDLRERRDLRDDRDRRGPPLRSEREEVSSWRRADDRKDDRVEERDPPRRVPPPALSRDRERDRDREREGEKEKASWRAEKDRESLRRTKNETDEDGWTTVRR

SEQ ID NO: 838974 - protein, 1343 aa, Homo sapiens
MPAYFQRPENALKRANEFLEVGKKQPALDVLYDVMKSKKHRTWQKIHEPIMLKYLELCVDLRKSHLAKEGLYQYKNICQQVNIKSLEDVVRAYLKMAEEKTEAAKEESQQMVLDIEDLDNIQTPESVLLSAVSGEDTQDRTDRLLLTPWVKFLWESYRQCLDLLRNNSRVERLYHDIAQQAFKFCLQYTRKAEFRKLCDNLRMHLSQIQRHHNQSTAINLNNPESQSMHLETRLVQLDSAISMELWQEAFKAVEDIHGLFSLSKKPPKPQLMANYYNKVSTVFWKSGNALFHASTLHRLYHLSREMRKNLTQDEMQRMSTRVLLATLSIPITPERTDIARLLDMDGIIVEKQRRLATLLGLQAPPTRIGLINDMVRFNVLQYVVPEVKDLYNWLEVEFNPLKLCERVTKVLNWVREQPEKEPELQQYVPQLQNNTILRLLQQVSQIYQSIEFSRLTSLVPFVDAFQLERAIVDAARHCDLQVRIDHTSRTLSFGSDLNYATREDAPIGPHLQSMPSEQIRNQLTAMSSVLAKALEVIKPAHILQEKEEQHQLAVTAYLKNSRKEHQRILARRQTIEERKERLESLNIQREKEELEQREAELQKVRKAEEERLRQEAKEREKERILQEHEQIKKKTVRERLEQIKKTELGAKAFKDIDIEDLEELDPDFIMAKQVEQLEKEKKELQERLKNQEKKIDYFERAKRLEEIPLIKSAYEEQRIKDMDLWEQQEEERITTMQLEREKALEHKNRMSRMLEDRDLFVMRLKAARQSVYEEKLKQFEERLAEERHNRLEERKRQRKEERRITYYREKEEEEQRRAEEQMLKEREERERAERAKREEELREYQERVKKLEEVERKKRQRELEIEERERRREEERRLGDSSLSRKDSRWGDRDSEGTWRKGPEADSEWRRGPPEKEWRRGEGRDEDRSHRRDEERPRRLGDDEDREPSLRPDDDRVPRRGMDDDRGPRRGPEEDRFSRRGADDDRPSWRNTDDDRPPRRIADEDRGNWRHADDDRPPRRGLDEDRGSWRTADEDRGPRRGMDDDRGPRRGGADDERSSWRNADDDRGPRRRGLDDDRGPWRNADDDRIPRRGAEDDRGPWRNMDDDRLSRRADDDRFPRRGDDSRPGPWRPLVKPGGWREKEKAREESWGPPRESRPSEEREWDREKERDRDNQDREENDKDPERERDRERDVDREDRFRRPRDEGGWRRGPAEESSSWRDSSRRDDRDRDDRRRERDDRRDLRERRDLRDDRDRRGPPLRSEREEVSSWRRADDRKDDRVEERDPPRRVPPPALSRDRERDRDREREGEKEKASWRAEKDRESLRRTKNETDEDGWTTVRR

SEQ ID NO: 838975 - protein, 621 aa, Homo sapiens
MATQSCAVVCDEEKLKQFEERLAEERHNRLEERKRQRKEERRITYYREKEEEEQRRAEEQMLKEREERERAERAKREEELREYQERVKKLEEVERKKRQRELEIEERERRREEERRLGDSSLSRKDSRWGDRDSEGTWRKGPEADSEWRRGPPEKEWRRGEGRDEDRSHRRDEERPRRLGDDEDREPSLRPDDDRVPRRGMDDDRGPRRGPEEDRFSRRGADDDRPSWRNTDDDRPPRRIADEDRGNWRHADDDRPPRRGLDEDRGSWRTADEDRGPRRGMDDDRGPRRGGADDERSSWRNADDDRGPRRGLDDDRGPRRGMDDDRGPRRGMDDDRGPRRGMDDDRGPRRGLDDDRGPWRNADDDRIPRRGAEDDRGPWRNMDDDRLSRRADDDRFPRRGDDSRPGPWRPLVKPGGWREKEKAREESWGPPRESRPSEEREWDREKERDRDNQDREENDKDPERERDRERDVDREDRFRRPRDEGGWRRGPAEESSSWRDSSRRDDRDRDDRRRERDDRRDLRERRDLRDDRDRRGPPLRSEREEVSSWRRADDRKDDRVEERDPPRRVPPPALSRDRERDRDREREGEKEKASWRAEKDRESLRRTKNETDEDGWTTVRR

SEQ ID NO: 838976 - protein, 561 aa, Homo sapiens
MLKEREERERAERAKREEELREYQERVKKLEEVERKKRQRELEIEERERRREEERRLGDSSLSRKDSRWGDRDSEGTWRKGPEADSEWRRGPPEKEWRRGEGRDEDRSHRRDEERPRRLGDDEDREPSLRPDDDRVPRRGMDDDRGPRRGPEEDRFSRRGADDDRPSWRNTDDDRPPRRIADEDRGNWRHADDDRPPRRGLDEDRGSWRTADEDRGPRRGMDDDRGPRRGGADDERSSWRNADDDRGPRRGLDDDRGPRRGMDDDRGPRRGMDDDRGPRRGMDDDRGPRRGLDDDRGPWRNADDDRIPRRGAEDDRGPWRNMDDDRLSRRADDDRFPRRGDDSRPGPWRPLVKPGGWREKEKAREESWGPPRESRPSEEREWDREKERDRDNQDREENDKDPERERDRERDVDREDRFRRPRDEGGWRRGPAEESSSWRDSSRRDDRDRDDRRRERDDRRDLRERRDLRDDRDRRGPPLRSEREEVSSWRRADDRKDDRVEERDPPRRVPPPALSRDRERDRDREREGEKEKASWRAEKDRESLRRTKNETDEDGWTTVRR

SEQ ID NO: 838977 - protein, 499 aa, Homo sapiens
YTPRKEKGSREEKQKPQAERKEEKKAAAPAPEEEWRRGEGRDEDRSHRRDEERPRRLGDDEDREPSLRPDDDRVPRRGMDDDRGPRRGPEEDRFSRRGADDDRPSWRNTDDDRPPRRIADEDRGNWRHADDDRPPRRGLDEDRGSWRTADEDRGPRRGMDDDRGPRRGGADDERSSWRNADDDRGPRRGLDDDRGPRRGMDDDRGPRRGMDDDRGPRRGMDDDRGPRRGLDDDRGPWRNADDDRIPRRGAEDDRGPWRNMDDDRLSRRADDDRFPRRGDDSRPGPWRPLVKPGGWREKEKAREESWGPPRESRPSEEREWDREKERDRDNQDREENDKDPERERDRERDVDREDRFRRPRDEGGWRRGPAEESSSWRDSSRRDDRDRDDRRRERDDRRDLRERRDLRDDRDRRGPPLRSEREEVSSWRRADDRKDDRVEERDPPRRVPPPALSRDRERDRDREREGEKEKASWRAEKDRESLRRTKNETDEDGWTTVRR

SEQ ID NO: 838978 - protein, 136 aa, Homo sapiens
RPEDHGIINVNEDRVKRQGQRYQDREENDVDGERKKKPERRAGVHLENQGHQKNVNGTEKKKGTEIIKIGRRMTRTLREKGTEREMWIERIASEDLGMKVAGEEDQLRNLQAGETQVAGTIGIGMTVAVRGMTGVI

SEQ ID NO: 838979 - protein, 1382 aa, Homo sapiens; identical to SEQ ID NO: 838953

SEQ ID NO: 838980 - protein, 158 aa, Homo sapiens
MCPYAYVTSENLTQDEMQRDEGGWRRGPAEESSSWRDSSRRDDRDRDDRRRERDDRRDLRERRDLRDDRDRRGPPLRSEREEVSSWRRADDRKDDRVEERDPPRRVPPPALSRDRERDRDREREGEKEKASWRAEKDRESLRRTKNETDEDGWTTVRR

SEQ ID NO: 838981 - protein, 125 aa, Homo sapiens
TRSLSSPANNICFYGECSYYLSTEHALCGKPDQIEGSLAAFLPDLSLAKRKTWRNPWRRSYHKRKKAEWEVDPDYCEEVKQTPPYDSSHRILDVMDMTIFDFLMGNMDHSTTLSLKIMDLNWCLK

SEQ ID NO: 838982 - protein, 103 aa, Homo sapiens
PAPYIRGLGGSRAAAGRSRGSFLSVSGRLGAGDCWRGAWDLTLVPLRLLSRPGPLESSLTPGELSLPPRCRPIFRGRKMPSNAPTNFLRLAKSSLLWMFFMML

SEQ ID NO: 838983 - protein, 591 aa, Homo sapiens
MPAYFQRPENALKRANEFLEVGKKQPALDVLYDVMKSKKHRTWQKIHEPIMLKYLELCVDLRKSHLAKEGLYQYKNICQQVNIKSLEDVVRAYLKMAEEKTEAAKEESQQMVLDIEDLDNIQTPESVLLSAVSGEDTQDRTDRLLLTPWVKFLWESYRQCLDLLRNNSRVERLYHDIAQQAFKFCLQYTRKAEFRKLCDNLRMHLSQIQRHHNQSTAINLNNPESQSMHLETRLVQLDSAISMELWQEAFKAVEDIHGLFSLSKKPPKPQLMANYYNKVSTVFWKSGNALFHASTLHRLYHLSREMRKNLTQDEMQRMSTRVLLATLSIPITPERTDIARLLDMDGIIVEKQRRLATLLGLQAPPTRIGLINDMVRFNVLQYVVPEVKDLYNWLEVEFNPLKLCERVTKVLNWVREQPEKEPELQQYVPQLQNNTILRLLQQVSQIYQSIEFSRLTSLVPFVDAFQLERAIVDAARHCDLQVRIDHTSRTLSFGSDLNYATREDAPIGPHLQSMPSEQIRNQLTAMSSVLAKALEVIKPAHILQEKEEQHQLAVTAYLKNSRKEHQRILARRQTIEERKAGSRRKPGVQGV

SEQ ID NO: 838984 - protein, 309 aa, Homo sapiens
AIPGIPYERRLLIMADPRDKALQDYRKKLLEHKEIDGRLKELREQLKELTKQYEKSENDLKALQSVGQIVGEVLKQLTEEKFIVKATNGPRYVVGCRRQLDKSKLKPGTRVALDMTTLTIMRYLPREVDPLVYNMSHEDPGNVSYSEIGGLSEQIRELREVIELPLTNPELFQRVGIIPPKGCLLYGPPGTGKTLLARAVASQLDCNFLKVVSSSIVDKYIGESARLIREMFNYARDHQPCIIFMDEIDAIGGRRFLRVLQLTERFRERYGVPNPMVGLKLSVELKGLGGQRTETGPVGGRILKPCWPT

SEQ ID NO: 838985 - protein, 117 aa, Homo sapiens
AIPGIPYERRLLIMADPRDKALQDYRKKLLEHKEIDGRLKECECTFLSIYIKCLDSLLPLTKQKPFAEPGNRALEMTRPRARDKALCHPALSLWSSTPSGVEMAQSSPGDRTSAALR

SEQ ID NO: 838986 - protein, 402 aa, Homo sapiens
AIPGIPYERRLLIMADPRDKALQDYRKKLLEHKEIDGRLKELREQLKELTKQYEKSENDLKALQSVGQIVGEVLKQLTEEKFIVKATNGPRYVVGCRRQLDKSKLKPGTRVALDMTTLTIMRYLPREVDPLVYNMSHEDPGNVSYSEIGGLSEQIRELREVIELPLTNPELFQRVGIIPPKGCLLYGPPGTGKTLLARAVASQLDCNFLKVVSSSIVDKYIGESARLIREMFNYARDHQPCIIFMDEIDAIGGRRFSEGTSADREIQRTLMELLNQMDGFDTLHRVKMIMATNRPDTLDPALLRPGRLDRKIHIDLPNEQARLDILKIHAGPITKHGEIDYEAIVKLSDGFNGADLRNVCTEAGMFAIRADHDFVVQEDFMKAVRKVADSKKLESKLDYKPV

SEQ ID NO: 838987 - protein, 277 aa, Homo sapiens
AIPGIPYERRLLIMADPRDKALQDYRKKLLEHKEIDGRLKELREQLKELTKQYEKSENDLKALQSVGQIVGEVLKQLTEEKFIVKATNGPRYVVGCRRQLDKSKLKPGTRVALDMTTLTIMRYLPREVDPLVYNMSHEDPGNVSYSEIGGLSEQIRELREVIELPLTNPELFQRVGIIPPKGCLLYGPPGTGKTLLARAVASQLDCNFLKVVSSSIVDKYIGESARLIREMFNYARDHQPCIIFMDEIDAIGGRRFSEGTSADREIQRTLMEIMKQL

SEQ ID NO: 838988 - protein, 192 aa, Homo sapiens
AIPGIPYERRLLIMADPRDKALQDYRKKLLEHKEIDGRLKELREQLKELTKQYEKSENDLKALQSVGQIVGEVLKQLTEEKFIVKATNGPRYVVGCRRQLDKSKLKPGTRVALDMTTLTIMRYLPREVDPLVYNMSHEDPGNVSYSEIGGLSEQIRELREVIELPLTNPELFQRVGIIPPKGCLLYGPPGCI

SEQ ID NO: 838989 - protein, 292 aa, Homo sapiens
MDQDMLWVVVDRYLPREVDPLVYNMSHEDPGNVSYSEIGGLSEQIRELREVIELPLTNPELFQRVGIIPPKGCLLYGPPGTGKTLLARAVASQLDCNFLKVVSSSIVDKYIGESARLIREMFNYARDHQPCIIFMDEIDAIGGRRFSEGTSADREIQRTLMELLNQMDGFDTLHRVKMIMATNRPDTLDPALLRPGRLDRKIHIDLPNEQARLDILKIHAGPITKHGEIDYEAIVKLSDGFNGADLRNVCTEAGMFAIRADHDFVVQEDFMKAVRKVADSKKLESKLDYKPV

SEQ ID NO: 838990 - protein, 288 aa, Homo sapiens
MTTLTIMRYLPREVDPLVYNMSHEDPGNVSYSEIGGLSEQIRELREVIELPLTNPELFQRVGIIPPKGCLLYGPPGTGKTLLARAVASQLDCNFLKVVSSSIVDKYIGESARLIREMFNYARDHQPCIIFMDEIDAIGGRRFSEGTSADREIQRTLMELLNQMDGFDTLHRVKMIMATNRPDTLDPALLRPGRLDRKIHIDLPNEQARLDILKIHAGPITKHGEIDYEAIVKLSDGFNGADLRNVCTEAGMFAIRADHDFVVQEDFMKAVRKVADSKKLESKLDYKPV

SEQ ID NO: 838991 - protein, 402 aa, Homo sapiens; identical to SEQ ID NO: 838986

SEQ ID NO: 838992 - protein, 172 aa, Homo sapiens
MFNYARDHQPCIIFMDEIDAIGGRRFSEGTSADREIQRTLMELLNQMDGFDTLHRVKMIMATNRPDTLDPALLRPGRLDRKIHIDLPNEQARLDILKIHAGPITKHGEIDYEAIVKLSDGFNGADLRNVCTEAGMFAIRADHDFVVQEDFMKAVRKVADSKKLESKLDYKPV

SEQ ID NO: 838993 - protein, 341 aa, Homo sapiens
AIPGIPYERRLLIMADPRDKALQDYRKKLLEHKEIDGRLKELREQLKELTKQYEKSENDLKALQSVGQIVGEVLKQLTEEKFIVKATNGPRYVVGCRRQLDKSKLKPGTRVALDMTTLTIMRYLPREVDPLVYNMSHEDPGNVSYSEIGGLSEQIRELREVIELPLTNPELFQRVGIIPPKGCLLYGPPGTGKTLLARAVASQLDCNFLKVVSSSIVDKYIGESARLIREMFNYARDHQPCIIFMDEIDAIGGRRFSEGTSADREIQRTLMELLNQMDGFDTLHRVKMIMATNRPDTLDPALLRPGRLDRKIHIDLPNEQARLDILKIHAGPITKHGEIAW

SEQ ID NO: 838994 - protein, 73 aa, Homo sapiens
EDPRELDQTQNYEAIVKLSDGFNGADLRNVCTEAGMFAIRADHDFVVQEDFMKAVRKVADSKKLESKLDYKPV

SEQ ID NO: 838995 - protein, 402 aa, Homo sapiens; identical to SEQ ID NO: 838986

SEQ ID NO: 838996 - protein, 229 aa, Homo sapiens
AIPGIPYERRLLIMADPRDKALQDYRKKLLEHKEIDGRLKELREQLKELTKQYEKSENDLKALQSVGQIVGEVLKQLTEEKFIVKATNGPRYVVGCRRQLDKTGITGSSHLAQQLKFTTSDSCDRIKDEFQLLQAQYHSLKLECDKLASENVRDAAVTMLTVLRSMSYGLATIENAHNRLIIVQKAERGILCPGSMTNISQEHKAEESLGAIDMAKQVIQIPKLNSIIR

SEQ ID NO: 838997 - protein, 402 aa, Homo sapiens; identical to SEQ ID NO: 838986

SEQ ID NO: 838998 - protein, 219 aa, Homo sapiens
AIPGIPYERRLLIMADPRDKALQDYRKKLLEHKEIDGRLKELREQLKELTKQYEKSENDLKALQSVGQIVGEVLKQLTEEKFIVKATNGPRYVVGCRRQLDKSKLKPGTRVALDMTTLTIMRYLPREVDPLVYNMSHEDPGNVSYSEIGGLSEQIRELREVIELPLTNPELFQRVGIIPPKGCLLYGPPGTGKTLLARAVASQLDCNFLKVKGRLFCTY

SEQ ID NO: 838999 - protein, 109 aa, Homo sapiens
AIPGIPYERRLLIMADPRDKALQDYRKKLLEHKEIDGRLKELREQLKELTKQYEKSENDLKALQSVGQIVGEVLKQLTEEKFIVKATNGPRYVVGCRRQGSVDAESWHF

SEQ ID NO: 839000 - protein, 288 aa, Homo sapiens; identical to SEQ ID NO: 838990

SEQ ID NO: 839001 - protein, 192 aa, Homo sapiens
PFPASPMRDGFSSWRTLEIRRFRTTARSCLNTRRSTAVLRSIVGEVLKQLTEEKFIVKATNGPRYVVGCRRQLDKSKLKPGTRVALDMTTLTIMRYLPREVDPLVYNMSHEDPGNVSYSEIGGLSEQIRELREVIELPLTNPELFQRVGIIPPKGCLLYGPPGTGKTLLARAVASQLDCNFLKVKGRLFCTY

SEQ ID NO: 839002 - protein, 109 aa, Homo sapiens; identical to SEQ ID NO: 838999

SEQ ID NO: 839003 - protein, 49 aa, Homo sapiens
AYSANLSHPHKRWHPMGGAGTDHYIQCNPQSFSFASPHLPPINQNSACA

SEQ ID NO: 839004 - protein, 103 aa, Homo sapiens
MILKERPLGVKLGHSPKVFQQWGLTSPGFTEEAPLEALPRPCIKAVLTIDEKGTEAAGAMFLEAIPMSIPPEVKFNKPFVFLMIEQNTKSPLFMGKVVNPTQK

SEQ ID NO: 839005 - protein, 41 aa, Homo sapiens
MIRITQPSTRSPPTWAEFAFSLYRQLAHQSNSISALERCRA

SEQ ID NO: 839006 - protein, 171 aa, Homo sapiens
NRGPPGKCTYDRREAMRITAAEQACQAGTCMIKSLGRMQRAIFFVPDEGAPPTTWKMYSRQFLYWGTPMILKERPLGVKLGHSPKVFQQWGLTSPGFTEEAPLEALPRPCIKAVLTIDEKGTEAAGAMFLEAIPMSIPPEVKFNKPFVFLMIEQNTKSPLFMGKVVNPTQK

SEQ ID NO: 839007 - protein, 418 aa, Homo sapiens
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 839008 - protein, 418 aa, Homo sapiens; identical to SEQ ID NO: 839007

SEQ ID NO: 839009 - protein, 418 aa, Homo sapiens; identical to SEQ ID NO: 839007

SEQ ID NO: 839010 - protein, 418 aa, Homo sapiens; identical to SEQ ID NO: 839007

SEQ ID NO: 839011 - protein, 418 aa, Homo sapiens; identical to SEQ ID NO: 839007

SEQ ID NO: 839012 - protein, 418 aa, Homo sapiens; identical to SEQ ID NO: 839007

SEQ ID NO: 839013 - protein, 76 aa, Homo sapiens
VVQRATCPGTVNRQCRLLSRGASSCWQACAAWSLSPWLRIPREMLPRRQGDAAQKTDTSHHDQDHPTFNKITPNLG

SEQ ID NO: 839014 - protein, 103 aa, Homo sapiens; identical to SEQ ID NO: 839004

SEQ ID NO: 839015 - protein, 165 aa, Homo sapiens
MFNIQHCKKAVQLGAADEIPGAMPPPSSSCLMKGKLQAPGENEVLPQLNIYPKTVPNYWGTPMILKERPLGVKLGHSPKVFQQWGLTSPGFTEEAPLEALPRPCIKAVLTIDEKGTEAAGAMFLEAIPMSIPPEVKFNKPFVFLMIEQNTKSPLFMGKVVNPTQK

SEQ ID NO: 839016 - protein, 239 aa, Homo sapiens
MFNIQHCKKAVQLGAADEIPGAMPPPSSSCLMKGKLQAPGENELTPRIFITQVPWGKLKDRSLPPLTGFLPKWAIIEEFTKNNSLIIPTIIATITLLNLYFYLRLIYSTSITLLPISNNVKIKGQFEHYKTTHSSPHSSPLPRYSYLISPFLTDNATSMRKNNRKPTTNPPAADTSDPQARSPRPTQGPGDRNAPGPTDAHTHAPQADDRSHPNTGGGGATTTPAGGDTRHRAGQTEPS

SEQ ID NO: 839017 - protein, 418 aa, Homo sapiens; identical to SEQ ID NO: 839007

SEQ ID NO: 839018 - protein, 418 aa, Homo sapiens; identical to SEQ ID NO: 839007

SEQ ID NO: 839019 - protein, 418 aa, Homo sapiens; identical to SEQ ID NO: 839007

SEQ ID NO: 839020 - protein, 418 aa, Homo sapiens; identical to SEQ ID NO: 839007

SEQ ID NO: 839021 - protein, 517 aa, Homo sapiens
AAALSAGRSPCCRVPFVAGSDSGRPRRAELRGVRRSSRAATTEQQRDWPPRAPFAAVPFPGALTPFSGWDCSGGADSAGIAAEAAASAAASAAERGSMFSPGQEEHCAPNKEPVKYGELVVLGYNGALPNGDRGRRKSRFALYKRPKANGVKPSTVHVISTPQASKAISCKGQHSISYTLSRNQTVVVEYTHDKDTDMFQVGRSTESPIDFVVTDTISGSQNTDEAQITQSTISRFACRIVCDRNEPYTARIFAAGFDSSKNIFLGEKAAKWKNPDGHMDGLTTNGVLVMHPRGGFTEESQPGVWREISVCGDVYTLRETRSAQQRGKLVESETNVLQDGSLIDLCGATLLWRTADGLFHTPTQKHIEALRQEINAARPQCPVGLNTLAFPSINRKEVVEEKQPWAYLSCGHVHGYHNWGHRSDTEANERECPMCRTVGPYVPLWLGCEAGFYVDAGPPTHAFTPCGHVCSEKSAKYWSQIPLPHGTHAFHAACPFCATQLVGEQNCIKLIFQGPID

SEQ ID NO: 839022 - protein, 517 aa, Homo sapiens; identical to SEQ ID NO: 839021

SEQ ID NO: 839023 - protein, 517 aa, Homo sapiens; identical to SEQ ID NO: 839021

SEQ ID NO: 839024 - protein, 160 aa, Homo sapiens
WGAWLREVVGLPGPLGAGQELSPKTLLGPGVGPESGLEMQPGGRAGPGGGAGRLQVGLRGQLEEAWPLPPALPSCSSWLHLPPPSKQALLAQLPPAFVDPEVSATKLFRPTSLLPVTEQSQLRLEKGVCRPRCCLPGESPGPALAPPRPPRPKSLPSSQL

SEQ ID NO: 839025 - protein, 316 aa, Homo sapiens
MDNTFAQCKKGVRVVNCARGGIVDEGALLRALQSGQCAGAALDVFTEEPPRDRALVDHENVISCPHLGASTKEAQSRCGEEIAVQFVDMVKGKSLTGVVNAQALTSAFSPHTKPWIGLAEALGTLMRAWAGSPKGTIQVITQGTSLKNAGNCLSPAVIVGLLKEASKQADVNLVNAKLLVKEAGLNVTTSHSPAAPGEQGFGECLLAVALAGAPYQAVGLVQGTTPVLQGLNGAVFRPEVPLRRDLPLLLFRTQTSDPAMLPTMIGLLAEAGVRLLSYQTSLVSDGETWHVMGISSLLPSLEAWKQHVTEAFQFHF

SEQ ID NO: 839026 - protein, 117 aa, Homo sapiens
LGPLFFSLFNIPDKTVQFTGPPLSVTLKSTENITLRRRSVVCTDIELTLTILALSEHSAGILYSILGLLQAGGVRLLSNVIPGISHGETWHVMGISSLLPSLEAWKQHVTEAFQFHF

SEQ ID NO: 839027 - protein, 316 aa, Homo sapiens; identical to SEQ ID NO: 839025

SEQ ID NO: 839028 - protein, 316 aa, Homo sapiens; identical to SEQ ID NO: 839025

SEQ ID NO: 839029 - protein, 316 aa, Homo sapiens; identical to SEQ ID NO: 839025

SEQ ID NO: 839030 - protein, 316 aa, Homo sapiens; identical to SEQ ID NO: 839025

SEQ ID NO: 839031 - protein, 217 aa, Homo sapiens
MAFANLRKVLISDSLDPCCRKILQDGGLQVVEKQNLSKEELIAELQDCEGLIVRSATKVTADVINAAEKLQVVGRAGTGVDNVDLEAATRKGILVMNTPNGNSLSAAELTCGMIMCLARQIPQATASMKDGKWERKKFMGTELNGKTLGILGLGRIGREVATRMQSFGMKTIGYDPIISPEVSSLLWCSAAAPGGRSGLSVISSLCTLLSCPPRQAC

SEQ ID NO: 839032 - protein, 309 aa, Homo sapiens
MDNTFAQCKKGVRVVNCARGGIVDEGALLRALQSGQCAGAALDVFTEEPPRDRALVDHENVISCPHLGASTKEAQSRCGEEIAVQFVDMVKGKSLTGVVNAQALTSAFSPHTKPWIGLAEALGTLMRAWAGSPKGTIQVITQGTSLKNAGNCLSPAVIVGLLKEASKQADVNLVNAKLLVTTSHSPAAPGEQGFGECLLAVALAGAPYQAVGLVQGTTPVLQGLNGAVFRPEVPLRRDLPLLLFRTQTSDPAMLPTMIGLLAEAGVRLLSYQTSLVSDGETWHVMGISSLLPSLEAWKQHVTEAFQFHF

SEQ ID NO: 839033 - protein, 316 aa, Homo sapiens; identical to SEQ ID NO: 839025

SEQ ID NO: 839034 - protein, 320 aa, Homo sapiens
MDNTFAQCKKGVRVVNCARGGIVDEGALLRALQSGQCAGAALDVFTEEPPRDRALVDHENVISCPHLGASTKEAQSRCGEEIAVQFVDMVKGKSLTGVVNAQALTSAFSPHTKPWIGLAEALGTLMRAWAGSPKGTIQVITQGTSLKNAGNCLSPAVIVGLLKEASKQADVNLVNAKLLVKEAGLNVTTSHSPAAPGEQGFGECLLAVALAGAPYQAVGLVQGTTPVLQGLNGAVFRPEPLWGEIAVQFLDMVKGKSLTGVVNAQPLTSAFSPHTKPWIGLAEALGTLMRAWVWVPQRDHPGDNTGNIPEECWSLPLGLF

SEQ ID NO: 839035 - protein, 217 aa, Homo sapiens; identical to SEQ ID NO: 839031

SEQ ID NO: 839036 - protein, 316 aa, Homo sapiens; identical to SEQ ID NO: 839025

SEQ ID NO: 839037 - protein, 316 aa, Homo sapiens; identical to SEQ ID NO: 839025

SEQ ID NO: 839038 - protein, 316 aa, Homo sapiens; identical to SEQ ID NO: 839025

SEQ ID NO: 839039 - protein, 205 aa, Homo sapiens
MAFANLRKVLISDSLDPCCRKILQDGGLQVVEKQNLSKEELIAELQDCEGLIVRSATKVTADVINAAEKLQVVGRAGTGVDNVDLEAATRKGILVMNTPNGNSLSAAELTCGMIMCLARQIPQATASMKDGKWERKKFMGTELNGKTLGILGLGRIGREVATRMQSFGMKTIGYDPIISPEVSSLLWCSAAAPGGRSGLSVISSL

SEQ ID NO: 839040 - protein, 723 aa, Homo sapiens
FLRRIARYIGDHGGTHMWWCSQWAYVNVVVFVGNVPFSYLNLVLMRLANRVVSLGPGALTTMVNGSQNVSPYCSPFRPNGARLLSQFVWTTAKVDKVLCVEGPKRTSSQTSGCAILFQTMVRTPTFYSGLWSTLSSSKGFQVCASLGVSPGNTNWQMTHSVCSTGFPCDPGRMGAISFSSGCAAWENDSRLFPLWIAPPMPGDHGVCTCVSLLGPLISLLPNLSLGVLPGGLPHDLMWAPSWTPSGIVLTFAPGIRPCALFAPTDFCSTLCDLGCVTFVALTSSRAQGTSSLHPKSCHSKRCPISKRFHYVPPMVLSDSSSYFSEVAPTKLNRSWRFYGTGFPPATFHVQANLVLPSVYCTSRIESPSLWVTLKLHGLCHHVVLSRRHCAPRLHSQEAIGAVDDGNGHLLMPPMGKFSNPQGEISTFTMSTNWTAISSLQSGQCAGAALDVFTEEPPRDRALVDHENVISCPHLGASTKEAQSRCGEEIAVQFVDMVKGKSLTGVVNAQALTSAFSPHTKPWIGLAEALGTLMRAWAGSPKGTIQVITQGTSLKNAGNCLSPAVIVGLLKEASKQADVNLVNAKLLVKEAGLNVTTSHSPAAPGEQGFGECLLAVALAGAPYQAVGLVQGTTPVLQGLNGAVFRPEVPLRRDLPLLLFRTQTSDPAMLPTMIGLLAEAGVRLLSYQTSLVSDGETWHVMGISSLLPSLEAWKQHVTEAFQFHF

SEQ ID NO: 839041 - protein, 299 aa, Homo sapiens
MAFANLRKVLISDSLDPCCRKILQDGGLQVVEKQNLSKEELIAELQDCEGLIVRSATKVTADVINAAEKLQVVGRAGTGVDNVDLEAATRKGILVMNTPNGNSLSAAELTCGMIMCLARQIPQATASMKDGKWERKKFMGTELNGKTLGILGLGRIGREVATRMQSFGMKTIGYDPIISPEVSSLLWCSAAAPGGRSGLSVISSLCTLLSCPPRQVADGKNLWPRGRTGTRVCDTVPEEGQWEKGSRSRGRETAQVARELNGNRFSSKTPDDQVPCGDHRMESRVHTLAVLPTRELNDG

SEQ ID NO: 839042 - protein, 156 aa, Homo sapiens
MGDLAKRGGWTWCSQEVSQSPCLLHTVTTSHSPAAPGEQGFGECLLAVALAGAPYQAVGLVQGTTPVLQGLNGAVFRPEVPLRRDLPLLLFRTQTSDPAMLPTMIGLLAEAGVRLLSYQTSLVSDGETWHVMGISSLLPSLEAWKQHVTEAFQFHF

SEQ ID NO: 839043 - protein, 72 aa, Homo sapiens
RALLRYCAQLRRSRAAMLALRILLAEAGVRLLSYQTSLVSDGETWHVMGISSLLPSLEAWKQHVTEAFQFHF

SEQ ID NO: 839044 - protein, 97 aa, Homo sapiens
MAFANLRKVLISDSLDPCCRKILQDGGLQVVEKQNLSKEELIAELQGKARERKLRSLGQPPWKKGWLRPGQRAPLACTPYQLVPGPPNWSFCFPCAE

SEQ ID NO: 839045 - protein, 184 aa, Homo sapiens
GPHGSFSLSPGTSLKNAGNCLSPAVIVGLLKEASKQADVNLVNAKLLVKEAGLNVTTSHSPAAPGEQGFGECLLAVALAGAPYQAVGLVQGTTPVLQGLNGAVFRPEVPLRRDLPLLLFRTQTSDPAMLPTMIGLLAEAGVRLLSYQTSLVSDGETWHVMGISSLLPSLEAWKQHVTEAFQFHF

SEQ ID NO: 839046 - protein, 316 aa, Homo sapiens; identical to SEQ ID NO: 839025

SEQ ID NO: 839047 - protein, 316 aa, Homo sapiens; identical to SEQ ID NO: 839025

SEQ ID NO: 839048 - protein, 316 aa, Homo sapiens; identical to SEQ ID NO: 839025

SEQ ID NO: 839049 - protein, 323 aa, Homo sapiens
MDNTFAQCKKGVRVVNCARGGIVDEGALLRALQSGQCAGAALDVFTEEPPRDRALVDHENVISCPHLGASTKEAQSRCGEEIAVQFVDMVKGKSLTGVVNAQALTSAFSPHTKPWIGLAEALGTLMRAWAGSPKGTIQVITQGTSLKNAGNCLSPAVIVGLLKEASKQADVNLVNAKLLVKEAGLNSPCLLHTVTTSHSPAAPGEQGFGECLLAVALAGAPYQAVGLVQGTTPVLQGLNGAVFRPEVPLRRDLPLLLFRTQTSDPAMLPTMIGLLAEAGVRLLSYQTSLVSDGETWHVMGISSLLPSLEAWKQHVTEAFQFHF

SEQ ID NO: 839050 - protein, 316 aa, Homo sapiens; identical to SEQ ID NO: 839025

SEQ ID NO: 839051 - protein, 316 aa, Homo sapiens; identical to SEQ ID NO: 839025

SEQ ID NO: 839052 - protein, 258 aa, Homo sapiens
MDNTFAQCKKGVRVVNCARGGIVDEGALLRALQSGQCAGAALDVFTEEPPRDRALVDHENVISCPHLGASTKEAQSRCGEEIAVQFVDMVKGKSLTGVVNAQALTSAFSPHTKPWIGLAEALGTLMRAWAGSPKGTIQVITQGTSLKNAGNCLSPAVIVGLLKEASKQADVNLVNAKLLVKEAGLNVTTSHSPAAPGEQGFGECLLAVALAGAPYQAVGLVQGTTPVLQGLNGAVFRPEVPLRRDLPLLLFRTLNAGL

SEQ ID NO: 839053 - protein, 217 aa, Homo sapiens; identical to SEQ ID NO: 839031

SEQ ID NO: 839054 - protein, 217 aa, Homo sapiens; identical to SEQ ID NO: 839031

SEQ ID NO: 839055 - protein, 316 aa, Homo sapiens; identical to SEQ ID NO: 839025

SEQ ID NO: 839056 - protein, 316 aa, Homo sapiens; identical to SEQ ID NO: 839025

SEQ ID NO: 839057 - protein, 316 aa, Homo sapiens; identical to SEQ ID NO: 839025

SEQ ID NO: 839058 - protein, 245 aa, Homo sapiens
MWAQSRCGEEIAVQFVDMVKGKSLTGVVNAQALTSAFSPHTKPWIGLAEALGTLMRAWAGSPKGTIQVITQGTSLKNAGNCLSPAVIVGLLKEASKQADVNLVNAKLLVKEAGLNVTTSHSPAAPGEQGFGECLLAVALAGAPYQAVGLVQGTTPVLQGLNGAVFRPEVPLRRDLPLLLFRTQTSDPAMLPTMIGLLAEAGVRLLSYQTSLVSDGETWHVMGISSLLPSLEAWKQHVTEAFQFHF

SEQ ID NO: 839059 - protein, 279 aa, Homo sapiens
MAFANLRKVLISDSLDPCCRKILQDGGLQVVEKQNLSKEELIAELQDCEGLIVRSATKVTADVINAAEKLQVVGRAGTGVDNVDLEAATRKGILVMNTPNGNSLSAAELTCGMIMCLARQIPQATASMKDGKWERKKFMGTELNGKTLGILGLGRIGREVATRMQSFGMKTIGYDPIISPEVSSLLWCSAAAPGGRSGLSVISSLCTLLSCPPRQAADENFGRAKGAVVTALGSWKAPGGPDWPFPGRWVVGNPGRLLPNFCAPLARGTGGVFDVGAPG

SEQ ID NO: 839060 - protein, 208 aa, Homo sapiens
MAFANLRKVLISDSLDPCCRKILQDGGLQVVEKQNLSKEELIAELQDCEGLIVRSATKVTADVINAAEKLQVVGRAGTGVDNVDLEAATRKGILVMNTPNGNSLSAAELTCGMIMCLARQIPQATASMKDGKWERKKFMGTELNGKTLGILGLGRIGREVATRMQSFGMKASFSVAPLHINIPGNILHHGDFGSDFNQMKSPTSFLND

SEQ ID NO: 839061 - protein, 229 aa, Homo sapiens
MDSTLTASEIRQRFIDFFKRNEHTYVHSSATIPLDDPTLLFANAGMNQFKPIFLNTIDPSHPMAKLSRAANTQKCIRAGGKHNDLDDVGKDVYHHTFFEMLGSWSFGDYFKELACKMALELLTQEFGIPIERLYVTYFGGDEAAGLEADLECKQIWQNLGLDDTKILPGNMKDNFWEMGDTGPCGPCSEIHYDRIGGRDAAHLVNQDDPNVLEIWNLVFIQYNRETDGS

SEQ ID NO: 839062 - protein, 968 aa, Homo sapiens
MDSTLTASEIRQRFIDFFKRNEHTYVHSSATIPLDDPTLLFANAGMNQFKPIFLNTIDPSHPMAKLSRAANTQKCIRAGGKHNDLDDVGKDVYHHTFFEMLGSWSFGDYFKELACKMALELLTQEFGIPIERLYVTYFGGDEAAGLEADLECKQIWQNLGLDDTKILPGNMKDNFWEMGDTGPCGPCSEIHYDRIGGRDAAHLVNQDDPNVLEIWNLVFIQYNREADGILKPLPKKSIDTGMGLERLVSVLQNKMSNYDTDLFVPYFEAIQKGTGARPYTGKVGAEDADGIDMAYRVLADHARTITVALADGGRPDNTGRGYVLRRILRRAVRYAHEKLNASRGFFATLVDVVVQSLGDAFPELKKDPDMVKDIINEEEVQFLKTLSRGRRILDRKIQSLGDSKTIPGDTAWLLYDTYGFPVDLTGLIAEEKGLVVDMDGFEEERKLAQLKSQGKGAGGEDLIMLDIYAIEELRARGLEVTDDSPKYNYHLDSSGSYVFENTVATVMALRREKMFVEEVSTGQECGVVLDKTCFYAEQGGQIYDEGYLVKVDDSSEDKTEFTVKNAQVRGGYVLHIGTIYGDLKVGDQVWLFIDEPRRRPIMSNHTATHILNFALRSVLGEADQKGSLVAPDRLRFDFTAKGAMSTQQIKKAEEIANEMIEAAKAVYTQDCPLAAAKAIQGLRAVFDETYPDPVRVVSIGVPVSELLDDPSGPAGSLTSVEFCGGTHLRNSSHAGAFVIVTEEAIAKGIRRIVAVTGAEAQKALRKAESLKKCLSVMEAKVKAQTAPNKDVQREIADLGEALATAVIPQWQKDELRETLKSLKKVMDDLDRASKADVQKRVLEKTKQFIDSNPNQPLVILEMESGASAKALNEALKLFKMHSPQTSAMLFTVDNEAGKITCLCQVPQNAANRGLKASEWVQQVSGLMDGKGGGKDVSAQATGKNVGCLQEALQLATSFAQLRLGDVKN

SEQ ID NO: 839063 - protein, 942 aa, Homo sapiens
MDSTLTASEIRQRFIDFFKRNEHTYVHSSATIPLDDPTLLFANAGMNQFKPIFLNTIDPSHPMAKLSRAANTQKCIRAGGKHNDLDDVGKDVYHHTFFEMLGSWSFGDYFKELACKMALELLTQEFGIPIERLYVTYFGGDEAAGLEADLECKQIWQNLGLDDTKILPGNMKDNFWEMGDTGPCGPCSEIHYDRIGGRDAAHLVNQDDPNVLEIWNLVFIQYNREADGILKPLPKKSIDTGMGLERLVSVLQNKMSNYDTDLFVPYFEAIQKGTGARPYTGKVGAEDADGIDMAYRVLADHARTITVALADGGRPDNTGRGYVLRRILRRAVRYAHEKLNASRGFFATLVDVVVQSLGDAFPELKKDPDMVKDIINEEEVQFLKTLSRGRRILDRKIQSLGDSKTIPGDTAWLLYDTYGFPVDLTGLIAEEKGLVVDMDGFEEERKLAQLKSQGKGAGGEDLIMLDIYAIEELRARGLEVTDDSPKYNYHLDSSGSYVFENTVATVMALRREKMFVEEVSTGQECGVVLDKTCFYAEQGGQIYDEGYLVKVDDSSEDKTEFTVKNAQVRGGYVLHIGTIYGDLKVGDQVWLFIDEPRRRPIMSNHTATHILNFALRSVLGEADQKGSLVAPDRLRFDFTAKGAMSTQQIKKAEEIANEMIEAAKAVYTQDCPLAAAKAIQGLRAVFDETYPDPVRVVSIGVPVSELLDDPSGPAGSLTSVEFCGGTHLRNSSHAGAFVIVTEEAIAKGIRRIVAVTGAEAQKALRKAESLKKCLSVMEAKVKAQTAPNKDVQREIADLGEALATAVIPQWQKDELRETLKSLKKVMDDLDRASKADVQKRVLEKTKQFIDSNPNQPLVILEMESGASAKALNEALKLFKMHSPQTSAMLFTVDNEAGKITCLCQVPQVVARMCLHRPQARTLAACRRRCSWPLPSPSCASGM

SEQ ID NO: 839064 - protein, 865 aa, Homo sapiens
MDSTLTASEIRQRFIDFFKRNEHTYVHSSATIPLDDPTLLFANAGMNQFKPIFLNTIDPSHPMAKLSRAANTQKCIRAGGKHNDLDDVGKDVYHHTFFEMLGSWSFGDYFKELACKMALELLTQEFGIPIERLYVTYFGGDEAAGLEADLECKQIWQNLGLDDTKILPGNMKDNFWEMGDTGPCGPCSEIHYDRIGGRDAAHLVNQDDPNVLEIWNLVFIQYNREADGILKPLPKKSIDTGMGLERLVSVLQNKMSNYDTDLFVPYFEAIQKGTGARPYTGKVGAEDADGIDMAYRVLADHARTITVALADGGRPDNTGRGYVLRRILRRAVRYAHEKLNASRGFFATLVDVVVQSLGDAFPELKKDPDMVKDIINEEEVQFLKTLSRGRRILDRKIQSLGDSKTIPGDTAWLLYDTYGFPVDLTGLIAEEKGLVVDMDGFEEERKLAQLKSQGKGAGGEDLIMLDIYAIEELRARGLEVTDDSPKYNYHLDSSGSYVFENTVATVMALRREKMFVEEVSTGQECGVVLDKTCFYAEQGGQIYDEGYLVKVDDSSEDKTEFTVKNAQVRGGYVLHIGTIYGDLKVGDQVWLFIDEPRRRPIMSNHTATHILNFALRSVLGEADQKGSLVAPDRLRFDFTAKGAMSTQQIKKAEEIANEMIEAAKAVYTQDCPLAAAKAIQGLRAVFDETYPDPVRVVSIGVPVSELLDDPSGPAGSLTSVEFCGGTHLRNSSHAGAFVIVTEEAIAKGIRRIVAVTGAEAQKALRKAESLKKCLSVMEAKVKAQTAPNKDVQREIADLGEALATAVIPQWQKDELRETLKSLKKVTGHFLRPAAPRGCKELSGEGGGSHWIHPSSQELFICYKNI

SEQ ID NO: 839065 - protein, 726 aa, Homo sapiens
MDSTLTASEIRQRFIDFFKRNEHTYVHSSATIPLDDPTLLFANAGMNQFKPIFLNTIDPSHPMAKLSRAANTQKCIRAGGKHNDLDDVGKDVYHHTFFEMLGSWSFGDYFKELACKMALELLTQEFGIPIERLYVTYFGGDEAAGLEADLECKQIWQNLGLDDTKILPGNMKDNFWEMGDTGPCGPCSEIHYDRIGGRDAAHLVNQDDPNVLEIWNLVFIQYNREADGILKPLPKKSIDTGMGLERLVSVLQNKMSNYDTDLFVPYFEAIQKGTGARPYTGKVGAEDADGIDMAYRVLADHARTITVALADGGRPDNTGRGYVLRRILRRAVRYAHEKLNASRGFFATLVDVVVQSLGDAFPELKKDPDMVKDIINEEEVQFLKTLSRGRRILDRKIQSLGDSKTIPGDTAWLLYDTYGFPVDLTGLIAEEKGLVVDMDGFEEERKLAQLKSQGKGAGGEDLIMLDIYAIEELRARGLEVTDDSPKYNYHLDSSGSYVFENTVATVMALRREKMFVEEVSTGQECGVVLDKTCFYAEQGGQIYDEGYLVKVDDSSEDKTEFTVKNAQVRGGYVLHIGTIYGDLKVGDQVWLFIDEPRRRPIMSNHTATHILNFALRSVLGEADQKGSLVAPDRLRFDFTAKGAMSTQQIKKAEEIANEMIEAAKAVYTQDCPLAAAKAIQGLRAVFDETYPDPVRVVSIGVPVSELLDDPSGPAGSLTSVEFCGGT

SEQ ID NO: 839066 - protein, 463 aa, Homo sapiens
MTWTMWARMFVEEVSTGQECGVVLDKTCFYAEQGGQIYDEGYLVKVDDSSEDKTEFTVKNAQVRGGYVLHIGTIYGDLKVGDQVWLFIDEPRRRPIMSNHTATHILNFALRSVLGEADQKGSLVAPDRLRFDFTAKGAMSTQQIKKAEEIANEMIEAAKAVYTQDCPLAAAKAIQGLRAVFDETYPDPVRVVSIGVPVSELLDDPSGPAGSLTSVEFCGGTHLRNSSHAGAFVIVTEEAIAKGIRRIVAVTGAEAQKALRKAESLKKCLSVMEAKVKAQTAPNKDVQREIADLGEALATAVIPQWQKDELRETLKSLKKVMDDLDRASKADVQKRVLEKTKQFIDSNPNQPLVILEMESGASAKALNEALKLFKMHSPQTSAMLFTVDNEAGKITCLCQVPQNAANRGLKASEWVQQVSGLMDGKGGGKDVSAQATGKNVGCLQEALQLATSFAQLRLGDVKN

SEQ ID NO: 839067 - protein, 583 aa, Homo sapiens
MDSTLTASEIRQRFIDFFKRNEHTYVHSSATIPLDDPTLLFANAGMNQFKPIFLNTIDPSHPMAKLSRAANTQKCIRAGGKHNDLDDVGKDVYHHTFFEMLGSWSFGDYFKELACKMALELLTQEFGIPIERLYVTYFGGDEAAGLEADLECKQIWQNLGLDDTKILPGNMKDNFWEMGDTGPCGPCSEIHYDRIGGRDAAHLVNQDDPNVLEIWNLVFIQYNREADGILKPLPKKSIDTGMGLERLVSVLQNKMSNYDTDLFVPYFEAIQKGTGARPYTGKVGAEDADGIDMAYRVLADHARTITVALADGGRPDNTGRGYVLRRILRRAVRYAHEKLNASRGFFATLVDVVVQSLGDAFPELKKDPDMVKDIINEEEVQFLKTLSRGRRILDRKIQSLGDSKTIPGDTAWLLYDTYGFPVDLTGLIAEEKGLVVDMDGFEEERKLAQLKSQGKGAGGEDLIMLDIYAIEELRARGLEVTDDSPKYNYHLDSSGSYVFENTVATVMALRREKMFVEEVSTGQECGVVLDKTCFYAEQGGQIYDEGYLVKVDDSSEDSPDLSFPRQQVGIVFAAENKRTTCNT

SEQ ID NO: 839068 - protein, 346 aa, Homo sapiens [sequence omitted]

SEQ ID NO: 839069 - protein, 189 aa, Homo sapiens
PRLVRGWVVQGCAEGDADFGEALATAVIPQWQKDELRETLKSLKKVMDDLDRASKADVQKRVLEKTKQFIDSNPNQPLVILEMESGASAKALNEALKLFKMHSPQTSAMLFTVDNEAGKITCLCQVPQNAANRGLKASEWVQQVSGLMDGKGGGKDVSAQATGKNVGCLQEALQLATSFAQLRLGDVKN

SEQ ID NO: 839070 - protein, 189 aa, Homo sapiens; identical to SEQ ID NO: 839069

SEQ ID NO: 839071 - protein, 128 aa, Homo sapiens
VAGLLRAANAHTSEGPCSSTVAWARSSPQALNEALKLFKMHSPQTSAMLFTVDNEAGKITCLCQVPQNAANRGLKASEWVQQVSGLMDGKGGGKDVSAQATGKNVGCLQEALQLATSFAQLRLGDVKN

SEQ ID NO: 839072 - protein, 73 aa, Homo sapiens
MSNHTATHILNFALRSVLGEADQKGSLVAPDRLRFDFTAKGAMSTQQIKKAEEIANEMIEAAKVGWATAECPP

SEQ ID NO: 839073 - protein, 968 aa, Homo sapiens; identical to SEQ ID NO: 839062

SEQ ID NO: 839074 - protein, 39 aa, Homo sapiens
MDDLDRASKADVQKRVLEKTKQFIDSNPNQPTVDKWYRA

SEQ ID NO: 839075 - protein, 968 aa, Homo sapiens
MDSTLTASEIRQRFIDFFKRNEHTYVHSSATIPLDDPTLLFANAGMNQFKPIFLNTIDPSHPMAKLSRAANTQKCIRAGGKHNDLDDVGKDVYHHTFFEMLGSWSFGDYFKELACKMALELLTQEFGIPIERLYVTYFGGDEAAGLEADLECKQIWQNLGLDDTKILPGNMKDNFWEMGDTGPCGPCSEIHYDRIGGRDAAHLVNQDDPNVLEIWNLVFIQYNREADGILKPLPKKSIDTGMGLERLVSVLQNKMSNYDTDLFVPYFEAIQKGTGARPYTGKVGAEDADGIDMAYRVLADHARTITVALADGGRPDNTGRGYVLRRILRRAVRYAHEKLNASRGFFATLVDVVVQSLGDAFPELKKDPDMVKDIINEEEVQFLKTLSRGRRILDRKIQSLGDSKTIPGDTAWLLYDTYGFPVDLTGLIAEEKGLVVDMDGFEEERKLAQLKSQGKGAGGEDLIMLDIYAIEELRARGLEVTDDSPKYNYHLDSSGSYVFENTVATVMALRREKMFVEEVSTGQECGVVLDKTCFYAEQGGQIYDEGYLVKVDDSSEDKTEFTVKNAQVRGGYVLHIGTIYGDLKVGDQVWLFIDEPRRRPIMSNHTATHILNFALRSVLGEADQKGSLVAPDRLRFDFTAKGAMSTQQIKKAEEIANEMIEAAKAVYTQDCPLAAAKAIQGLRAVFDETYPDPVRVVSIGVPVSELLDDPSGPAGSLTSVEFCGGTHLRNSSHAGAFVIVTEEAIAKGIRRIVAVTGAEAQKALRKAESLKKCLSVMEAKVKAQTAPNKDVQREIADLGEALATAVIPQWQKDELRETLKSLKKVMDDLDRASKADVQKRVLEKTKQFIDSNPNQPLVILEMESGASAKALNEALKLFKMHSPQTSAMLFTVDNEAGKITCLCQVPQNAANRGLKASEWVQQVSGLMDGKGGGKDVSAQASVPDQASMPDQASVPDQASVPDQASVPD

SEQ ID NO: 839076 - protein, 894 aa, Homo sapiens
MDSTLTASEIRQRFIDFFKRNEHTYVHSSATIPLDDPTLLFANAGMNQFKPIFLNTIDPSHPMAKLSRAANTQKCIRAGGKHNDLDDVGKDVYHHTFFEMLGSWSFGDYFKELACKMALELLTQEFGIPIERLYVTYFGGDEAAGLEADLECKQIWQNLGLDDTKILPGNMKDNFWEMGDTGPCGPCSEIHYDRIGGRDAAHLVNQDDPNVLEIWNLVFIQYNREADGILKPLPKKSIDTGMGLERLVSVLQNKMSNYDTDLFVPYFEAIQKGTGARPYTGKVGAEDADGIDMAYRVLADHARTITVALADGGRPDNTGRGYVLRRILRRAVRYAHEKLNASRGFFATLVDVVVQSLGDAFPELKKDPDMVKDIINEEEVQFLKTLSRGRRILDRKIQSLGDSKTIPGDTAWLLYDTYGFPVDLTGLIAEEKGLVVDMDGFEEERKLAQLKSQGKGAGGEDLIMLDIYAIEELRARGLEVTDDSPKYNYHLDSSGSYVFENTVATVMALRREKMFVEEVSTGQECGVVLDKTCFYAEQGGQIYDEGYLVKVDDSSEDKTEFTVKNAQVRGGYVLHIGTIYGDLKVGDQVWLFIDEPRRRPIMSNHTATHILNFALRSVLGEADQKGSLVAPDRLRFDFTAKGAMSTQQIKKAEEIANEMIEAAKAVYTQDCPLAAAKAIQGLRAVFDETYPDPVRVVSIGVPVSELLDDPSGPAGSLTSVEFCGGTHLRNSSHAGAFVIVTEEAIAKGIRRIVAVTGAEAQKALRKAESLKKCLSVMEAKVKAQTAPNKDVQREIADLGEALATAVIPQWQKDELRETLKSLKKVMDDLDRASKADVQKRVLEKTKQFIDSNPNQPLVILEMESGASAKATQGPGSPPLGLISSLVADMWPLWL

SEQ ID NO: 839077 - protein, 700 aa, Homo sapiens
MDSTLTASEIRQRFIDFFKRNEHTYVHSSATIPLDDPTLLFANAGMNQFKPIFLNTIDPSHPMAKLSRAANTQKCIRAGGKHNDLDDVGKDVYHHTFFEMLGSWSFGDYFKELACKMALELLTQEFGIPIERLYVTYFGGDEAAGLEADLECKQIWQNLGLDDTKILPGNMKDNFWEMGDTGPCGPCSEIHYDRIGGRDAAHLVNQDDPNVLEIWNLVFIQYNREADGILKPLPKKSIDTGMGLERLVSVLQNKMSNYDTDLFVPYFEAIQKGTGARPYTGKVGAEDADGIDMAYRVLADHARTITVALADGGRPDNTGRGYVLRRILRRAVRYAHEKLNASRGFFATLVDVVVQSLGDAFPELKKDPDMVKDIINEEEVQFLKTLSRGRRILDRKIQSLGDSKTIPGDTAWLLYDTYGFPVDLTGLIAEEKGLVVDMDGFEEERKLAQLKSQGKGAGGEDLIMLDIYAIEELRARGLEVTDDSPKYNYHLDSSGSYVFENTVATVMALRREKMFVEEVSTGQECGVVLDKTCFYAEQGGQIYDEGYLVKVDDSSEDKTEFTVKNAQVRGGYVLHIGTIYGDLKVGDQVWLFIDEPRRRPIMSNHTATHILNFALRSVLGEADQKGSLVAPDRLRFDFTAKGAMSTQQIKKAEEIANEMIEAAKVGWATAECPPSPHRHCLSTVLAVRCSHSVVSDSSCT

SEQ ID NO: 839078 - protein, 538 aa, Homo sapiens
MDSTLTASEIRQRFIDFFKRNEHTYVHSSATIPLDDPTLLFANAGMNQFKPIFLNTIDPSHPMAKLSRAANTQKCIRAGGKHNDLDDVGKDVYHHTFFEMLGSWSFGDYFKELACKMALELLTQEFGIPIERLYVTYFGGDEAAGLEADLECKQIWQNLGLDDTKILPGNMKDNFWEMGDTGPCGPCSEIHYDRIGGRDAAHLVNQDDPNVLEIWNLVFIQYNREADGILKPLPKKSIDTGMGLERLVSVLQNKMSNYDTDLFVPYFEAIQKGTGARPYTGKVGAEDADGIDMAYRVLADHARTITVALADGGRPDNTGRGYVLRRILRRAVRYAHEKLNASRGFFATLVDVVVQSLGDAFPELKKDPDMVKDIINEEEVQFLKTLSRGRRILDRKIQSLGDSKTIPGDTAWLLYDTYGFPVDLTGLIAEEKGLVVDMDGFEEERKLAQLKSQGKGAGGEDLIMLDIYAIEELRARGLEVTDDSPKYNYHLDSSGSYVFENTVATVMALRREKIFLSRMRRPLSESLEKLHLFFTNDV

SEQ ID NO: 839079 - protein, 308 aa, Homo sapiens
MDSTLTASEIRQRFIDFFKRNEHTYVHSSATIPLDDPTLLFANAGMNQFKPIFLNTIDPSHPMAKLSRAANTQKCIRAGGKHNDLDDVGKDVYHHTFFEMLGSWSFGDYFKELACKMALELLTQEFGIPIERLYVTYFGGDEAAGLEADLECKQIWQNLGLDDTKILPGNMKDNFWEMGDTGPCGPCSEIHYDRIGGRDAAHLVNQDDPNVLEIWNLVFIQYNREADGILKPLPKKSIDTGMGLERLVSVLQNKMSNYDTDLFVPYFEAIQKGTGARPYTGKVGAEDADGIDMALNFCPEPSTSVPSV

SEQ ID NO: 839080 - protein, 190 aa, Homo sapiens
RYSTVVTAILTKPPEASPVIAPALATAVIPQWQKDELRETLKSLKKVMDDLDRASKADVQKRVLEKTKQFIDSNPNQPLVILEMESGASAKALNEALKLFKMHSPQTSAMLFTVDNEAGKITCLCQVPQNAANRGLKASEWVQQVSGLMDGKGGGKDVSAQATGKNVGCLQEALQLATSFAQLRLGDVKN

SEQ ID NO: 839081 - protein, 118 aa, Homo sapiens
MDSTLTASEIRQRFIDFFKRNEHTYVHSSATIPLDDPTLLFANAGMNQFKPIFLNTIDPSHPMAKLSRAANTQKCIRAGGKHNDLDDVGKDVYHHTFFEMLGSWSFGDYFKVSSEQKN

SEQ ID NO: 839082 - protein, 122 aa, Homo sapiens
AAVPAGTCGSDRGWGWGRGRAWRRAGAGGGRLPLPRHFLPGCGRLSGSSAFAPAAAASLSAPASFDRLPPRPGGARLLHGHSASSLPSSLLPLPFFLLPSPPRRHRPGPPAGGRARSSSQKA

SEQ ID NO: 839083 - protein, 496 aa, Homo sapiens
MKLGKKPMYKPVDPYSRMQSTYNYNMRGGAYPPRYFYPFPVPPLLYQVELSVGGQQFNGKGKTRQAAKHDAAAKALRILQNEPLPERLEVNGRESEEENLNKSEISQVFEIALKRNLPVNFEVARESGPPHMKNFVTKVSVGEFVGEGEGKSKKISKKNAAIAVLEELKKLPPLPAVERVKPRIKKKTKPIVKPQTSPEYGQGINPISRLAQIQQAKKEKEPEYTLLTERGLPRRREFVMQVKVGNHTAEGTGTNKKVAKRNAAENMLEILGFKVPQAQPTKPALKSEEKTPIKKPGDGRKVTFFEPGSGDENGTSNKEDEFRMPYLSHQQLPAGILPMVPEVAQAVGVSQGHHTKDFTRAAPNPAKATVTAMIARELLYGGTSPTAETILKNNISSGHVPHGPLTRPSEQLDYLSRVQGFQVEYKDFPKNNKNEFVSLINCSSQPPLISHGIGKDVESCHDMAALNILKLLSELDQQSTEMPRTGNGPMSVCGRC

SEQ ID NO: 839084 - protein, 577 aa, Homo sapiens
MSQVQVQVQNPSAALSGSQILNKNQSLLSQPLMSIPSTTSSLPSENAGRPIQNSALPSASITSTSAAAESITPTVELNALCMKLGKKPMYKPVDPYSRMQSTYNYNMRGGAYPPRYFYPFPVPPLLYQVELSVGGQQFNGKGKTRQAAKHDAAAKALRILQNEPLPERLEVNGRESEEENLNKSEISQVFEIALKRNLPVNFEVARESGPPHMKNFVTKVSVGEFVGEGEGKSKKISKKNAAIAVLEELKKLPPLPAVERVKPRIKKKTKPIVKPQTSPEYGQGINPISRLAQIQQAKKEKEPEYTLLTERGLPRRREFVMQVKVGNHTAEGTGTNKKVAKRNAAENMLEILGFKVPQAQPTKPALKSEEKTPIKKPGDGRKVTFFEPGSGDENGTSNKEDEFRMPYLSHQQLPAGILPMVPEVAQAVGVSQGHHTKDFTRAAPNPAKATVTAMIARELLYGGTSPTAETILKNNISSGHVPHGPLTRPSEQLDYLSRVQGFQVEYKDFPKNNKNEFVSLINCSSQPPLISHGIGKDVESCHDMAALNILKLLSELDQQSTEMPRTGNGPMSVCGRC

SEQ ID NO: 839085 - protein, 496 aa, Homo sapiens; identical to SEQ ID NO: 839083

SEQ ID NO: 839086 - protein, 496 aa, Homo sapiens; identical to SEQ ID NO: 839083

SEQ ID NO: 839087 - protein, 264 aa, Homo sapiens
GLCFDFFVQVKVGNHTAEGTGTNKKVAKRNAAENMLEILGFKVPQAQPTKPALKSEEKTPIKKPGDGRKVTFFEPGSGDENGTSNKEDEFRMPYLSHQQLPAGILPMVPEVAQAVGVSQGHHTKDFTRAAPNPAKATVTAMIARELLYGGTSPTAETILKNNISSGHVPHGPLTRPSEQLDYLSRVQGFQVEYKDFPKNNKNEFVSLINCSSQPPLISHGIGKDVESCHDMAALNILKLLSELDQQSTEMPRTGNGPMSVCGRC

SEQ ID NO: 839088 - protein, 496 aa, Homo sapiens; identical to SEQ ID NO: 839083

SEQ ID NO: 839089 - protein, 496 aa, Homo sapiens; identical to SEQ ID NO: 839083

SEQ ID NO: 839090 - protein, 373 aa, Homo sapiens
MKLGKKPMYKPVDPYSRMQSTYNYNMRGGAYPPRYFYPFPVPPLLYQVELSVGGQQFNGKGKTRQAAKHDAAAKALRILQNEPLPERLEVNGRESEEENLNKSEISQVFEIALKRNLPVNFEVARESGPPHMKNFVTKVSVGEFVGEGEGKSKKISKKNAAIAVLEELKKLPPLPAVERVKPRIKKKTKPIVKPQTSPEYGQGINPISRLAQIQQAKKEKEPEYTLLTERGLPRRREFVMQVKVGNHTAEGTGTNKKVAKRNAAENMLEILGFKVPQAQPTKPALKSEEKTPIKKPGDGRKVTFFEPGSGDENGTSNKEDEFRMPYLSHQQLPAGILPMVPEVAQAVGVSQATPSPLLSLPTVICILSFIIFF

SEQ ID NO: 839091 - protein, 353 aa, Homo sapiens
MKLGKKPMYKPVDPYSRMQSTYNYNMRGGAYPPRYFYPFPVPPLLYQVELSVGGQQFNGKGKTRQAAKHDAAAKALRILQNEPLPERLEVNGRESEEENLNKSEISQVFEIALKRNLPVNFEVARESGPPHMKNFVTKVSVGEFVGEGEGKSKKISKKNAAIAVLEELKKLPPLPAVERVKPRIKKKTKPIVKPQTSPEYGQGINPISRLAQIQQAKKEKEPEYTLLTERGLPRRREFVMQVKVGNHTAEGTGTNKKVAKRNAAENMLEILGFKVPQAQPTKPALKSEEKLGQTLDSHARERPLTGPRAKSTRENQMLPTQRDPTFLVCHGPTTSCSTHTITTAFSSNSDLYS

SEQ ID NO: 839092 - protein, 435 aa, Homo sapiens
MKLGKKPMYKPVDPYSRMQSTYNYNMRGGAYPPRYFYPFPVPPLLYQVELSVGGQQFNGKGKTRQAAKHDAAAKALRILQNEPLPERLEVNGRESEEENLNKSEISQVFEIALKRNLPVNFEVARESGPPHMKNFVTKVSVGEFVGEGEGKSKKISKKNAAIAVLEELKKLPPLPAVERVKPRIKKKTKPIVKPQTSPEYGQGINPISRLAQIQQAKKEKEPEYTLLTERGLPRRREFVMQVKVGNHTAEGTGTNKKVAKRNAAENMLEILGFKVPQAQPTKPALKSEEKTPIKKPGDGRKVTFFEPGSGDENGTSNKEDEFRMPYLSHQQLPAGILPMVPEVAQAVGVSQGHHTKDFTRAAPNPAKATVTAMIARELLYGGTSPTAETILKNNISSGHVPHGPLTRPSEQLDYLSRVQGFQVEIQRLPKKQQEG

SEQ ID NO: 839093 - protein, 325 aa, Homo sapiens
MKLGKKPMYKPVDPYSRMQSTYNYNMRGGAYPPRYFYPFPVPPLLYQVELSVGGQQFNGKGKTRQAAKHDAAAKALRILQNEPLPERLEVNGRESEEENLNKSEISQVFEIALKRNLPVNFEVARESGPPHMKNFVTKVSVGEFVGEGEGKSKKISKKNAAIAVLEELKKLPPLPAVERVKPRIKKKTKPIVKPQTSPEYGQGINPISRLAQIQQAKKEKEPEYTLLTERGLPRRREFVMQVKVGNHTAEGTGTNKKVAKRNAAENMLEILGFKVPQAQPTKPALKSEEKEGECCGLSDCKMVSRLTLGNWGTSRGRLQGKALSA

SEQ ID NO: 839094 - protein, 125 aa, Homo sapiens
AAVPAGTCGSDRGWGWGRGRAWRRAGAGGGRLPLPRHFLPGCGRLSGSSAFAPAAAASLSAPASFDRLPPRPGGARLLHGHSASSLPSSLLPLPFFLLPSPPRRHRPGPPAGGRARSSSQSLLTT

SEQ ID NO: 839095 - protein, 496 aa, Homo sapiens; identical to SEQ ID NO: 839083

SEQ ID NO: 839096 - protein, 496 aa, Homo sapiens; identical to SEQ ID NO: 839083

SEQ ID NO: 839097 - protein, 134 aa, Homo sapiens
AAVPAGTCGSDRGWGWGRGRAWRRAGAGGGRLPLPRHFLPGCGRLSGSSAFAPAAAASLSAPASFDRLPPRPGGARLLHGHSASSLPSSLLPLPFFLLPSPPRRHRPGPPAGGRARSSSQVEFCSCRPGWSAVA

SEQ ID NO: 839098 - protein, 496 aa, Homo sapiens; identical to SEQ ID NO: 839083

SEQ ID NO: 839099 - protein, 502 aa, Homo sapiens
MKLGKKPMYKPVDPYSRMQSTYNYNMRGGAYPPRYFYPFPVPPLLYQVELSVGGQQFNGKGKTRQAAKHDAAAKALRILQNEPLPERLEVNGRESEEENLNKSEISQVFEIALKRNLPVNFESFPLKQVARESGPPHMKNFVTKVSVGEFVGEGEGKSKKISKKNAAIAVLEELKKLPPLPAVERVKPRIKKKTKPIVKPQTSPEYGQGINPISRLAQIQQAKKEKEPEYTLLTERGLPRRREFVMQVKVGNHTAEGTGTNKKVAKRNAAENMLEILGFKVPQAQPTKPALKSEEKTPIKKPGDGRKVTFFEPGSGDENGTSNKEDEFRMPYLSHQQLPAGILPMVPEVAQAVGVSQGHHTKDFTRAAPNPAKATVTAMIARELLYGGTSPTAETILKNNISSGHVPHGPLTRPSEQLDYLSRVQGFQVEYKDFPKNNKNEFVSLINCSSQPPLISHGIGKDVESCHDMAALNILKLLSELDQQSTEMPRTGNGPMSVCGRC

SEQ ID NO: 839100 - protein, 276 aa, Homo sapiens
MRGNAISGAPIIRGTSSVAKASDYDGYYYEEDYYKCMGCDDNVVDVVLPRRLPGWPSSARIRRLRAVPRTPAHAPNNRYSDPMSLRFAENLVPEFGNKEDEFRMPYLSHQQLPAGILPMVPEVAQAVGVSQGHHTKDFTRAAPNPAKATVTAMIARELLYGGTSPTAETILKNNISSGHVPHGPLTRPSEQLDYLSRVQGFQVEYKDFPKNNKNEFVSLINCSSQPPLISHGIGKDVESCHDMAALNILKLLSELDQQSTEMPRTGNGPMSVCGRC

SEQ ID NO: 839101 - protein, 474 aa, Homo sapiens
MKLGKKPMYKPVDPYSRMQSTYNYNMRGGAYPPRYFYPFPVPPLLYQVELSVGGQQFNGKGKTRQAAKHDAAAKALRILQNEPLPERLEVNGRESEEENLNKSEISQVFEIALKRNLPVNFEVARESGPPHMKNFVTKVSVGEFVGEGEGKSKKISKKNAAIAVLEELKKLPPLPAVERVKPRIKKKTKPIVKPQTSPEYGQGINPISRLAQIQQAKKEKEPEYTLLTERGLPRRREFVMQVKVGNHTAEGTGTNKKVAKRNAAENMLEILGFKVPQAQPTKPALKSEEKTPIKKPGDGRKVTFFEPGSGDENGTSNKEDEFRMPYLSHQQLPAGILPMVPEVAQAVGVSQGHHTKDFTRAAPNPAKATVTAMIARELLYGGTSPTAETILKNNISSGHVPHGPLTRPSEQLGQTLDSHARERPLTGPRAKSTRENQMLPTQRDPTFLVCHGPTTSCSTHTITTAFSSNSDLYS

SEQ ID NO: 839102 - protein, 448 aa, Homo sapiens
MYKPVDPYSRMQSTYNYNMRGGAYPPRYFYPFPVPPLLYQVELSVGGQQFNGKGKTRQAAKHDAAAKALRILQNEPLPERLEVNGRESEEENLNKSEISQVFEIALKRNLPVNFEVARESGPPHMKNFVTKVSVGEFVGEGEGKSKKISKKNAAIAVLEELKKLPPLPAVERVKPRIKKKTKPIVKPQTSPEYGQGINPISRLAQIQQAKKEKEPEYTLLTERGLPRRREFVMQVKVGNHTAEGTGTNKKVAKRNAAENMLEILGFKVPQAQPTKPALKSEEKTPIKKPGDGRKVTFFEPGSGDENGTSNKEDEFRMPYLSHQQLPAGILPMVPEVAQAVGVSQGHHTKDFTRAAPNPAKATVTAMIARELLYGGTSPTAETILKNNISSGHVPHGPLTRPSEQLDYLSRVQGFQVEYKDFPKNNKNEFVSLINCSSQPLSPSMHIAQ

SEQ ID NO: 839103 - protein, 332 aa, Homo sapiens
MKLGKKPMYKPVDPYSRMQSTYNYNMRGGAYPPRYFYPFPVPPLLYQVELSVGGQQFNGKGKTRQAAKHDAAAKALRILQNEPLPERLEVNGRESEEENLNKSEISQVFEIALKRNLPVNFEVARESGPPHMKNFVTKVSVGEFVGEGEGKSKKISKKNAAIAVLEELKKLPPLPAVERVKPRIKKKTKPIVKPQTSPEYGQGINPISRLAQIQQAKKEKEPEYTLLTERGLPRRREFVMQVKVGNHTAEGTGTNKKVAKRNAAENMLEILGFKVPQAQPTKPALKSEEKTQRHPPKKKIKRRKHKNKTQINTQHNNKKKGGGAQKSSPGGA

SEQ ID NO: 839104 - protein, 125 aa, Homo sapiens; identical to SEQ ID NO: 839094

SEQ ID NO: 839105 - protein, 109 aa, Homo sapiens
MPRHLALGRDNSIQKDGVNSVGSRDSSSYQWLAADWKPACCRSVGGDMSSHCLEREQSKLRSRHLQKGNGGRTHSGVDLGLSPAVPVAIAFSAIHKHSKPNQTAVHIPA

SEQ ID NO: 839106 - protein, 370 aa, Homo sapiens
MAFRRRTKSYPLFSQEFVIHNHADIGFCLVLCVLIGLMFEVTAKTAFLFILPQYNISVPTADSETVHYHYGPKDLVTILFYIFITIILHAVVQEYILDKISKRLHLSKVKHSKFNESGQLVVFHFTSVIWCFYVVVTEGYLTNPRSLWEDYPHVHLPFQVKFFYLCQLAYWLHALPELYFQKVRKEEIPRQLQYICLYLVHIAGAYLLNLSRLGLILLLLQYSTEFLFHTARLFYFADENNEKLFSAWAAVFGVTRLFILTLAVLAIGFGLARMENQAFDPEKGNFNTLFCRLCVLLLVCAAQAWLMWRFIHSQLRHWREYWNEQSAKRRVPATPRLPARLIKRESGYHENGVVKAENGTSPRTKKLKSP

SEQ ID NO: 839107 - protein, 400 aa, Homo sapiens
TLCSLASGRTLLCRRRQTGIAGAAATAVCAPTSAATMGILEKISEIEKEIARTQKNKATEYHLGLLKAKLAKYRAQLLEPSKSASSKGEGFDVMKSGDARVALIGFPSVGKSTFLSLMTSTASEAASYEFTTLTCIPGVIEYKGANIQLLDLPGIIEGAAQGKGRGRQVIAVARTADVIIMMLDATKGEVQRSLLEKELESVGIRLNKHKPNIYFKPKKGGGISFNSTVTLTQCSEKLVQLILHEYKIFNAEVLFREDCSPDEFIDVIVGNRVYMPCLYVYNKIDQISMEEVDRLARKPNSVVISCGMKLNLDYLLEMLWEYLALTCIYTKKRGQRPDFTDAIILRKGASVEHVCHRIHRSLASQFKYALVWGTSTKYSPQRVGLTHTMEHEDVIQIVKK

SEQ ID NO: 839108 - protein, 306 aa, Homo sapiens
TLCSLASGRTLLCRRRQTGIAGAAATAVCAPTSAATMGILEKISEIEKEIARTQKNKATEYHLGLLKAKLAKYRAQLLEPSKSASSKGEGFDVMKSGDARVALIGFPSVGKSTFLSLMTSTASEAASYEFTTLTCIPGVIEYKGANIQLLDLPGIIEGAAQGKGRGRQVIAVARTADVIIMMLDATKGEVQRSAGWGMGQAHMSGEGQCVPELVLGGLWVFGSLTRESSGRTCHRLNPTPPSLWRLLLKACVQPAQRYLGTGGRGAWPGPASCSEAQVPHHCPEPARSPAPGTEALFIHILAEGYT

SEQ ID NO: 839109 - protein, 120 aa, Homo sapiens
EVIRSNSEKWRPQPLNSQGPLPDWPPPSLQLRHEAEPGLSAGDALGVLGPDLHLHQEERTEARLHRRHHSPERGLSGARVPPHPPVTRQPVQVRPGVDRALHDGNQWLVASKAQLTPSTA

SEQ ID NO: 839110 - protein, 126 aa, Homo sapiens
MMLDATKGEVQRSAGWGMGQAHMSGEGQCVPELVLGGLWVFGSLTRESSGRTCHRLNPTPPSLWRLLLKACVQPAQRYLGTGGRGAWPGPASCSEAQVPHHCPEPARSPAPGTEALFIHILAEGYT

SEQ ID NO: 839111 - protein, 370 aa, Homo sapiens
TLCSLASGRTLLCRRRQTGIAGAAATAVCAPTSAATMGILEKISEIEKEIARTQKNKATEYHLGLLKAKLAKYRAQLLEPSKSASSKGEGFDVMKSGDARVALIGFPSVGKSTFLSLMTSTASEAASYEFTTLTCIPGVIEYKGANIQLLDLLDATKGEVQRSLLEKELESVGIRLNKHKPNIYFKPKKGGGISFNSTVTLTQCSEKLVQLILHEYKIFNAEVLFREDCSPDEFIDVIVGNRVYMPCLYVYNKIDQISMEEVDRLARKPNSVVISCGMKLNLDYLLEMLWEYLALTCIYTKKRGQRPDFTDAIILRKGASVEHVCHRIHRSLASQFKYALVWGTSTKYSPQRVGLTHTMEHEDVIQIVKK

SEQ ID NO: 839112 - protein, 400 aa, Homo sapiens; identical to SEQ ID NO: 839107

SEQ ID NO: 839113 - protein, 197 aa, Homo sapiens
TLCSLASGRTLLCRRRQTGIAGAAATAVCAPTSAATMGILEKISEIEKEIARTQKNKATEYHLGLLKAKLAKYRAQLLEPSKSASSKGEGFDVMKSGDARVALIGFPSVGKLRHEAEPGLSAGDALGVLGPDLHLHQEERTEARLHRRHHSPERGLSGARVPPHPPVTRQPVQVRPGVGHQHQVQSAAGGPDPHHGA

SEQ ID NO: 839114 - protein, 125 aa, Homo sapiens
EVIRSNSEKWRPQPLNSQGPLPDWPPPSFSCGMKLNLDYLLEMLWEYLALTCIYTKKRGQRPDFTDAIILRKGASVEHVCHRIHRSLASQFKYALVWGTSTKYSPQRVGLTHTMEHEDVIQIVKK

SEQ ID NO: 839115 - protein, 37 aa, Homo sapiens
MISFSPSSTFLSLMTSTASEAASYEFTTLTCIPGVIE

SEQ ID NO: 839116 - protein, 73 aa, Homo sapiens
FSPSCPAERPDFTDAIILRKGASVEHVCHRIHRSLASQFKYALVWGTSTKYSPQRVGLTHTMEHEDVIQIVKK

SEQ ID NO: 839117 - protein, 206 aa, Homo sapiens
TLCSLASGRTLLCRRRQTGIAGAAATAVCAPTSAATMGILEKISEIEKEIARTQKNKATEYHLGLLKAKLAKYRAQLLEPSKSASSKGEGFDVMKSGDARVALIGFPSVGKSTFLSLMTSTASEAASYEFTTLTCIPGVIEYKGANIQLLDLPGIIEGAAQGKGRGRQVIAVARTADVIIMMLDATKGEVQRTRSLIFFVDIRLIT

SEQ ID NO: 839118 - protein, 293 aa, Homo sapiens
MILTNIVRRCDTMEGPWKYARWRQSIRIPWGPDAVRTVDGNDATRRVNEDSAVTVGLIGWLAAAPGLASVIIDARIATKGTRCRRSLLEKELESVGIRLNKHKPNIYFKPKKGGGISFNSTVTLTQCSEKLVQLILHEYKIFNAEVLFREDCSPDEFIDVIVGNRVYMPCLYVYNKIDQISMEEVDRLARKPNSVVISCGMKLNLDYLLEMLWEYLALTCIYTKKRGQRPDFTDAIILRKGASVEHVCHRIHRSLASQFKYALVWGTSTKYSPQRVGLTHTMEHEDVIQIVKK

SEQ ID NO: 839119 - protein, 451 aa, Homo sapiens
MPKNKKRNTPHRGSSAGGGGSGAAAATAATAGGQHRNVQPFSDEDASIETMSHCSGYSDPSSFAEDGPEVLDEEGTQEDLEYKLKGLIDLTLDKSAKTRQAALEGIKNALASKMLYEFILERRMTLTDSIERCLKKGKSDEQRAAAALASVLCIQLGPGIESEEILKTLGPILKKIICDGSASMQARQTCATCFGVCCFIATDDITELYSTLECLENIFTKSYLKEKDTTVICSTPNTVLHISSLLAWTLLLTICPINEVKKKLEMHFHKLPSLLSCDDVNMRIAAGESLALLFELARGIESDFFYEDMESLTQMLRALATDGNKHRAKVDKRKQRSVFRDVLRAVEERDFPTETIKFGPERMYIDCWVKKHTYDTFKEVLGSGMQYHLQSNEFLRNVFELGPPVMLDAATLKTMKISRFERHLYNSAAFKARTKARSKCRDKRADVGEFF

SEQ ID NO: 839120 - protein, 451 aa, Homo sapiens; identical to SEQ ID NO: 839119

SEQ ID NO: 839121 - protein, 451 aa, Homo sapiens; identical to SEQ ID NO: 839119

SEQ ID NO: 839122 - protein, 168 aa, Homo sapiens [sequence omitted]

SEQ ID NO: 839123 - protein, 197 aa, Homo sapiens
MPKNKKRNTPHRGSSAGGGGSGAAAATAATAGGQHRNVQPFSDEDASIETMSHCSGYSDPSSFAEDGPEVLDEEGTQEDLEYKLKGLIDLTLDKSAKTRQAALEGIKNALASKMLYEFILERRMTLTDSIERCLKKGKSDEQRAAAALASVLCIQLGPGIESEEILKTLGPILKKIICDGSASMQARQTVSIRYLHL

SEQ ID NO: 839124 - protein, 118 aa, Homo sapiens
FIFYYSHIIKPNDLMGTISNVTIKFGPERMYIDCWVKKHTYDTFKEVLGSGMQYHLQSNEFLRNVFELGPPVMLDAATLKTMKISRFERHLYNSAAFKARTKARSKCRDKRADVGEFF

SEQ ID NO: 839125 - protein, 451 aa, Homo sapiens; identical to SEQ ID NO: 839119

SEQ ID NO: 839126 - protein, 116 aa, Homo sapiens
PKNVTLSLPPLQERDFPTETIKFGPERMYIDCWVKKHTYDTFKEVLGSGMQYHLQSNEFLRNVFELGPPVMLDAATLKTMKISRFERHLYNSAAFKARTKARSKCRDKRADVGEFF

SEQ ID NO: 839127 - protein, 115 aa, Homo sapiens
FKCHLSFARRRLRQYFHSTIKFGPERMYIDCWVKKHTYDTFKEVLGSGMQYHLQSNEFLRNVFELGPPVMLDAATLKTMKISRFERHLYNSAAFKARTKARSKCRDKRADVGEFF

SEQ ID NO: 839128 - protein, 798 aa, Homo sapiens
MAASLPGPGSRLFRTYGAADGRRQRRPGREAAQWFPPQDRRRFFNSSGSSDASIGDPSQSDDPDDPDDPDFPGSPVRRRRRCPGGRVPKDRPSLTVTPKRWKLRARPSLTVTPRRLGLRARPPQKCSTPCGPLRLPPFPSRDSGRLSPDLSVCGQPRDGDELGISASLFSSLASPCPGSPTPRDSVISIGTSACLVAASAVPSDLHLPEVSLDRASLPCSQEEATGGAKDTRMVHQTRASLRSVLFGLMNSGTPEDSEFRADGKNMRESCCKRKLVVGNGPEGPGLSSTGKRRATGQDSCQERGLQEAVRREHQEASVPKGRIVPRGTDRLERTRSSRKSKHQEATETSLLHSHRFKKGQKLGKDSFPTQDLTPLQNACFWTKTRASFSFHKKKIVTDVSEVCSIYTTATSLSGSLLSECSNRPVMNRTSGAPSSWHSSSMYLLSPLNTLSISNKKASDAEKVYGECSQKGPVPFSHCLPTEKLQRCEKIGEGVFGEVFQTIADHTPVAIKIIAIEGPDLVNGSHQKTFEEILPEIIISKELSLLSGEVCNRTEGFIGLNSVHCVQGSYPPLLLKAWDHYNSTKGSANDRPDFFKDDQLFIVLEFEFGGIDLEQMRTKLSSLATAKSILHQLTASLAVAEASLRFEHRDLHWGNVLLKKTSLKKLHYTLNGKSSTIPSCGLQVSIIDYTLSRLERDGIVVFCDVSMDEDLFTGDGDYQFDIYRLMKKENNNRWGEYHPYSNVLWLHYLTDKMLKQMTFKTKCNTPAMKQIKRKIQEFHRTMLNFSSATDLLCQHSLFK

SEQ ID NO: 839129 - protein, 798 aa, Homo sapiens; identical to SEQ ID NO: 839128

SEQ ID NO: 839130 - protein, 79 aa, Homo sapiens
CHAGLEKSGYPGTPRSCKNKNLPSSPLRLPIGQTPSELLISERGQLWLFLLPPPDGPSSKQPPTGPPGQKWQPLPGDLS

SEQ ID NO: 839131 - protein, 263 aa, Homo sapiens
MSQQRPARRVTQSPPGPDGGDGSPSVPRPHQRGGPAEALKVKRPRFDVSLVYLTRKFMDLVRSAPGGILDLNKVATKLGVRKRRVYDITNVLDGIDLVEKKSKNHIRWIGSDLSNFGAVPQQKKLQEELSDLSAMEDALDELIKDCAQQLFELTDDKENERLAYVTYQDIHSIQAFHEQIVIAVKAPAETRLDVPAPREDSITVHIRSTNGPIDVYLCEVEQGQTSNKRSEGVGTSSSESTHPEGPEEEENPQQSEELLEVSN

SEQ ID NO: 839132 - protein, 263 aa, Homo sapiens; identical to SEQ ID NO: 839131

SEQ ID NO: 839133 - protein, 206 aa, Homo sapiens
MDLVRSAPGGILDLNKVATKLGVRKRRVYDITNVLDGIDLVEKKSKNHIRWIGSDLSNFGAVPQQKKLQEELSDLSAMEDALDELIKDCAQQLFELTDDKENERLAYVTYQDIHSIQAFHEQIVIAVKAPAETRLDVPAPREDSITVHIRSTNGPIDVYLCEVEQGQTSNKRSEGVGTSSSESTHPEGPEEEENPQQSEELLEVSN

SEQ ID NO: 839134 - protein, 75 aa, Homo sapiens
LCAGAHPTASSRNSREQRWDVTRFLQDDNGASKQATSPGAAFVARNRVPPAVQGRATLQPSGAPMGRGASRAHAD

SEQ ID NO: 839135 - protein, 1164 aa, Homo sapiens
KRRGRQPISTTQPLTAAPYISWKEELHRSREVRCMLQCPSVEVSFLPLIVNTVALPDELSYICTHGEDWDVAYIIHLYPSLTLRNLLPYSLRYLLEGTAETHELAEGSTADVLHSRISGEIMELVLVKYQGKNWNGHFRIRDTLPEFFPVCFSSDSTEVTTVDLSVHVRRIGSRMVLSVFSPYWLINKTTRVLQYRSEDIHVKHPADFRDIILFSFKKKNIFTKNKVQLKISTSAWSSSFSLDTVGSYGCVKCPANNMEYLVGVSIKMSSFNLSRIVTLTPFCTIANKSSLELEVGEIASDGSMPTNKWNYIASSECLPFWPENLSGKLCVRVVGCEGSSKPFFYNRQDNGTLLSLEDLNGGILVDVNTAEHSTVITFSDYHEGSAPALIMNHTPWDILTYKQSGSPEEMVLLPRQARLFAWADPTGTRKLTWTYAANVGEHDLLKDGCGQFPYDANIQIHWVSFLDGRQRVLLFTDDVALVSKALQAEEMEQADYEITLSLHSLGLSLVNNESKQEVSYIGITSSGVVWEVKPKQKWKPFSQKQIILLEQSYQKHQISRDHGWIKLDNNFEVNFDKDPMEMRLPIRSPIKRDFLSGIQIEFKQSSHQRSLRARLYWLQVDNQLPGAMFPVVFHPVAPPKSIALDSEPKPFIDVSVITRFNEYSKVLQFKYFMVLIQEMALKIDQGFLGAIIALFTPTTDPEAERRRTKLIQQDIDALNAELMETSMTDMSILSFFEHFHISPVKLHLSLSLGSGGEESDKEKQEMFAVHSVNLLLKSIGATLTDVDDLIFKLAYYEIRYQFYKRDQLIWSVVRHYSEQFLKQMYVLVLGLDVLGNPFGLIRGLSEGVEALFYEPFQGAVQGPEEFAEGLVIGVRSLFGHTVGGAAGVVSRITGSVGKGLAAITMDKEYQQKRREELSRQPRDFGDSLARGGKGFLRGVVGGVTGIITKPVEGAKKEGAAGFFKGIGKGLVGAVARPTGGIVDMASSTFQGIQRAAESTEEVSSLRPPRLIHEDGIIRPYDRQESEGSDLLENHIKKLEGETYRYHCAIPGSKKTILMVTNRRVLCIKEVEILGLMCVDWQCPFEDFVFPPSVSENVLKISVKEQGLFHKKDSANQGCVRKVYLKDTATAERACNAIEDAQSTRQQQKLMKQSSVRLLRPQLPS

SEQ ID NO: 839136 - protein, 203 aa, Homo sapiens
DVLTTEDPQCPQPLEGAWPVTLGDAQALKPLKLAAESTEEVSSLRPPRLIHEDGIIRPYDRQESEGSDLLENHIKKLEGETYRYHCAIPGSKKTILMVTNRRVLCIKEVEILGLMCVDWQCPFEDFVFPPSVSENVLKISVKEQGLFHKKDSANQGCVRKVYLKDTATAERACNAIEDAQSTRQQQKLMKQSSVRLLRPQLPS

SEQ ID NO: 839137 - protein, 1164 aa, Homo sapiens; identical to SEQ ID NO: 839135

SEQ ID NO: 839138 - protein, 1164 aa, Homo sapiens; identical to SEQ ID NO: 839135

SEQ ID NO: 839139 - protein, 1039 aa, Homo sapiens
KRRGRQPISTTQPLTAAPYISWKEELHRSREVRCMLQCPSVEVSFLPLIVNTVALPDELSYICTHGEDWDVAYIIHLYPSLTLRNLLPYSLRYLLEGTAETHELAEGSTADVLHSRISGEIMELVLVKYQGKNWNGHFRIRDTLPEFFPVCFSSDSTEVTTVDLSVHVRRIGSRMVLSVFSPYWLINKTTRVLQYRSEDIHVKHPADFRDIILFSFKKKNIFTKNKVQLKISTSAWSSSFSLDTVGSYGCVKCPANNMEYLVGVSIKMSSFNLSRIVTLTPFCTIANKSSLELEVGEIASDGSMPTNKWNYIASSECLPFWPENLSGKLCVRVVGCEGSSKPFFYNRQDNGTLLSLEDLNGGILVDVNTAEHSTVITFSDYHEGSAPALIMNHTPWDILTYKQSGSPEEMVLLPRQARLFAWADPTGTRKLTWTYAANVGEHDLLKDGCGQFPYDANIQIHWVSFLDGRQRVLLFTDDVALVSKALQAEEMEQADYEITLSLHSLGLSLVNNESKQEVSYIGITSSGVVWEVKPKQKWKPFSQKQIILLEQSYQKHQISRDHGWIKLDNNFEVNFDKDPMEMRLPIRSPIKRDFLSGIQIEFKQSSHQRSLRARLYWLQVDNQLPGAMFPVVFHPVAPPKSIALDSEPKPFIDVSVITRFNEYSKVLQFKYFMVLIQEMALKIDQGFLGAIIALFTPTTDPEAERRRTKLIQQDIDALNAELMETSMTDMSILSFFEHFHISPVKLHLSLSLGSGGEESDKEKQEMFAVHSVNLLLKSIGATLTDVDDLIFKLAYYEIRYQFYKRDQLIWSVVRHYSEQFLKQMYVLVLGLDVLGNPFGLIRGLSEGVEALFYEPFQGAVQGPEEFAEGLVIGVRSLFGHTVGGAAGVVSRITGSVGKGLAAITMDKEYQQKRREELSRQPRDFGDSLARGGKGFLRGVVGGVTGIITKPVEGAKKEGAAGFFKGIGKGLVGAVARPTGGIVDMASSTFQGIQRAAESTEEVSSLRPPRLIHEDGIIRPYDRQESEGSDLLEQELEIQE

SEQ ID NO: 839140 - protein, 97 aa, Homo sapiens
QIHWVSFLDGRQRVLLFTDDVALVSKALQAEEMEQADYEITLSLHSLGLSLVNNESKQEVSYIGITRYARRKIRHPKPLKGIKFIIADLKKVKRYLV

SEQ ID NO: 839141 - protein, 475 aa, Homo sapiens
KRRGRQPISTTQPLTAAPYISWKEELHRSREVRCMLQCPSVEVSFLPLIVNTVALPDELSYICTHGEDWDVAYIIHLYPSLTLRNLLPYSLRYLLEGTAETHELAEGSTADVLHSRISGEIMELVLVKYQGKNWNGHFRIRDTLPEFFPVCFSSDSTEVTTVDLSVHVRRIGSRMVLSVFSPYWLINKTTRVLQYRSEDIHVKHPADFRDIILFSFKKKNIFTKNKVQLKISTSAWSSSFSLDTVGSYGCVKCPANNMEYLVGVSIKMSSFNLSRIVTLTPFCTIANKSSLELEVGEIASDGSMPTNKWNYIASSECLPFWPENLSGKLCVRVVGCEGSSKPFFYNRQDNGTLLSLEDLNGGILVDVNTAEHSTVITFSDYHEGSAPALIMNHTPWDILTYKQSGSPEEMVLLPRQARLFAWADPTGTRKLTWTYAANVGEHDLLKVSFDVNECYMSYLTVKEVEKLSSLTPCPN

SEQ ID NO: 839142 - protein, 1164 aa, Homo sapiens; identical to SEQ ID NO: 839135

SEQ ID NO: 839143 - protein, 326 aa, Homo sapiens
KRRGRQPISTTQPLTAAPYISWKEELHRSREVRCMLQCPSVEVSFLPLIVNTVALPDELSYICTHGEDWDVAYIIHLYPSLTLRNLLPYSLRYLLEGTAETHELAEGSTADVLHSRISGEIMELVLVKYQGKNWNGHFRIRDTLPEFFPVCFSSDSTEVTTVDLSVHVRRIGSRMVLSVFSPYWLINKTTRVLQYRSEDIHVKHPADFRDIILFSFKKKNIFTKNKVQLKISTSAWSSSFSLDTVGSYGCVKCPANNMEYLVGVSIKMSSFNLSRIVTLTPFCTIANKSSLELEVGEIASDGSMPTNKWNYIASSEVAFFFVTTDS

SEQ ID NO: 839144 - protein, 819 aa, Homo sapiens
GGGAGGAAVPSQARAGRVPIACCAPGRAAPLGLLAMDADDSRAPKGSLRKFLEHLSGAGKAIGVLTSGGDAQGMNAAVRAVVRMGIYVGAKVYFIYEGYQGMVDGGSNIAEADWESVSSILQVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGWTGQGGSILGTKRVLPGKYLEEIATQMRTHSINALLIIGGFEAYLGLLELSAAREKHEEFCVPMVMVPATVSNNVPGSDFSIGADTALNTITDTCDRIKQSASGTKRRVFIIETMGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 839145 - protein, 220 aa, Homo sapiens
MGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTIGNVAVINVGVRLSNQAYRYLDLEGGP

SEQ ID NO: 839146 - protein, 202 aa, Homo sapiens
MGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGCPAGVHLGKRGPGRLGGIVKVCADTRAGTGERPGPCCTEKSSPVSMATVSGNAKGKTK

SEQ ID NO: 839147 - protein, 239 aa, Homo sapiens
MTQRKKFCPTMDPIQPTRSSKVHLGYQGMVDGGSNIAEADWESVSSILQVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSTEDLRSGGDGTNTVGYPGPGEGRGRGGAGCLPRIFTQKEGGKTTGVNPEEPARKTGNKKGARARTNSHAE

SEQ ID NO: 839148 - protein, 130 aa, Homo sapiens
VDYYYYIRGRVDVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGRDCFSLSTRP

SEQ ID NO: 839149 - protein, 165 aa, Homo sapiens
MKTTIQRGLVLRNESCSENYTTDFIYQLYSEEGKGVFDCRKNVLGHMQQVGYVTTHLAPVIPEQVNLAGEGFLNAQLEKYVVQVIVPRDSKLWQVELTYLSELQRVSPPLQGLWEQHGFHFLHLVLIREDEECPGVACVHSAPPRCRTAPRPGRRYNQLRYSGSS

SEQ ID NO: 839150 - protein, 819 aa, Homo sapiens; identical to SEQ ID NO: 839144

SEQ ID NO: 839151 - protein, 819 aa, Homo sapiens; identical to SEQ ID NO: 839144

SEQ ID NO: 839152 - protein, 816 aa, Homo sapiens
GGGAGGAAVPSQARAGRVPIACCAPGRAAPLGLLAMDADDSRAPKGSLRKFLEHLSGAGKAIGVLTSGGDAQGMNAAVRAVVRMGIYVGAKVYFIYEGYQGMVDGGSNIAEADWESVSSILQVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGWTGQGGSILGTKRVLPGKYLEEIATQMRTHSINALLIIGGFEAYKSACDMAEARGRHQELCIPLCVVPATISNNVPGTEISLGSDTGLKLTCDRIKQSASGTKRRVFIIETMGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 839153 - protein, 746 aa, Homo sapiens
MNAAVRAVVRMGIYVGAKVYFIYEGYQGMVDGGSNIAEADWESVSSILQVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGWTGQGGSILGTKRVLPGKYLEEIATQMRTHSINALLIIGGFEAYLGLLELSAAREKHEEFCVPMVMVPATVSNNVPGSDFSIGADTALNTITDTCDRIKQSASGTKRRVFIIETMGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 839154 - protein, 726 aa, Homo sapiens
MGWDGYQGMVDGGSNIAEADWESVSSILQVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGWTGQGGSILGTKRVLPGKYLEEIATQMRTHSINALLIIGGFEAYLGLLELSAAREKHEEFCVPMVMVPATVSNNVPGSDFSIGADTALNTITDTCDRIKQSASGTKRRVFIIETMGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 839155 - protein, 819 aa, Homo sapiens; identical to SEQ ID NO: 839144

SEQ ID NO: 839156 - protein, 785 aa, Homo sapiens
GGGAGGAAVPSQARAGRVPIACCAPGRAAPLGLLAMDADDSRAPKGSLRKFLEHLSGAGKAIGVLTSGGDAQGMNAAVRAVVRMGIYVGAKVYFIYEGYQGMVDGGSNIAEADWESVSSILQVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGWTGQGGSILGTKRVLPGKYLEEIATQMRTHSINALLIIGGFEAYLGLLELSAAREKHEEFCVPMVMVPATVSNNVPGSDFSIGADTALNTITDTCDRIKQSASGTKRRVFIIETMGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFETVSMQPPR

SEQ ID NO: 839157 - protein, 777 aa, Homo sapiens
GGGAGGAAVPSQARAGRVPIACCAPGRAAPLGLLAMDADDSRAPKGSLRKFLEHLSGAGKAIGVLTSGGDAQGMNAAVRAVVRMGIYVGAKVYFIYEGYQGMVDGGSNIAEADWESVSSILQVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGWTGQGGSILGTKRVLPGKYLEEIATQMRTHSINALLIIGGFEAYLGLLELSAAREKHEEFCVPMVMVPATVSNNVPGSDFSIGADTALNTITDTCDRIKQSASGTKRRVFIIETMGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFE

SEQ ID NO: 839158 - protein, 581 aa, Homo sapiens
MLPWKVLKGPASRFIPGVRYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGWTGQGGSILGTKRVLPGKYLEEIATQMRTHSINALLIIGGFEAYLGLLELSAAREKHEEFCVPMVMVPATVSNNVPGSDFSIGADTALNTITDTCDRIKQSASGTKRRVFIIETMGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 839159 - protein, 549 aa, Homo sapiens
MMYSRHPVLFRHGAELMCIYTARNRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGWTGQGGSILGTKRVLPGKYLEEIATQMRTHSINALLIIGGFEAYLGLLELSAAREKHEEFCVPMVMVPATVSNNVPGSDFSIGADTALNTITDTCDRIKQSASGTKRRVFIIETMGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 839160 - protein, 530 aa, Homo sapiens
LVRGRVLMAEGLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGWTGQGGSILGTKRVLPGKYLEEIATQMRTHSINALLIIGGFEAYLGLLELSAAREKHEEFCVPMVMVPATVSNNVPGSDFSIGADTALNTITDTCDRIKQSASGTKRRVFIIETMGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 839161 - protein, 554 aa, Homo sapiens
GGGAGGAAVPSQARAGRVPIACCAPGRAAPLGLLAMDADDSRAPKGSLRKFLEHLSGAGKAIGVLTSGGDAQGMNAAVRAVVRMGIYVGAKVYFIYEGYQGMVDGGSNIAEADWESVSSILQVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGWTGQGGSILGTKRVLPGKYLEEIATQMRTHSINALLIIGGFEAATVDCLFL

SEQ ID NO: 839162 - protein, 537 aa, Homo sapiens
GGGAGGAAVPSQARAGRVPIACCAPGRAAPLGLLAMDADDSRAPKGSLRKFLEHLSGAGKAIGVLTSGGDAQGMNAAVRAVVRMGIYVGAKVYFIYEGYQGMVDGGSNIAEADWESVSSILQVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGWTGQGGSILGTKRVPPGEYIGRDRPFDRVPARFV

SEQ ID NO: 839163 - protein, 317 aa, Homo sapiens
MGPGRRERQMARPPKRDIEVTSRWLPWWGCGGPRSHPLRGHIPAAAHPSPLRDAGTACLGAVGGPCCTHSWGSSGMVGAPRAWAGVTDRFSVDQTCDRIKQSASGTKRRVFIIETMGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 839164 - protein, 225 aa, Homo sapiens
MLTCDRIKQSASGTKRRVFIIETMGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 839165 - protein, 113 aa, Homo sapiens
MQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 839166 - protein, 269 aa, Homo sapiens
GGGAGGAAVPSQARAGRVPIACCAPGRAAPLGLLAMDADDSRAPKGSLRKFLEHLSGAGKAIGVLTSGGDAQGMNAAVRAVVRMGIYVGAKVYFIYEGYQGMVDGGSNIAEADWESVSSILQVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGPAAWEWRQSSPC

SEQ ID NO: 839167 - protein, 336 aa, Homo sapiens
MNAAVRAVVRMGIYVGAKVYFIYEGYQGMVDGGSNIAEADWESVSSILQVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGYLALVSALACGADWVFLPESPPEEGWEEQMCVKLSENRARKKRLNIIIVAEGAIDTQNKPITSEKIKELSVLQVGYDTRVTISGRAMGALCSQVGRAGWGGLLLRRRTRGLSIGHGARWGGVRAGGGEGPEGARTGGGPQLGRGGVDWGGRG

SEQ ID NO: 839168 - protein, 135 aa, Homo sapiens
GGGAGGAAVPSQARAGRVPIACCAPGRAAPLGLLAMDADDSRAPKGSLRKFLEHLSGAGKAIGVLTSGGDAQGMNAAVRAVVRMGIYVGAKVYFIYEGYQGMVDGGSNIAEADWESVSSILQVVGTGLRPQGSLS

SEQ ID NO: 839169 - protein, 111 aa, Homo sapiens
WSGSLHSSGRDFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 839170 - protein, 87 aa, Homo sapiens
FLIPERISQWNPRAATQVLARLCGFVCGLPRAETAASARRAEMWRGAECGPPVIQLHAPFPACTWAPPLHDEGGHLVWSLQPCAPSH

SEQ ID NO: 839171 - protein, 81 aa, Homo sapiens
GGGAGGAAVPSQARAGRVPIACCAPGRAAPLGLLAMDADDSRAPKGSLRKFLEHLSGAGKAIGVLTSGGDAQGLGSQRKKT

SEQ ID NO: 839172 - protein, 103 aa, Homo sapiens
TCFRGRDPAVAVDSSCRLCPIEKVSGKEPSTGPGSVSVSWHRQAEGVQRATGERRGGSSPLPRRSLEGYCIAFALVENGPFLKPRSLQASWLTRLSKPLFSAF

SEQ ID NO: 839173 - protein, 819 aa, Homo sapiens; identical to SEQ ID NO: 839144

SEQ ID NO: 839174 - protein, 819 aa, Homo sapiens; identical to SEQ ID NO: 839144

SEQ ID NO: 839175 - protein, 768 aa, Homo sapiens
GGGAGGAAVPSQARAGRVPIACCAPGRAAPLGLLAMDADDSRAPKGSLRKFLEHLSGAGKAIGVLTSGGDAQGMNAAVRAVVRMGIYVGAKVYFIYEGYQGMVDGGSNIAEADWESVSSILQVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGWTGQGGSILGTKRVLPGKYLEEIATQMRTHSINALLIIGGFETCDRIKQSASGTKRRVFIIETMGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 839176 - protein, 746 aa, Homo sapiens; identical to SEQ ID NO: 839153

SEQ ID NO: 839177 - protein, 746 aa, Homo sapiens; identical to SEQ ID NO: 839153

SEQ ID NO: 839178 - protein, 730 aa, Homo sapiens
SARYEAGFGYQGMVDGGSNIAEADWESVSSILQVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGWTGQGGSILGTKRVLPGKYLEEIATQMRTHSINALLIIGGFEAYLGLLELSAAREKHEEFCVPMVMVPATVSNNVPGSDFSIGADTALNTITDTCDRIKQSASGTKRRVFIIETMGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 839179 - protein, 804 aa, Homo sapiens
GGGAGGAAVPSQARAGRVPIACCAPGRAAPLGLLAMDADDSRAPKGSLRKFLEHLSGAGKAIGVLTSGGDAQGMNAAVRAVVRMGIYVGAKVYFIYEGYQGMVDGGSNIAEADWESVSSILQVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQRYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGWTGQGGSILGTKRVLPGKYLEEIATQMRTHSINALLIIGGFEAYLGLLELSAAREKHEEFCVPMVMVPATVSNNVPGSDFSIGADTALNTITDTCDRIKQSASGTKRRVFIIETMGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 839180 - protein, 568 aa, Homo sapiens
MGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGWTGQGGSILGTKRVLPGKYLEEIATQMRTHSINALLIIGGFEAYLGLLELSAAREKHEEFCVPMVMVPATVSNNVPGSDFSIGADTALNTITDTCDRIKQSASGTKRRVFIIETMGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 839181 - protein, 608 aa, Homo sapiens
GGGAGGAAVPSQARAGRVPIACCAPGRAAPLGLLAMDADDSRAPKGSLRKFLEHLSGAGKAIGVLTSGGDAQGMNAAVRAVVRMGIYVGAKVYFIYEGYQGMVDGGSNIAEADWESVSSILQVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGWTGQGGSILGTKRVLPGKYLEEIATQMRTHSINALLIIGGFEAYLGLLELSAAREKHEEFCVPMVMVPATVSNNVPGSDFSIGADTALNTITDVSPCAPCQAGAG

SEQ ID NO: 839182 - protein, 595 aa, Homo sapiens
GGGAGGAAVPSQARAGRVPIACCAPGRAAPLGLLAMDADDSRAPKGSLRKFLEHLSGAGKAIGVLTSGGDAQGMNAAVRAVVRMGIYVGAKVYFIYEGYQGMVDGGSNIAEADWESVSSILQVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGWTGQGGSILGTKRVLPGKYLEEIATQMRTHSINALLIIGGFEAYKSACDMAEARGRHQELCIPLCVVPATISNNVPGTEISLGSDTGLNAEV

SEQ ID NO: 839183 - protein, 471 aa, Homo sapiens
GGGAGGAAVPSQARAGRVPIACCAPGRAAPLGLLAMDADDSRAPKGSLRKFLEHLSGAGKAIGVLTSGGDAQGMNAAVRAVVRMGIYVGAKVYFIYEGYQGMVDGGSNIAEADWESVSSILQVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTIGNVAVINVGVRLSNQAYRYLDLEGGP

SEQ ID NO: 839184 - protein, 175 aa, Homo sapiens
AAPDVRRSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 839185 - protein, 166 aa, Homo sapiens
VVFTAALISEHKASLVVVRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 839186 - protein, 93 aa, Homo sapiens
QVVVGRLYHLVDSADPTNPVFLARPLAVLARRRHLPPVTAGLTAVSSYLHRHRIPKEQWWLKLRPLMKILAKYKASYDVSDSGQLEHVQPWSV

SEQ ID NO: 839187 - protein, 276 aa, Homo sapiens
LKGARCRQGASLAGMAASALRGLPVAGGGESSESEDDGWEIGYLDRTSQKLKRLLPIEEKKEKFKKAMTIGDVSLVQELLDSGISVDSNFQYGWTPLMYAASVANAELVRVLLDRGANASFEKDKQSILITACSAHGSEEQILKCVELLLSRNADPNVACRRLMTPIMYAARDGHTQVVALLVAHGAEVNTQDENGYTALTWAARQGHKNIVLKLLELGANKMLQTKDGKMPSEIAKRNKHHEIFNLLSFTLNPLEGKLQQLTKEDTICNNIDNRF

SEQ ID NO: 839188 - protein, 162 aa, Homo sapiens
LKGARCRQGASLAGMAASALRGLPVAGGGESSESEDDGWEIGYLDRTSQKLKRLLPIEEKKEKFKKAMTIGDVSLVQELLDSGISVDSNFQYGWTPLMYAASVANAELVRVLLDRGANASFEKDKQSILITACSAHGSEEQILKCVELLLSRNADPNVACRL

SEQ ID NO: 839189 - protein, 162 aa, Homo sapiens; identical to SEQ ID NO: 839188

SEQ ID NO: 839190 - protein, 235 aa, Homo sapiens
LKGARCRQGASLAGMAASALRGLPVAGGGESSESEDDGWEIGYLDRTSQKLKRLLPIEEKKEKFKKAMTIGDVSLVQELLDSDKQSILITACSAHGSEEQILKCVELLLSRNADPNVACRRLMTPIMYAARDGHTQVVALLVAHGAEVNTQDENGYTALTWAARQGHKNIVLKLLELGANKMLQTKDGKMPSEIAKRNKHHEIFNLLSFTLNPLEGKLQQLTKEDTICNNIDNRF

SEQ ID NO: 839191 - protein, 467 aa, Homo sapiens
MALHPRRVRLKPWLVAQVDSGLYPGLIWLHRDSKRFQIPWKHATRHSPQQEEENTIFKAWAVETGKYQEGVDDPDPAKWKAQLRCALNKSREFNLMYDGTKEVPMNPVKIYQVCDIPQPQGSIINPGSTGSAPWDEKDNDVDEEDEEDELDQSQHHVPIQDTFPFLNINGSPMAPASVGNCSVGNCSPEAVWPKTEPLEMEVPQAPIQPFYSSPELWISSLPMTDLDIKFQYRGKEYGQTMTVSNPQGCRLFYGDLGPMPDQEELFGPVSLEQVKFPGPEHITNEKQKLFTSKLLDVMDRGLILEVSGHAIYAIRLCQCKVYWSGPCAPSLVAPNLIERQKKVKLFCLETFLSDLIAHQKGQIEKQPPFEIYLCFGEEWPDGKPLERKLILVQVIPVVARMIYEMFSGDFTRSFDSGSVRLQISTPDIKDNIVAQLKQLYRILQTQESWQPMQPTPSMQLPPALPPQ

SEQ ID NO: 839192 - protein, 467 aa, Homo sapiens; identical to SEQ ID NO: 839191

SEQ ID NO: 839193 - protein, 467 aa, Homo sapiens; identical to SEQ ID NO: 839191

SEQ ID NO: 839194 - protein, 295 aa, Homo sapiens
MAPASVGNCSVGNCSPEAVWPKTEPLEMEVPQAPIQPFYSSPELWISSLPMTDLDIKFQYRGKEYGQTMTVSNPQGCRLFYGDLGPMPDQEELFGPVSLEQVKFPGPEHITNEKQKLFTSKLLDVMDRGLILEVSGHAIYAIRLCQCKVYWSGPCAPSLVAPNLIERQKKVKLFCLETFLSDLIAHQKGQIEKQPPFEIYLCFGEEWPDGKPLERKLILVQVIPVVARMIYEMFSGDFTRSFDSGSVRLQISTPDIKDNIVAQLKQLYRILQTQESWQPMQPTPSMQLPPALPPQ

SEQ ID NO: 839195 - protein, 467 aa, Homo sapiens; identical to SEQ ID NO: 839191

SEQ ID NO: 839196 - protein, 389 aa, Homo sapiens
MALHPRRVRLKPWLVAQVDSGLYPGLIWLHRDSKRFQIPWKHATRHSPQQEEENTIFKAWAVETGKYQEGVDDPDPAKWKAQLRCALNKSREFNLMYDGTKEVPMNPVKIYQVCDIPQPQGSIINPGSTGSAPWDEKDNDVDEEDEEDELDQSQHHVPIQDTFPFLNINGSPMAPASVGNCSVGNCSPEAVWPKTEPLEMEVPQAPIQPFYSSPELWISSLPMTDLDIKFQYRGKEYGQTMTVSNPQGCRLFYGDLGPMPDQEELFGPVSLEQVKFPGPEHITNEKQKLFTSKLLDVMDRGLILEVSGHAIYAIRLCQCKVYWSGPCAPSLVAPNLIERQKKVKLFCLETFLSGKSFLRKLIVGITLWKYIPSTIPVFHLPAFLAWQRS

SEQ ID NO: 839197 - protein, 173 aa, Homo sapiens [sequence omitted]

SEQ ID NO: 839198 - protein, 467 aa, Homo sapiens; identical to SEQ ID NO: 839191

SEQ ID NO: 839199 - protein, 509 aa, Homo sapiens
SSAHLGWAGKGWCGTGRGTCSPYLGRARRPLAKTSRSVVATGDLRCGLGSEGRPLLVDRLSKESLSGQGKDKPTSKRFQIPWKHATRHSPQQEEENTIFKAWAVETGKYQEGVDDPDPAKWKAQLRCALNKSREFNLMYDGTKEVPMNPVKIYQVCDIPQPQGSIINPGSTGSAPWDEKDNDVDEEDEEDELDQSQHHVPIQDTFPFLNINGSPMAPASVGNCSVGNCSPEAVWPKTEPLEMEVPQAPIQPFYSSPELWISSLPMTDLDIKFQYRGKEYGQTMTVSNPQGCRLFYGDLGPMPDQEELFGPVSLEQVKFPGPEHITNEKQKLFTSKLLDVMDRGLILEVSGHAIYAIRLCQCKVYWSGPCAPSLVAPNLIERQKKVKLFCLETFLSDLIAHQKGQIEKQPPFEIYLCFGEEWPDGKPLERKLILVQVIPVVARMIYEMFSGDFTRSFDSGSVRLQISTPDIKDNIVAQLKQLYRILQTQESWQPMQPTPSMQLPPALPPQ

SEQ ID NO: 839200 - protein, 245 aa, Homo sapiens [sequence omitted]

SEQ ID NO: 839201 - protein, 410 aa, Homo sapiens
MALHPRRVRLKPWLVAQVDSGLYPGLIWLHRDSKRFQIPWKHATRHSPQQEEENTIFKAWAVETGKYQEGVDDPDPAKWKAQLRCALNKSREFNLMYDGTKEVPMNPVKIYQVCDIPQPQGSIINPGSTGSAPWDEKDNDVDEEDEEDELDQSQHHVPIQDTFPFLNINGSPMAPASVGNCSVGNCSPEAVWPKTEPLEMEVPQAPIQPFYSSPELWISSLPMTDLDIKFQYRGKEYGQTMTVSNPQGCRLFYGDLGPMPDQEELFGPVSLEQVKFPGPEHITNEKQKLFTSKLLDVMDRGLILEVSGHAIYAIRLCQCKVYWSGPCAPSLVAHGHGLPVLLPTVLKLDVQVSHWERADPQFWRAIEGLYRCLGYFHLQGFSFGPHCLRAAVAHTQFPHWLRHGVMQVPS

SEQ ID NO: 839202 - protein, 179 aa, Homo sapiens
WHPASAGRATGARLFPGCGRRSRCAARGALLGAPSAVGSAPGIGLGSRGAREGCAFPTAPLASSGTAATEISSRGNYADPFRGSSPRPSSPPPPLCWGAWAGPRRGGGSGSLGREAAGGRGAAGHRFSPPCDAVLSPATPSASRACASAPPRSARCFCRDAHANRRRPSPCSIPASAGR

SEQ ID NO: 839203 - protein, 441 aa, Homo sapiens
MLLPGRARQPPTPQPVQHPGLRRQVEPPGQLLRLFYCTVLVCSKEISALTDFSGYLTKLLQNHTTYACDGDYLNLQCPRHSTISVQSAFYGQDYQMCSSQKPASQREDSLTCVAATTFQKVLDECQNQRACHLLVNSRVFGPDLCPGSSKYLLVSFKCQPNELKNKTVCEDQELKLHCHESKFLNIYSATYGRRTQERDICSSKAERLPPFDCLSYSALQVLSRRCYGKQRCKIIVNNHHFGSPCLPGVKKYLTVTYACVPKNILTAIDPAIANLKPSLKQKDGEYGINFDPSGSKVLRKDGILVSNSLAAFAYIRAHPERAALLFVSSVCIGLALTLCALVIRESCAKDFRDLQLGREQLVPGSDKVEEDSEDEEEEEDPSESDFPGELSGFCRTSYPIYSSIEAAELAERIERREQIIQEIWMNSGLDTSLPRNMGQFY

SEQ ID NO: 839204 - protein, 346 aa, Homo sapiens
MCSSQKPASQREDSLTCVAATTFQKVLDECQNQRACHLLVNSRVFGPDLCPGSSKYLLVSFKCQPNELKNKTVCEDQELKLHCHESKFLNIYSATYGRRTQERDICSSKAERLPPFDCLSYSALQVLSRRCYGKQRCKIIVNNHHFGSPCLPGVKKYLTVTYACVPKNILTAIDPAIANLKPSLKQKDGEYGINFDPSGSKVLRKDGILVSNSLAAFAYIRAHPERAALLFVSSVCIGLALTLCALVIRESCAKDFRDLQLGREQLVPGSDKVEEDSEDEEEEEDPSESDFPGELSGFCRTSYPIYSSIEAAELAERIERREQIIQEIWMNSGLDTSLPRNMGQFY

SEQ ID NO: 839205 - protein, 423 aa, Homo sapiens
MLLPGRARQPPTPQPVQHPGLRRQVEPPGQLLRLFYCTVLVCSKEISALTDFSGYLTKLLQNHTTYACDGDYLNLQCPRHSTISVQSAFYGQDYQMCSSQKPASQREDSLTCVAATTFQKVLDECQNQRACHLLVNSRVFGPDLCPGSSKYLLVSFKCQPNELKNKTVCEDQELKLHCHESKFLNIYSATYGRRTQERDICSSKAERLPPFDCLSYSALQVLSRRCYGKQRCKIIVNNHHFGSPCLPGVKKYLTVTYACVPKNILTAIDPAIANLGSKVLRKDGILVSNSLAAFAYIRAHPERAALLFVSSVCIGLALTLCALVIRESCAKDFRDLQLGREQLVPGSDKVEEDSEDEEEEEDPSESDFPGELSGFCRTSYPIYSSIEAAELAERIERREQIIQEIWMNSGLDTSLPRNMGQFY

SEQ ID NO: 839206 - protein, 179 aa, Homo sapiens; identical to SEQ ID NO: 839202

SEQ ID NO: 839207 - protein, 228 aa, Homo sapiens [sequence omitted]

SEQ ID NO: 839208 - protein, 179 aa, Homo sapiens; identical to SEQ ID NO: 839202

SEQ ID NO: 839209 - protein, 441 aa, Homo sapiens; identical to SEQ ID NO: 839203

SEQ ID NO: 839210 - protein, 414 aa, Homo sapiens
MLLPGRARQPPTPQPVQHPGLRRQVEPPGQLLRLFYCTVLVCSKEISALTDFSGYLTKLLQNHTTYACDGDYLNLQCPRHSTISVQSAFYGQDYQMCSSQKPASQREDSLTCVAATTFQKVLDECQNQRACHLLVNSRVFGPDLCPGSSKYLLVSFKCQPNELKNKTVCEDQELKLHCHESKFLNIYSATYGRRTQERDICSSKAERLPPFDCLSYSALQVLSRRCYGKQRCKIIVNNHHFGSPCLPGVKKYLTVTYACGINFDPSGSKVLRKDGILVSNSLAAFAYIRAHPERAALLFVSSVCIGLALTLCALVIRESCAKDFRDLQLGREQLVPGSDKVEEDSEDEEEEEDPSESDFPGELSGFCRTSYPIYSSIEAAELAERIERREQIIQEIWMNSGLDTSLPRNMGQFY

SEQ ID NO: 839211 - protein, 103 aa, Homo sapiens
MEFLLATLWQPLLTLEPTRRELPCCSCPVSASAWPSHCAPWSSESPVPRTSATCSWGGSSWCQEVTRSRRTARMKKRRRTPLSLISQGNCRGSVGLHILYTVP

SEQ ID NO: 839212 - protein, 299 aa, Homo sapiens
MLLPGRARQPPTPQPVQHPGLRRQVEPPGQLLRLFYCTVLVCSKEISALTDFSGYLTKLLQNHTTYACDGDYLNLQCPRHSTISVQSAFYGQDYQMCSSQKPASQREDSLTCVAATTFQKVLDECQNQRACHLLVNSRVFGPDLCPGSSKYLLVSFKCQPNELKNKTVCEDQELKLHCHESKFLNIYSATYGRRTQERDICSSKAERLPPFDCLSYSALQVLSRRCYGKQRCKIIVNNHHFGSPCLPGVKKYLTVTYACVPKNILTAIDPAIANLKPSLKQKDGEYGNFYGLVPAFLFK

SEQ ID NO: 839213 - protein, 66 aa, Homo sapiens
KSLIAYSSISHIALVVTAILIQNPLRLHRRSHSHNRPRTYILITILPSKHYYNKHPHHYNLPRNNI

SEQ ID NO: 839214 - protein, 98 aa, Homo sapiens
THLHQPPNISINLAMDIPILLLIVPILIAMAFLMLTERKILGYIQLRKGPNVVGPYGLLQPFADAIKLFTKEPLKPATSTITLYITAPTLALTIALLL

SEQ ID NO: 839215 - protein, 98 aa, Homo sapiens; identical to SEQ ID NO: 839214

SEQ ID NO: 839216 - protein, 105 aa, Homo sapiens
VALRRSLYSRVLADICYSLNITSKPSFWLLLSGRFLLTLKYQLNSVLFSTTVMVLPGRVSVFFFLNSQAPVVLAGSLIYTNHPTIYKPSHGHPLMSGRSDYRLSL

SEQ ID NO: 839217 - protein, 98 aa, Homo sapiens; identical to SEQ ID NO: 839214

SEQ ID NO: 839218 - protein, 87 aa, Homo sapiens
MRHNYNKLHLPTTNRPKIAHCLLIQPIALAVRLTANITAGHLLMHLIGSATLAISTINLPSTLIIFTILILLTILEIAVALIQAYVF

SEQ ID NO: 839219 - protein, 98 aa, Homo sapiens; identical to SEQ ID NO: 839214

SEQ ID NO: 839220 - protein, 77 aa, Homo sapiens
LDLTFSKVKESELVSGFNIEYAAGPFALFFIAEYTNIIIINTLTTTIFLGTTYDALSPELYTTYFVTKTLLLTSLFL

SEQ ID NO: 839221 - protein, 189 aa, Homo sapiens
AQARGARGWQCACAASACGTPRCLGASARGKMAEQATKSVLFVCLGNICRSPIAEAVFRKLVTDQNISENWRVDSAATSGYEIGNPPDYRGQSCMKRHGIPMSHVARQITKEDFATFDYILCMDESNLRDLNRKSNQVKTCKAKIELLGSYDPQKQLIIEDPYYGNDSDFETVYQQCVRCCRAFLEKAH

SEQ ID NO: 839222 - protein, 189 aa, Homo sapiens
AQARGARGWQCACAASACGTPRCLGASARGKMAEQATKSVLFVCLGNICRSPIAEAVFRKLVTDQNISENWVIDSGAVSDWNVGRSPDPRAVSCLRNHGIHTAHKARQITKEDFATFDYILCMDESNLRDLNRKSNQVKTCKAKIELLGSYDPQKQLIIEDPYYGNDSDFETVYQQCVRCCRAFLEKAH

SEQ ID NO: 839223 - protein, 189 aa, Homo sapiens; identical to SEQ ID NO: 839221

SEQ ID NO: 839224 - protein, 101 aa, Homo sapiens
AQARGARGWQCACAASACGTPRCLGASARGKMAEQATKSVLFVCLGNICRSPIAEAVFRKLVTDQNISENWRVDSAATSGGSLTAVLFLTGTWAGPQTQEL

SEQ ID NO: 839225 - protein, 111 aa, Homo sapiens
AQARGARGWQCACAASACGTPRCLGASARGKMAEQATKSVLFVCLGNICRSPIAEAVFRKLVTDQNISENWRVDSAATSGYEIGNPPDYRGQSCMKRHGIPMSHVARQRFE

SEQ ID NO: 839226 - protein, 101 aa, Homo sapiens; identical to SEQ ID NO: 839224

SEQ ID NO: 839227 - protein, 189 aa, Homo sapiens; identical to SEQ ID NO: 839222

SEQ ID NO: 839228 - protein, 71 aa, Homo sapiens
EFPRRARKSVLFVCLGNICRSPIAEAVFRKLVTDQNISENWRVDSAATSGGSLTAVLFLTGTWAGPQTQEL

SEQ ID NO: 839229 - protein, 111 aa, Homo sapiens; identical to SEQ ID NO: 839225

SEQ ID NO: 839230 - protein, 189 aa, Homo sapiens; identical to SEQ ID NO: 839221

SEQ ID NO: 839231 - protein, 94 aa, Homo sapiens
AQARGARGWQCACAASACGTPRCLGASARGKMAEQATKSVLFVCLGNICRSPIAEAVFRKLVTDQNISENWRVDSAATSGYEIGNPPDCCGQPD

SEQ ID NO: 839232 - protein, 159 aa, Homo sapiens
EFPRRARKSVLFVCLGNICRSPIAEAVFRKLVTDQNISENWVIDSGAVSDWNVGRSPDPRAVSCLRNHGIHTAHKARQITKEDFATFDYILCMDESNLRDLNRKSNQVKTCKAKIELLGSYDPQKQLIIEDPYYGNDSDFETVYQQCVRCCRAFLEKAH

SEQ ID NO: 839233 - protein, 189 aa, Homo sapiens; identical to SEQ ID NO: 839221

SEQ ID NO: 839234 - protein, 189 aa, Homo sapiens; identical to SEQ ID NO: 839222

SEQ ID NO: 839235 - protein, 129 aa, Homo sapiens
AQARGARGWQCACAASACGTPRCLGASARGKMAEQATKSVLFVCLGNICRSPIAEAVFRKLVTDQNISENWRVDSAATSGYEIGNPPDYRGQSCMKRHGIPMSHVARQITKEDFATFDYILCMDESNLR

SEQ ID NO: 839236 - protein, 189 aa, Homo sapiens; identical to SEQ ID NO: 839221

SEQ ID NO: 839237 - protein, 148 aa, Homo sapiens
NSPARREAARPIAEAVFRKLVTDQNISENWRVDSAATSGYEIGNPPDYRGQSCMKRHGIPMSHVARQITKEDFATFDYILCMDESNLRDLNRKSNQVKTCKAKIELLGSYDPQKQLIIEDPYYGNDSDFETVYQQCVRCCRAFLEKAH

SEQ ID NO: 839238 - protein, 101 aa, Homo sapiens; identical to SEQ ID NO: 839224

SEQ ID NO: 839239 - protein, 174 aa, Homo sapiens
AQARGARGWQCACAASACGTPRCLGASARGKMAEQATKSVLFVCLGNICRSPIAEAVFRKLVTDQNISENWRVDSAATSGYEIGNPPDYRGQSCMKRHGIPMSHVARQITKEDFATFDYILCMDESNLRDLNRKSNQVKTCKAKIELLGSYDPQKQLIIEDPYYVSTVHVLGLI

SEQ ID NO: 839240 - protein, 171 aa, Homo sapiens
AQARGARGWQCACAASACGTPRCLGASARGKMAEQATKSVLFVCLGNICRSPIAEAVFRKLVTDQNISENWRVDSAATSGYEIGNPPDYRGQSCMKRHGIPMSHVARQITKEDFATFDYILCMDESNLRDLNRKSNQVKTCKAKIELLGSYDPQVYQQCVRCCRAFLEKAH

SEQ ID NO: 839241 - protein, 189 aa, Homo sapiens; identical to SEQ ID NO: 839221

SEQ ID NO: 839242 - protein, 174 aa, Homo sapiens; identical to SEQ ID NO: 839239

SEQ ID NO: 839243 - protein, 506 aa, Homo sapiens
VRGRWYSAEGSERGSPSSGGNPLSGVASSSPNLPHRDAAVAGSSPRLPSLLPPRPPPALSLDIASDSLRTANKVDSDLADYKLRAQPLLVRAHSSLGPGRPRSPLACDDCSLRSAKSSFSLLAPIRSKDVRSRSYLEGSLLASGALLGADELARYFPDRNVALFVATWNMQGQKELPPSLDEFLLPAEADYAQDLYVIGVQEGCSDRREWETRLQETLGPHYVLLSSAAHGVLYMSLFIRRDLIWFCSEVECSTVTTRIVSQIKTKGALGISFTFFGTSFLFITSHFTSGDGKVAERLLDYTRTVQALVLPRNVPDTNPYRSSAADVTTRFDEVFWFGDFNFRLSGGRTVVDALLCQGLVVDVPALLQHDQLIREMRKGSIFKGFQEPDIHFLPSYKFDIGKDTYDSTSKQRTPSYTDRVLYRSRHKGDICPVSYSSCPGIKTSDHRPVYGLFRVKVRPGRDNIPLAAGKFDRELYLLGIKRRISKEIQRQQALQSQNSSTICSVS

SEQ ID NO: 839244 - protein, 464 aa, Homo sapiens
VRGRWYSAEGSERGSPSSGGNPLSGVASSSPNLPHRDAAVAGSSPRLPSLLPPRPPPALSLDIASDSLRTANKVDSDLADYKLRAQPLLVRAHSSLGPGRPRSPLACDDCSLRSAKSSFSLLAPIRSKDVRSRSYLEGSLLASGALLGADELARYFPDRNVALFVATWNMQGQKELPPSLDEFLLPAEADYAQDLYVIGVQEGCSDRREWETRLQETLGPHYVLLSSAAHGVLYMSLFIRRDLIWFCSEVECSTVTTRIVSQIKTKGALGISFTFFGTSFLFITSHFTSGDGKVAERLLDYTRTVQALVLPRNVPDTNPYRSSAADVTTRFDEVFWFGDFNFRLSGGRTVVDALLCQGLVVDVPALLQHDQLIREMRKGSIFKGFQEPDIHFLPSYKFDIGKDTYDSTSKQRTPSYTDRVLYRSRHKGDICPVSYSSCPGIKTSDHRPVYGLFRVKVRPGRDKN

SEQ ID NO: 839245 - protein, 506 aa, Homo sapiens; identical to SEQ ID NO: 839243

SEQ ID NO: 839246 - protein, 100 aa, Homo sapiens
PSARCTLAHPPARPMAASLGMSRYLDICWKPQEATEAGQGRSSRCPQGLSSGEGQALAQLATDARQQNGHECQGSQKASLWGALENSREVSGPRPTAPHK

SEQ ID NO: 839247 - protein, 644 aa, Homo sapiens
MPSKAENLRPSEPAPQPPEGRTLQGQLPGAPPAQRAGSPPDAPGSESPALACSTPATPSGEDPPARAAPIAPRPPARPRLERALSLDDKGWRRRRFRGSQEDLEARNGTSPSRGSVQSEGPGAPAHSCSPPCLSTSLQEIPKSRGVLSSERGSPSSGGNPLSGVASSSPNLPHRDAAVAGSSPRLPSLLPPRPPPALSLDIASDSLRTANKVDSDLADYKLRAQPLLVRAHSSLGPGRPRSPLACDDCSLRSAKSSFSLLAPIRSKDVRSRSYLEGSLLASGALLGADELARYFPDRNVALFVATWNMQGQKELPPSLDEFLLPAEADYAQDLYVIGVQEGCSDRREWETRLQETLGPHYVLLSSAAHGVLYMSLFIRRDLIWFCSEVECSTVTTRIVSQIKTKGALGISFTFFGTSFLFITSHFTSGDGKVAERLLDYTRTVQALVLPRNVPDTNPYRSSAADVTTRFDEVFWFGDFNFRLSGGRTVVDALLCQGLVVDVPALLQHDQLIREMRKGSIFKGFQEPDIHFLPSYKFDIGKDTYDSTSKQRTPSYTDRVLYRSRHKGDICPVSYSSCPGIKTSDHRPVYGLFRVKVRPGRDNIPLAAGKFDRELYLLGIKRRISKEIQRQQALQSQNSSTICSVS

SEQ ID NO: 839248 - protein, 472 aa, Homo sapiens
VRGRWYSAEGSERGSPSSGGNPLSGVASSSPNLPHRDAAVAGSSPRLPSLLPPRPPPALSLDIASDSLRTANKVDSDLADYKLRAQPLLVRAHSSLGPGRPRSPLACDDCSLRSAKSSFSLLAPIRSKDVRSRSYLEGSLLASGALLGADELARYFPDRNVALFVATWNMQGQKELPPSLDEFLLPAEADYAQDLYVIGVQEGCSDRDLIWFCSEVECSTVTTRIVSQIKTKGALGISFTFFGTSFLFITSHFTSGDGKVAERLLDYTRTVQALVLPRNVPDTNPYRSSAADVTTRFDEVFWFGDFNFRLSGGRTVVDALLCQGLVVDVPALLQHDQLIREMRKGSIFKGFQEPDIHFLPSYKFDIGKDTYDSTSKQRTPSYTDRVLYRSRHKGDICPVSYSSCPGIKTSDHRPVYGLFRVKVRPGRDNIPLAAGKFDRELYLLGIKRRISKEIQRQQALQSQNSSTICSVS

SEQ ID NO: 839249 - protein, 150 aa, Homo sapiens
RAWGAAAGTSWSEPVRVPILLAGSIFKGFQEPDIHFLPSYKFDIGKDTYDSTSKQRTPSYTDRVLYRSRHKGDICPVSYSSCPGIKTSDHRPVYGLFRVKVRPGRDNIPLAAGKFDRELYLLGIKRRISKEIQRQQALQSQNSSTICSVS

SEQ ID NO: 839250 - protein, 105 aa, Homo sapiens
SEGQSGRCKIVVVGDAECGKTALLQVFAKDAYPGSYVPTVFENYTASFEIDKRRIELNMWDTSGSSYYDNVRPLAYPDSDAVLICFDISRPETLCVSEFMFFPLP

SEQ ID NO: 839251 - protein, 227 aa, Homo sapiens
SEGQSGRCKIVVVGDAECGKTALLQVFAKDAYPGSYVPTVFENYTASFEIDKRRIELNMWDTSGSSYYDNVRPLAYPDSDAVLICFDISRPETLDSVLKKWQGETQEFCPNAKVVLVGCKLDMRTDLATLRELSKQRLIPVTHEQGTVLAKQVGAVSYVECSSRSSERSVRDVFHVATVASLGRGHRQLRRTDSRRGMQRSAQLSGRPDRGNEGEIHKDRAKSCNLM

SEQ ID NO: 839252 - protein, 227 aa, Homo sapiens; identical to SEQ ID NO: 839251

SEQ ID NO: 839253 - protein, 234 aa, Homo sapiens
SEGQSGRCKIVVVGDAECGKTALLQVFAKDAYPGSYVPTVFENYTASFEIDKRRIELNMWDTSGSSYYDNVRPLAYPDSDAVLICFDISRPETLDSVLKKWQGETQEFCPNAKVVLVGCKLDMRTDLATLRELSKQRLIPVTHEQGTVLAKQVGAVSYVECSSRSSERSVRDVFHVATVASLGRGHRQLRRTDSRRGMQRSAQLSGRPDRGNEGEIHKDRAKSCNLIYSHTSNL

SEQ ID NO: 839254 - protein, 227 aa, Homo sapiens; identical to SEQ ID NO: 839251

SEQ ID NO: 839255 - protein, 240 aa, Homo sapiens
SEGQSGRCKIVVVGDAECGKTALLQVFAKDAYPGSYVPTVFENYTASFEIDKRRIELNMWDTSGSSYYDNVRPLAYPDSDAVLICFDISRPETLDSVLKKWQGETQEFCPNAKVVLVGCKLDMRTDLATLRELSKQRLIPVTHEQGTVLAKQVGAVSYVECSSRSSERSVRDVFHVATVASLGRGHRQLRRTDSRRGMQRSAQLSGRPDRGNEGEIHKENVHSMTFSFPLLSLLQLFSHI

SEQ ID NO: 839256 - protein, 60 aa, Homo sapiens
HFQHQEHCLDHLINASQCSQQQQVLTPVFHKRCLHPRTNQLQAVPSAPPAHLNTSLQTQR

SEQ ID NO: 839257 - protein, 67 aa, Homo sapiens
GQILMPNIGYGSNKKTKHMLLMCNKSYCAEIAHNVSSKNRKAIVETAAQLAIRVTNPNARLRSEENE

SEQ ID NO: 839258 - protein, 33 aa, Homo sapiens
MGCTLYVSLFPRERDIILVFFIFETPTQRCLAY

SEQ ID NO: 839259 - protein, 1009 aa, Homo sapiens
PARRLGHRLAVVAAPPAVLCPYRPRSQGRVLAMPARRLLLLLTLLLPGLGIFGSTSTVTLPETLLFVSTLDGSLHAVSKRTGSIKWTLKEDPVLQVPTHVEEPAFLPDPNDGSLYTLGSKNNEGLTKLPFTIPELVQASPCRSSDGILYMGKKQDIWYVIDLLTGEKQQTLSSAFADSLCPSTSLLYLGRTEYTITMYDTKTRELRWNATYFDYAASLPEDDVDYKMSHFVSNGDGLVVTVDSESGDVLWIQNYASPVVAFYVWQREGLRKVMHINVAVETLRYLTFMSGEVGRITKWKYPFPKETEAKSKLTPTLYVGKYSTSLYASPSMVHEGVAVVPRGSTLPLLEGPQTDGVTIGDKGECVITPSTDVKFDPGLKSKNKLNYLRNYWLLIGHHETPLSASTKMLERFPNNLPKHRENVIPADSEKKSFEEVINLVDQTSENAPTTVSRDVEEKPAHAPARPEAPVDSMLKDMATIILSTFLLIGWVAFIITYPLSMHQQQQLQHQQFQKELEKIQLLQQQQQQLPFHPPGDTAQDGELLDTSGPYSESSGTSSPSTSPRASNHSLCSGSSASKAGSSPSLEQDDGDEETSVVIVGKISFCPKDVLGHGAEGTIVYRGMFDNRDVAVKRILPECFSFADREVQLLRESDEHPNVIRYFCTEKDRQFQYIAIELCAATLQEYVEQKDFAHLGLEPITLLQQTTSGLAHLHSLNIVHRDLKPHNILISMPNAHGKIKAMISDFGLCKKLAVGRHSFSRRSGVPGTEGWIAPEMLSEDCKENPTYTVDIFSAGCVFYYVISEGSHPFGKSLQRQANILLGACSLDCLHPEKHEDVIARELIEKMIAMDPQKRPSAKHVLKHPFFWSLEKQLQFFQDVSDRIEKESLDGPIVKQLERGGRAVVKMDWRENITDPLQTDLRKFRTYKGGSVRDLLRAMRNKKHHYRELPAEVRETLGTLPDDFVCYFTSRFPHLLAHTYRAMELCSHERLFQPYYFHEPPEPQPPVTPDAL

SEQ ID NO: 839260 - protein, 225 aa, Homo sapiens
PARRLGHRLAVVAAPPAVLCPYRPRSQGRVLAMPARRLLLLLTLLLPGLGVSDRGAWGGGQLATAGSGPGQRRGAGAGVRAGSATAAARCPVSPAVGGSGRAEEAAPGRESFPDGSRGPTEASAARRASQASAAVTGSGSPDPAGSGATSWRPARHLGVPEGPGLRRPPTCGTLLLAGGRRRCLAGAAEEPKGRWDPGEGSVLRFESLFELFKNSKTLGNECNRE

SEQ ID NO: 839261 - protein, 225 aa, Homo sapiens; identical to SEQ ID NO: 839260

SEQ ID NO: 839262 - protein, 127 aa, Homo sapiens
LVNFFFSFFFFLKKLPFTIPELVQASPCRSSDGILYMGKKQDIWYVIDLLTGEKQQTLSSAFADSLCPSTSLLYLGRTEYTITMYDTKTRELRWNATYFDYAASLPEDDVDYSKCSLLDFTSLGQYF

SEQ ID NO: 839263 - protein, 466 aa, Homo sapiens
PARRLGHRLAVVAAPPAVLCPYRPRSQGRVLAMPARRLLLLLTLLLPGLGIFGSTSTVTLPETLLFVSTLDGSLHAVSKRTGSIKWTLKEDPVLQVPTHVEEPAFLPDPNDGSLYTLGSKNNEGLTKLPFTIPELVQASPCRSSDGILYMGKKQDIWYVIDLLTGEKQQTLSSAFADSLCPSTSLLYLGRTEYTITMYDTKTRELRWNATYFDYAASLPEDDVDYKMSHFVSNGDGLVVTVDSESGDVLWIQNYASPVVAFYVWQREGLRKVMHINVAVETLRYLTFMSGEVGRITKWKYPFPKETEAKSKLTPTLYVGKYSTSLYASPSMVHEGVAVVPRGSTLPLLEGPQTDGVTIGDKGECVITPSTDVKFDPGLKSKNKLNYLRNYWLLIGHHETPLSASTKMLERFPNNLPKHRENVIPADSEKKSFEETLLQMTSVFSWILNLPSKEEVFAFLRIFEKNM

SEQ ID NO: 839264 - protein, 205 aa, Homo sapiens
QRDIITVCNDPYTLAQQLTHIELERLNYIGPEEFVQAFVQKDPLDNDKSCYSERKKTRNLEAYVEWFNRLSYLVATEICMPVKKKHRARMIEYFIDVARECFNIGNFNSLMAIISGMNMSPVSRLKKTWAKVKTAKFDILEVCEADVLLLSNTLHLESGIPLCGLASPSDYDRGKSPSIFTDPGKGKWVELEGKINQVMYWLLYR

SEQ ID NO: 839265 - protein, 246 aa, Homo sapiens
QRDIITVCNDPYTLAQQLTHIELERLNYIGPEEFVQAFVQKDPLDNDKSCYSERKKTRNLEAYVEWFNRLSYLVATEICMPVKKKHRARMIEYFIDVARECFNIGNFNSLMAIISGMNMSPVSRLKKTWAKVKTAKFDILEHQMDPSSNFYNYRTALRGAAQRSLTAHSSREKIVIPFFSLLIKDIYFLNEGCANRLPNGHVNFEKFWELAKQVSEFMTWKQVECPFERDRKILQYLLTVPVFSED

SEQ ID NO: 839266 - protein, 40 aa, Homo sapiens
MALEQGSLHLPVKGGWGEWEEHQEVSAVATGCFDDRPGRF

SEQ ID NO: 839267 - protein, 96 aa, Homo sapiens
HRATGARSNATVPRACLQPSLSFLSVTSFYDLEMTITPFLAPNQPEATSSGCYRLRRLLWATAPAQKHRQATQQLLERMRFAHPGPGAVRGDSHDP

SEQ ID NO: 839268 - protein, 96 aa, Homo sapiens; identical to SEQ ID NO: 839267

SEQ ID NO: 839269 - protein, 96 aa, Homo sapiens; identical to SEQ ID NO: 839267

SEQ ID NO: 839270 - protein, 369 aa, Homo sapiens
LDPRVRAPQEPKPGSKSAPHVEAPPQPPELAADKKGREREREESSEARGPSAMRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGGFFKLRSGEEISIEVSNPSLLDPDQDATYFGAFKVRDID

SEQ ID NO: 839271 - protein, 244 aa, Homo sapiens
MDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGGFFKLRSGEEISIEVSNPSLLDPDQDATYFGAFKVRDID

SEQ ID NO: 839272 - protein, 188 aa, Homo sapiens
LDPRVRAPQEPKPGSKSAPHVEAPPQPPELAADKKGREREREESSEARGPSAMRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKRWWMAHG

SEQ ID NO: 839273 - protein, 121 aa, Homo sapiens
CLSFPQGLRSGLAVDGRLSSLKAVAAFRPHHLYHYFLSDMFKLFLHYIYPSSQGKVPIVLDEWMICHCHDGHTDTNQRNRLGVGLTPVIPALWEAEEGGLPEPRSSRPAWATWRDPVSTKN

SEQ ID NO: 839274 - protein, 117 aa, Homo sapiens
MSSNVPADMINLRLILVSGKTKEFLFSPNDSASDIAKHVYDNWPMDWEEEQVSSPNILRLIYQGRFLHGNVTLGALKLPFGKTTVMHLVARETLPEPNSQGQRNREKTGESNCCVIL

SEQ ID NO: 839275 - protein, 117 aa, Homo sapiens; identical to SEQ ID NO: 839274

SEQ ID NO: 839276 - protein, 117 aa, Homo sapiens; identical to SEQ ID NO: 839274

SEQ ID NO: 839277 - protein, 117 aa, Homo sapiens; identical to SEQ ID NO: 839274

SEQ ID NO: 839278 - protein, 117 aa, Homo sapiens; identical to SEQ ID NO: 839274

SEQ ID NO: 839279 - protein, 117 aa, Homo sapiens; identical to SEQ ID NO: 839274

SEQ ID NO: 839280 - protein, 117 aa, Homo sapiens; identical to SEQ ID NO: 839274

SEQ ID NO: 839281 - protein, 117 aa, Homo sapiens; identical to SEQ ID NO: 839274

SEQ ID NO: 839282 - protein, 210 aa, Homo sapiens
MFESFNVPGLYIAVQAVLALAASWTSRQVGERTLTGIVIDSGDGVTHVIPVAEGYVIGSCIKHIPIAGRDITYFIQQLLREREVGIPPEQSLETAKAIKEKYCYICPDIVKEFAKYDVDPQKWIKQYTGINAINQKKFVIDVGYERFLGPEIFFHPEFANPDSMESISDVVDEVIQNCPIDVRRPLYKMEQIPLSYPQGHGFHPLSPPFH

SEQ ID NO: 839283 - protein, 210 aa, Homo sapiens; identical to SEQ ID NO: 839282

SEQ ID NO: 839284 - protein, 154 aa, Homo sapiens
LLSSKPTNDGTCIEIGYVKYSIFQLVMQYLYYGGPESLLIKNNEIMELLSAAKFFQLEALQRHCEIICAKSINTDNCVDIYNHAKFLGVTELSAYCEGYFLKNMMVLIENEAFKQLLYDKNGEGTGQDVLQDLQRTLAIRIQSIHLSSSKGSVV

SEQ ID NO: 839285 - protein, 154 aa, Homo sapiens; identical to SEQ ID NO: 839284

SEQ ID NO: 839286 - protein, 1146 aa, Homo sapiens
MCFIKVIKQVILLFLVLVTYLHIYLGGVMFFLKGTPVTPVTPANVVQGLPDPWVSQITNTDTLAAVAQILQSPQGQQLQQLIQTLQIQQQKPQPSILQALDAGLVVQLQALTAQLTAAAAAANTLTPLEQGVSFNKKLMDRFDFGEDSEHSEEPKKEIPASQLSHVSESVNNSIFHQIAEQLQQQNLEHLRQQLLEQQQPQKATPQDSQEGTFGSEHSASPSQGSSQQHFLEPEVNLDDSIDIQQQDMDIDEGQDGVEEEVFEQEAKKVAVRSRSRTHSRSRSRSPRKRRSRSRSGSRKRKHRKRSRSRSRERKRKSSRSYSSERRAREREKERQKKGLPPIRSKTLSVCSTTLWVGQVDKKATQQDLTNLFEEFGQIESINMIPPRGCAYVCMVHRQDAFRALQKLSSGSYKIGSKVIKIAWALNKGVKTEYKQFWDVDLGVTYIPWEKVKVDDLEGFAEGGMIDQETVNTEWETVKSSEPVKETVQTTQSPTPVEKETVVTTQAEVFPPPVAMLQIPVAPAVPTVSLVPPAFPVSMPVPPPGFSPIPPPPFLRASFNPSQPPPGFMPPPVPPPVVPPPTIPPVVPTSLVQPSLSMTPETVKDVGFGSLVIPGGSVASNLATSALPAGNVFNAPTKQAEPEEKVPHLIDHQISSGENTRSVIPNDISSNAAILGGQPPNVTSNSGILGVQRPNVSSNSEILGVRPSNVSSSSGIIAAQPPNILNNSGILGIQPPSVSNSSGLLGVLPPNIPNNSGLVGVQPPNVPNTPGLLGTQPPAGPQNLPPLSIPNQRMPTMPMLDIRPGLIPQAPGPRFPLIQPGIPPQRGIPPPSVLDSALHPPPRGPFPPGDIFSQPERPFLAPGRQSVDNVTNPEKRIPLGNDNIQQEGDRDYRFPPIETRESISRPPPVDVRDVVGRPIDPREGPGRPPLDGRDHFGRPPVDIRENLVRPGIDHLGRRDHFGFNPEKPWGHRGDFDEREHRVLPVYGGPKGLHEERGRFRSGNYRFDPRSGPWNRGFGQEVHRDFDDRRRPWERQRDRDDRDFDFCREMNGNRLGRDRIQNTWVPPPHARVFDYFEGATSQRKGDNVPQVNGENTERHAQPPPIPVQNDPELYEKLTSSNEINKEKSDTVADIESEPVVESTETEGT

SEQ ID NO: 839287 - protein, 1432 aa, Homo sapiens
MEAVKTFNSELYSLNDYKPPISKAKMTQITKAAIKAIKFYKHVVQSVEKFIQKCKPEYKVPGLYVIDSIVRQSRHQFGQEKDVFAPRFSNNIISTFQNLYRCPGDDKSKIVRVLNLWQKNNVFKSEIIQPLLDMAAGIPPPVVTPVLASTTTAMSNTPGTPVTPVTPANVVQGLPDPWVSQITNTDTLAAVAQILQSPQGQQLQQLIQTLQIQQQKPQPSILQALDAGLVVQLQALTAQLTAAAAAANTLTPLEQGVSFNKKLMDRFDFGEDSEHSEEPKKEIPASQLSHVSESVNNSIFHQIAEQLQQQNLEHLRQQLLEQQQPQKATPQDSQEGTFGSEHSASPSQGSSQQHFLEPEVNLDDSIDIQQQVKVNVFLGHKFLKVAKEIIKYFIQQCPEYIFPTLKLHFVIVSPIEAKLVQGLSMAPRPSTWPRTALNAAQHKFVNFLKKYEICFCDFFFFLSLSAVISVSIFYVWPKTLLLLMGPREAKRLDTPVLGINAPIVNIFKNRIVNVELCLNQPFCLFAVLLTFKDMDIDEGQDGVEEEVFEQEAKKVAVRSRSRTHSRSRSRSPRKRRSRSRSGSRKRKHRKRSRSRSRERKRKSSRSYSSERRAREREKERQKKGLPPIRSKTLSVCSTTLWVGQVDKKATQQDLTNLFEEFGQIESINMIPPRGCAYVCMVHRQDAFRALQKLSSGSYKIGSKVIKIAWALNKGVKTEYKQFWDVDLGVTYIPWEKVKVDDLEGFAEGGMIDQETVNTEWETVKSSEPVKETVQTTQSPTPVEKETVVTTQAEVFPPPVAMLQIPVAPAVPTVSLVPPAFPVSMPVPPPGFSPIPPPPFLRASFNPSQPPPGFMPPPVPPPVVPPPTIPPVVPTSLVQPSLSMTPETVKDVGFGSLVIPGGSVASNLATSALPAGNVFNAPTKQAEPEEKVPHLIDHQISSGENTRSVIPNDISSNAAILGGQPPNVTSNSGILGVQRPNVSSNSEILGVRPSNVSSSSGIIAAQPPNILNNSGILGIQPPSVSNSSGLLGVLPPNIPNNSGLVGVQPPNVPNTPGLLGTQPPAGPQNLPPLSIPNQRMPTMPMLDIRPGLIPQAPGPRFPLIQPGIPPQRGIPPPSVLDSALHPPPRGPFPPGDIFSQPERPFLAPGRQSVDNVTNPEKRIPLGNDNIQQEGDRDYRFPPIETRESISRPPPVDVRDVVGRPIDPREGPGRPPLDGRDHFGRPPVDIRENLVRPGIDHLGRRDHFGFNPEKPWGHRGDFDEREHRVLPVYGGPKGLHEERGRFRSGNYRFDPRSGPWNRGFGQEVHRDFDDRRRPWERQRDRDDRDFDFCREMNGNRLGRDRIQNTWVPPPHARVFDYFEGATSQRKGDNVPQVNGENTERHAQPPPIPVQNDPELYEKLTSSNEINKEKSDTVADIESEPVVESTETEGT

SEQ ID NO: 839288 - protein, 632 aa, Homo sapiens
MLQIPVAPAVPTVSLVPPAFPVSMPVPPPGFSPIPPPPFLRASFNPSQPPPGFMPPPVPPPVVPPPTIPPVVPTSLVQPSLSMTPETVKDVGFGSLVIPGGSVASNLATSALPAGNVFNAPTKQAEPEEKVPHLIDHQISSGENTRSVIPNDISSNAAILGGQPPNVTSNSGILGVQRPNVSSNSEILGVRPSNVSSSSGIIAAQPPNILNNSGILGIQPPSVSNSSGLLGVLPPNIPNNSGLVGVQPPNVPNTPGLLGTQPPAGPQNLPPLSIPNQRMPTMPMLDIRPGLIPQAPGPRFPLIQPGIPPQRGIPPPSVLDSALHPPPRGPFPPGDIFSQPERPFLAPGRQSVDNVTNPEKRIPLGNDNIQQEGDRDYRFPPIETRESISRPPPVDVRDVVGRPIDPREGPGRPPLDGRDHFGRPPVDIRENLVRPGIDHLGRRDHFGFNPEKPWGHRGDFDEREHRVLPVYGGPKGLHEERGRFRSGNYRFDPRSGPWNRGFGQEVHRDFDDRRRPWERQRDRDDRDFDFCREMNGNRLGRDRIQNTWVPPPHARVFDYFEGATSQRKGDNVPQVNGENTERHAQPPPIPVQNDPELYEKLTSSNEINKEKSDTVADIESEPVVESTETEGT

SEQ ID NO: 839289 - protein, 1271 aa, Homo sapiens
MEAVKTFNSELYSLNDYKPPISKAKMTQITKAAIKAIKFYKHVVQSVEKFIQKCKPEYKVPGLYVIDSIVRQSRHQFGQEKDVFAPRFSNNIISTFQNLYRCPGDDKSKIVRVLNLWQKNNVFKSEIIQPLLDMAAGIPPPVVTPVLASTTTAMSNTPGTPVTPVTPANVVQGLPDPWVSQITNTDTLAAVAQILQSPQGQQLQQLIQTLQIQQQKPQPSILQALDAGLVVQLQALTAQLTAAAAAANTLTPLEQGVSFNKKLMDRFDFGEDSEHSEEPKKEIPASQLSHVSESVNNSIFHQIAEQLQQQNLEHLRQQLLEQQQPQKATPQDSQEGTFGSEHSASPSQGSSQQHFLEPEVNLDDSIDIQQQDMDIDEGQDGVEEEVFEQEAKKVAVRSRSRTHSRSRSRSPRKRRSRSRSGSRKRKHRKRSRSRSRERKRKSSRSYSSERRAREREKERQKKGLPPIRSKTLSVCSTTLWVGQVDKKATQQDLTNLFEEFGQIESINMIPPRGCAYVCMVHRQDAFRALQKLSSGSYKIGSKVIKIAWALNKGVKTEYKQFWDVDLGVTYIPWEKVKVDDLEGFAEGGMIDQETVNTEWETVKSSEPVKETVQTTQSPTPVEKETVVTTQAEVFPPPVAMLQIPVAPAVPTVSLVPPAFPVSMPVPPPGFSPIPPPPFLRASFNPSQPPPGFMPPPVPPPVVPPPTIPPVVPTSLVQPSLSMTPETVKDVGFGSLVIPGGSVASNLATSALPAGNVFNAPTKQAEPEEKVPHLIDHQISSGENTRSVIPNDISSNAAILGGQPPNVTSNSGILGVQRPNVSSNSEILGVRPSNVSSSSGIIAAQPPNILNNSGILGIQPPSVSNSSGLLGVLPPNIPNNSGLVGVQPPNVPNTPGLLGTQPPAGPQNLPPLSIPNQRMPTMPMLDIRPGLIPQAPGPRFPLIQPGIPPQRGIPPPSVLDSALHPPPRGPFPPGDIFSQPERPFLAPGRQSVDNVTNPEKRIPLGNDNIQQEGDRDYRFPPIETRESISRPPPVDVRDVVGRPIDPREGPGRPPLDGRDHFGRPPVDIRENLVRPGIDHLGRRDHFGFNPEKPWGHRGDFDEREHRVLPVYGGPKGLHEERGRFRSGNYRFDPRSGPWNRGFGQEVHRDFDDRRRPWERQRDRDDRDFDFCREMNGNRLGRDRIQNTWVPPPHARVFDYFEGATSQRKGDNVPQVNGENTERHAQPPPIPVQNDPELYEKLTSSNEINKEKSDTVADIESEPVVESTETEGT

SEQ ID NO: 839290 - protein, 1190 aa, Homo sapiens
MEAVKTFNSELYSLNDYKPPISKAKMTQITKAAIKAIKFYKHVVQSVEKFIQKCKPEYKVPGLYVIDSIVRQSRHQFGQEKDVFAPRFSNNIISTFQNLYRCPGDDKSKIVRVLNLWQKNNVFKSEIIQPLLDMAAGIPPPVVTPVLASTTTAMSNTPGTPVTPVTPANVVQGLPDPWVSQITNTDTLAAVAQILQSPQGQQLQQLIQTLQIQQQKPQPSILQALDAGLVVQLQALTAQLTAAAAAANTLTPLEQGVSFNKKLMDRFDFGEDSEHSEEPKKEIPASQLSHVSESVNNSIFHQIAEQLQQQNLEHLRQQLLEQQQPQKATPQDSQEGTFGSEHSASPSQGSSQQHFLEPEVNLDDSIDIQQQDMDIDEGQDGVEEEVFEQEAKKVAVRSRSRTHSRSRSRSPRKRRSRSRSGSRKRKHRKRSRSRSRERKRKSSRSYSSERRAREREKERQKKGLPPIRSKTLSVCSTTLWVGQVDKKATQQDLTNLFEEFGQIESINMIPPRGCAYVCMVHRQDAFRALQKLSSGSYKIGSKVIKIAWALNKGVKTEYKQFWDVDLGVTYIPWEKVKVDDLEGFAEGGMIDQETVNTEWETVKSSEPVKETVQTTQSPTPVEKETVVTTQAEVFPPPVAMLQIPVAPAVPTVSLVPPAFPVSMPVPPPGFSPIPPPPFLRASFNPSQPPPGFMPPPVPPPVVPPPTIPPVVPTSLVQPSLSMTPETVKDVGFGSLVIPGGSVASNLATSALPAGNVFNAPTKQAEPEEKVPHLIDHQISSGENTRSVIPNDISSNAAILGGQPPNVTSNSGILGVQRPNVSSNSQNLPPLSIPNQRMPTMPMLDIRPGLIPQAPGPRFPLIQPGIPPQRGIPPPSVLDSALHPPPRGPFPPGDIFSQPERPFLAPGRQSVDNVTNPEKRIPLGNDNIQQEGDRDYRFPPIETRESISRPPPVDVRDVVGRPIDPREGPGRPPLDGRDHFGRPPVDIRENLVRPGIDHLGRRDHFGFNPEKPWGHRGDFDEREHRVLPVYGGPKGLHEERGRFRSGNYRFDPRSGPWNRGFGQEVHRDFDDRRRPWERQRDRDDRDFDFCREMNGNRLGRDRIQNTWVPPPHARVFDYFEGATSQRKGDNVPQVNGENTERHAQPPPIPVQNDPELYEKLTSSNEINKEKSDTVADIESEPVVESTETEGT

SEQ ID NO: 839291 - protein, 1253 aa, Homo sapiens
MEAVKTFNSELYSLNDYKPPISKAKMTQITKAAIKAIKFYKHVVQSVEKFIQKCKPEYKVPGLYVIDSIVRQSRHQFGQEKDVFAPRFSNNIISTFQNLYRCPGDDKSKIVRVLNLWQKNNVFKSEIIQPLLDMAAGIPPPVVTPVLASTTTAMSNTPGTPVTPVTPANVVQGLPDPWVSQITNTDTLAAVAQILQSPQGQQLQQLIQTLQIQQQKPQPSILQALDAGLVVQLQALTAQLTAAAAAANTLTPLEQGVSFNKKLMDRFDFGEDSEHSEEPKKEIPASQLSHVSESVNNSIFHQIAEQLQQQNLEHLRQQLLEQQQPQKATPQDSQEGTFGSEHSASPSQGSSQQHFLEPEVNLDDSIDIQQQDMDIDEGQDGVEEEVFEQEAKKVAVRSRSRTHSRSRSRSPRKRRSRSRSGSRKRKHRKRSRSRSRERKRKSSRSYSSERRAREREKERQKKGLPPIRSKTLSVCSTTLWVGQVDKKATQQDLTNLFEEFGQIESINMIPPRGCAYVCMVHRQDAFRALQKLSSGSYKIGSKVIKIAWALNKGVKTEYKQFWDVDLGVTYIPWEKVKVDDLEGFAEGGMIDQETVNTEWETVKSSEPVKETVQTTQSPTPVEKETVVTTQAEVFPPPVAMLQIPVAPAVPTVSLVPPAFPVSMPVPPPGFSPIPPPPFLRASFNPSQPPPGFMPPPVPPPVVPPPTIPPVVPTSLVQPSLSMTPETVKDVGFGSLVIPGGSVASNLATSALPAGNVFNAPTKQAEPEEKVPHLIDHQISSGENTRSVIPNDISSNAAILGGQPPNVTSNSGILGVQRPNVSSNSEILGVRPSNVSSSSGIIAAQPPNILNNSGILGIQPPSVSNSSGLLGVLPPNIPNNSGLVGVQPPNVPNTPGLLGTQPPAGPQNLPPLSIPNQRMPTMPMLDIRPGLIPQAPGPRFPLIQPGIPPQRGIPPPSVLDSALHPPPRGPFPPGDIFSQPERPFLAPGRQSVDNVTNPEKRIPLGNDNIQQEGDRDYRFPPIETRESISRPPPVDVRDVVGRPIDPREGPGRPPLDGRDHFGRPPVDIRENLVRPGIDHLGRRDHFGFNPEKPWGHRGDFDEREHRVLPVYGGPPRSGPWNRGFGQEVHRDFDDRRRPWERQRDRDDRDFDFCREMNGNRLGRDRIQNTWVPPPHARVFDYFEGATSQRKGDNVPQVNGENTERHAQPPPIPVQNDPELYEKLTSSNEINKEKSDTVADIESEPVVESTETEGT

SEQ ID NO: 839292 - protein, 1070 aa, Homo sapiens
MEAVKTFNSELYSLNDYKPPISKAKMTQITKAAIKAIKFYKHVVQSVEKFIQKCKPEYKVPGLYVIDSIVRQSRHQFGQEKDVFAPRFSNNIISTFQNLYRCPGDDKSKIVRVLNLWQKNNVFKSEIIQPLLDMAAGIPPPVVTPVLASTTTAMSNTPGTPVTPVTPANVVQGLPDPWVSQITNTDTLAAVAQILQSPQGQQLQQLIQTLQIQQQKPQPSILQALDAGLVVQLQALTAQLTAAAAAANTLTPLEQGVSFNKKLMDRFDFGEDSEHSEEPKKEIPASQLSHVSESVNNSIFHQIAEQLQQQNLEHLRQQLLEQQQPQKATPQDSQEGTFGSEHSASPSQGSSQQHFLEPEVNLDDSIDIQQQDMDIDEGQDGVEEEVFEQEAKKVAVRSRSRTHSRSRSRSPRKRRSRSRSGSRKRKHRKRSRSRSRERKRKSSRSYSSERRAREREKERQKKGLPPIRSKTLSVCSTTLWVGQVDKKATQQDLTNLFEEFGQIESINMIPPRGCAYVCMVHRQDAFRALQKLSSGSYKIGSKVIKIAWALNKGVKTEYKQFWDVDLGVTYIPWEKVKVDDLEGFAEGGMIDQETVNTEWETVKSSEPVKETVQTTQSPTPVEKETVVTTQAEVFPPPVAMLQIPVAPAVPTVSLVPPAFPVSMPVPPPGFSPIPPPPFLRASFNPSQPPPGFMPPPVPPPVVPPPTIPPVVPTSLVQPSLSMTPETVKDVGFGSLVIPGGSVASNLATSALPAGNVFNAPTKQAEPEEKVPHLIDHQISSGENTRSVIPNDISSNAAILGGQPPNVTSNSGILGVQRPNVSSNSEILGVRPSNVSSSSGIIAAQPPNILNNSGILGIQPPSVSNSSGLLGVLPPNIPNNSGLVGVQPPNVPNTPGLLGTQPPAGPQNLPPLSIPNQRMPTMPMLDIRPGLIPQAPGPRFPLIQPGIPPQRGIPPPSVLDSALHPPPRGPFPPGDIFSQPERPFLAPGRQSVDNVTNPEKRIPLGNDNIQQEGDRDFHKLKQSRFFDENESPVDPQHGSKLADYNGDDGNVGEYEAGAAELAYMRTEDGRV

SEQ ID NO: 839293 - protein, 696 aa, Homo sapiens
MEAVKTFNSELYSLNDYKPPISKAKMTQITKAAIKAIKFYKHVVQSVEKFIQKCKPEYKVPGLYVIDSIVRQSRHQFGQEKDVFAPRFSNNIISTFQNLYRCPGDDKSKIVRVLNLWQKNNVFKSEIIQPLLDMAAGIPPPVVTPVLASTTTAMSNTPGTPVTPVTPANVVQGLPDPWVSQITNTDTLAAVAQILQSPQGQQLQQLIQTLQIQQQKPQPSILQALDAGLVVQLQALTAQLTAAAAAANTLTPLEQGVSFNKKLMDRFDFGEDSEHSEEPKKEIPASQLSHVSESVNNSIFHQIAEQLQQQNLEHLRQQLLEQQQPQKATPQDSQEGTFGSEHSASPSQGSSQQHFLEPEVNLDDSIDIQQQDMDIDEGQDGVEEEVFEQEAKKVAVRSRSRTHSRSRSRSPRKRRSRSRSGSRKRKHRKRSRSRSRERKRKSSRSYSSERRAREREKERQKKGLPPIRSKTLSVCSTTLWVGQVDKKATQQDLTNLFEEFGQIESINMIPPRGCAYVCMVHRQDAFRALQKLSSGSYKIGSKVIKIAWALNKGVKTEYKQFWDVDLGVTYIPWEKVKVDDLEGFAEGGMIDQETVNTEWETVKSSEPVKETVQTTQSPTPVEKETVVTTQAEVFPPPVAMLQIPVAPAVPTVSLVPPAFPVSMPVPPPGFSPIPPPPFLRASFNPSQPPPGKEFLF

SEQ ID NO: 839294 - protein, 1271 aa, Homo sapiens; identical to SEQ ID NO: 839289

SEQ ID NO: 839295 - protein, 1271 aa, Homo sapiens; identical to SEQ ID NO: 839289

SEQ ID NO: 839296 - protein, 899 aa, Homo sapiens [sequence omitted]

SEQ ID NO: 839297 - protein, 1271 aa, Homo sapiens; identical to SEQ ID NO: 839289

SEQ ID NO: 839298 - protein, 1271 aa, Homo sapiens; identical to SEQ ID NO: 839289

SEQ ID NO: 839299 - protein, 365 aa, Homo sapiens
RILRFNCALQWMPTMPMLDIRPGLIPQAPGPRFPLIQPGIPPQRGIPPPSVLDSALHPPPRGPFPPGDIFSQPERPFLAPGRQSVDNVTNPEKRIPLGNDNIQQEGDRDYRFPPIETRESISRPPPVDVRDVVGRPIDPREGPGRPPLDGRDHFGRPPVDIRENLVRPGIDHLGRRDHFGFNPEKPWGHRGDFDEREHRVLPVYGGPKGLHEERGRFRSGNYRFDPRSGPWNRGFGQEVHRDFDDRRRPWERQRDRDDRDFDFCREMNGNRLGRDRIQNTWVPPPHARVFDYFEGATSQRKGDNVPQVNGENTERHAQPPPIPVQNDPELYEKLTSSNEINKEKSDTVADIESEPVVESTETEGT

SEQ ID NO: 839300 - protein, 788 aa, Homo sapiens
MEAVKTFNSELYSLNDYKPPISKAKMTQITKAAIKAIKFYKHVVQSVEKFIQKCKPEYKVPGLYVIDSIVRQSRHQFGQEKDVFAPRFSNNIISTFQNLYRCPGDDKSKIVRVLNLWQKNNVFKSEIIQPLLDMAAGIPPPVVTPVLASTTTAMSNTPGTPVTPVTPANVVQGLPDPWVSQITNTDTLAAVAQILQSPQGQQLQQLIQTLQIQQQKPQPSILQALDAGLVVQLQALTAQLTAAAAAANTLTPLEQGVSFNKKLMDRFDFGEDSEHSEEPKKEIPASQLSHVSESVNNSIFHQIAEQLQQQNLEHLRQQLLEQQQPQKATPQDSQEGTFGSEHSASPSQGSSQQHFLEPEVNLDDSIDIQQQDMDIDEGQDGVEEEVFEQEAKKVAVRSRSRTHSRSRSRSPRKRRSRSRSGSRKRKHRKRSRSRSRERKRKSSRSYSSERRAREREKERQKKGLPPIRSKTLSVCSTTLWVGQVDKKATQQDLTNLFEEFGQIESINMIPPRGCAYVCMVHRQDAFRALQKLSSGSYKIGSKVIKIAWALNKGVKTEYKQFWDVDLGVTYIPWEKVKVDDLEGFAEGGMIDQETVNTEWETVKSSEPVKETVQTTQSPTPVEKETVVTTQAEVFPPPVAMLQIPVAPAVPTVSLVPPAFPVSMPVPPPGFSPIPPPPFLRASFNPSQPPPGFMPPPVPPPVVPPPTIPPVVPTSLVQPSLSMTPETVKDVGFGSLVIPGGSVASNLATSALPAGNVFNAPTKQAEPEEKVPHLIDHQISSGENTRSGK

SEQ ID NO: 839301 - protein, 68 aa, Homo sapiens
SYSVVSDGRRILRAPWKTLEIAIHPLTPSEHSARGSPYWCRRSGQVATLPTAPPSDADSGLLFDHVGF

SEQ ID NO: 839302 - protein, 110 aa, Homo sapiens
PLWAQHPHNCTSPPFLFLLRWLTQKGARQKKINEWLGIKNETEDQYALMEDECFLEMLSISMLAYCLRVLQLWVHSLICMIKMNWPFSTSKLLTDTTIFDRIPRVNCLCY

SEQ ID NO: 839303 - protein, 728 aa, Homo sapiens
MAGPEGFQYRALYPFRRERPEDLELLPGDVLVVSRAALQALGVAEGGERCPQSVGWMPGLNERTRQRGDFPGTYVEFLGPVALARPGPRPRGPRPLPARPRDGAPEPGLTLPDLPEQFSPPDVAPPLLVKLVEAIERTGLDSESHYRPELPAPRTDWSLSDVDQWDTAALADGIKSFLLALPAPLVTPEASAEARRALREAAGPVGPALEPPTLPLHRALTLRFLLQHLGRVARRAPALGPAVRALGATFGPLLLRAPPPPSSPPPGGAPDGSEPSPDFPALLVEKLLQEHLEEQEVAPPALPPKPPKAKPAPTVLANGGSPPSLQDAEWYWGDISREEVNEKLRDTPDGTFLVRDASSKIQGEYTLTLRKGGNNKLIKVFHRDGHYGFSEPLTFCSVVDLINHYRHESLAQYNAKLDTRLLYPVSKYQQDQIVKEDSVEAVGAQLKVYHQQYQDKSREYDQLYEEYTRTSQELQMKRTAIEAFNETIKIFEEQGQTQEKCSKEYLERFRREGNEKEMQRILLNSERLKSRIAEIHESRTKLEQQLRAQASDNREIDKRMNSLKPDLMQLRKIRDQYLVWLTQKGARQKKINEWLGIKNETEDQYALMEDEDDLPHHEERTWYVGKINRTQAEEMLSGKRDGTFLIRESSQRGCYACSVVVDGDTKHCVIYRTATGFGFAEPYNLYGSLKELVLHYQHASLVQHNDALTVTLAHPVRAPGPGPPPAAR

SEQ ID NO: 839304 - protein, 653 aa, Homo sapiens
MAGPEGFQYRALYPFRRERPEDLELLPGDVLVVSRAALQALGVAEGGERCPQSVGWMPGLNERTRQRGDFPGTYVEFLGPVALARPGPRPRGPRPLPARPRDGAPEPGLTLPDLPEQFSPPDVAPPLLVKLVEAIERTGLDSESHYRPELPAPRTDWSLSDVDQWDTAALADGIKSFLLALPAAAPSSPPPGGAPDGSEPSPDFPALLVEKLLQEHLEEQEVAPPALPPKPPKAKPAPTVLANGGSPPSLQDAEWYWGDISREEVNEKLRDTPDGTFLVRDASSKIQGEYTLTLRKGGNNKLIKVFHRDGHYGFSEPLTFCSVVDLINHYRHESLAQYNAKLDTRLLYPVSKYQQDQIVKEDSVEAVGAQLKVYHQQYQDKSREYDQLYEEYTRTSQELQMKRTAIEAFNETIKIFEEQGQTQEKCSKEYLERFRREGNEKEMQRILLNSERLKSRIAEIHESRTKLEQQLRAQASDNREIDKRMNSLKPDLMQLRKIRDQYLVWLTQKGARQKKINEWLGIKNETEDQYALMEDEDDLPHHEERTWYVGKINRTQAEEMLSGKRDGTFLIRESSQRGCYACSVVVDGDTKHCVIYRTATGFGFAEPYNLYGSLKELVLHYQHASLVQHNDALTVTLAHPVRAPGPGPPPAAR

SEQ ID NO: 839305 - protein, 305 aa, Homo sapiens
IPPRIKQDQIVKEDSVEAVGAQLKVYHQQYQDKSREYDQLYEEYTRTSQELQMKRTAIEAFNETIKIFEEQGQTQEKCSKEYLERFRREGNEKEMQRILLNSERLKSRIAEIHESRTKLEQQLRAQASDNREIDKRMNSLKPDLMQLRKIRDQYLVWLTQKGARQKKINEWLGIKNETEDQYALMEDEDDLPHHEERTWYVGKINRTQAEEMLSGKRDGTFLIRESSQRGCYACSVVVDGDTKHCVIYRTATGFGFAEPYNLYGSLKELVLHYQHASLVQHNDALTVTLAHPVRAPGPGPPPAAR

SEQ ID NO: 839306 - protein, 728 aa, Homo sapiens; identical to SEQ ID NO: 839303

SEQ ID NO: 839307 - protein, 603 aa, Homo sapiens
MAGPEGFQYRALYPFRRERPEDLELLPGDVLVVSRAALQALGVAEGGERCPQSVGWMPGLNERTRQRGDFPGTYVEFLGPVALARPGPRPRGPRPLPARPRDGAPEPGLTLPDLPEQFSPPDVAPPLLVKLVEAIERTGLDSESHYRPELPAPRTDWSLSDVDQWDTAALADGIKSFLLALPAPLVTPEASAEARRALREAAGPVGPALEPPTLPLHRALTLRFLLQHLGRVARRAPALGPAVRALGATFGPLLLRAPPPPSSPPPGGAPDGSEPSPDFPALLVEKLLQEHLEEQEVAPPALPPKPPKAKPAPTVLANGGSPPSLQDAEWYWGDISREEVNEKLRDTPDGTFLVRDASSKIQGEYTLTLRKGGNNKLIKVFHRDGHYGFSEPLTFCSVVDLINHYRHESLAQYNAKLDTRLLYPVSKYQQDQIVKEDSVEAVGAQLKVYHQQYQDKSREYDQLYEEYTRTSQELQMKRTAIEAFNETIKIFEEQGQTQEKCSKEYLERFRREGNEKEMQRILLNSERLKSRIAEIHESRTKLEQQLRAQASDNREIDKRMNSLKPDLMQLRKIRDQYLVWLTQKGARQKKINEWLGIKNETEE

SEQ ID NO: 839308 - protein, 392 aa, Homo sapiens [sequence omitted]

SEQ ID NO: 839309 - protein, 728 aa, Homo sapiens; identical to SEQ ID NO: 839303

SEQ ID NO: 839310 - protein, 606 aa, Homo sapiens
RSGQHLRADSPVPFTPRLDSESHYRPELPAPRTDWSLSDVDQWDTAALADGIKSFLLALPAPLVTPEASAEARRALREAAGPVGPALEPPTLPLHRALTLRFLLQHLGRVARRAPALGPAVRALGATFGPLLLRAPPPPSSPPPGGAPDGSEPSPDFPALLVEKLLQEHLEEQEVAPPALPPKPPKAKPAPTVLANGGSPPSLQDAEWYWGDISREEVNEKLRDTPDGTFLVRDASSKIQGEYTLTLRKGGNNKLIKVFHRDGHYGFSEPLTFCSVVDLINHYRHESLAQYNAKLDTRLLYPVSKYQQDQIVKEDSVEAVGAQLKVYHQQYQDKSREYDQLYEEYTRTSQELQMKRTAIEAFNETIKIFEEQGQTQEKCSKEYLERFRREGNEKEMQRILLNSERLKSRIAEIHESRTKLEQQLRAQASDNREIDKRMNSLKPDLMQLRKIRDQYLVWLTQKGARQKKINEWLGIKNETEDQYALMEDEDDLPHHEERTWYVGKINRTQAEEMLSGKRDGTFLIRESSQRGCYACSVVVDGDTKHCVIYRTATGFGFAEPYNLYGSLKELVLHYQHASLVQHNDALTVTLAHPVRAPGPGPPPAAR

SEQ ID NO: 839311 - protein, 519 aa, Homo sapiens
MEHLLHTAMRELASHMCLYHLLLRPAHTVSYIPPGVQAHAQSCAHAWADRPYPALTTLPFPLRSEPSPDFPALLVEKLLQEHLEEQEVAPPALPPKPPKAKPAPTVLANGGSPPSLQDAEWYWGDISREEVNEKLRDTPDGTFLVRDASSKIQGEYTLTLRKGGNNKLIKVFHRDGHYGFSEPLTFCSVVDLINHYRHESLAQYNAKLDTRLLYPVSKYQQDQIVKEDSVEAVGAQLKVYHQQYQDKSREYDQLYEEYTRTSQELQMKRTAIEAFNETIKIFEEQGQTQEKCSKEYLERFRREGNEKEMQRILLNSERLKSRIAEIHESRTKLEQQLRAQASDNREIDKRMNSLKPDLMQLRKIRDQYLVWLTQKGARQKKINEWLGIKNETEDQYALMEDEDDLPHHEERTWYVGKINRTQAEEMLSGKRDGTFLIRESSQRGCYACSVVVDGDTKHCVIYRTATGFGFAEPYNLYGSLKELVLHYQHASLVQHNDALTVTLAHPVRAPGPGPPPAAR

SEQ ID NO: 839312 - protein, 689 aa, Homo sapiens
MAGPEGFQYRALYPFRRERPEDLELLPGDVLVVSRAALQALGVAEGGERCPQSVGWMPGLNERTRQRGDFPGTYVEFLGPVALARPGPRPRGPRPLPARPRDGAPEPGLTLPDLPEQFSPPDVAPPLLVKLVEAIERTGLDSESHYRPELPAPRTDWSLSDVDQWDTAALADGIKSFLLALPAPLVTPEASAEARRALREAAGPVGPALEPPTLPLHRALTLRFLLQHLGRVARRAPALGPAVRALGATFGPLLLRAPPPPSSPPPGGAPDGSEPSPDFPALLVEKLLQEHLEEQEVAPPALPPKPPKAKPAPTVLANGGSPPSLQDAEWYWGDISREEVNEKLRDTPDGTFLVRDASSKIQGEYTLTLRKGGNNKLIKVFHRDGHYGFSEPLTFCSVVDLINHYRHESLAQYNAKLDTRLLYPVSKYQQDQIVKEDSVEAVGAQLKVYHQQYQDKSREYDQLYEEYTRTSQELQMKRTAIEAFNETIKIFEEQGQTQEKCSKEYLERFRREGNEKEMQRILLNSERLKSRIAEIHESRTKLEQQLRAQASDNREIDKRMNSLKPDLMQLRKIRDQYLVWLTQKGARQKKINEWLGIKNETEDQYALMEDEDDLPHHEERTWYVGKINRTQAEEMLSGKRDGTFLIRESSQRGCYACSVVKLRHCPRPLPLMQIQGFSSIMLGFDSVFP

SEQ ID NO: 839313 - protein, 266 aa, Homo sapiens
IPPRIKQDQIVKEDSVEAVGAQLKVYHQQYQDKSREYDQLYEEYTRTSQELQMKRTAIEAFNETIKIFEEQGQTQEKCSKEYLERFRREGNEKEMQRILLNSERLKSRIAEIHESRTKLEQQLRAQASDNREIDKRMNSLKPDLMQLRKIRDQYLVWLTQKGARQKKINEWLGIKNETEDQYALMEDEDDLPHHEERTWYVGKINRTQAEEMLSGKRDGTFLIRESSQRGCYACSVVKLRHCPRPLPLMQIQGFSSIMLGFDSVFP

SEQ ID NO: 839314 - protein, 297 aa, Homo sapiens
RPERVLSGGAAPAQSGPADGGVKGTLRSRAPRPRYISMNNLNDPPNWNIRPNSRADGGDGSRWNYALLVPMLGLAAFRWIWSRESQKEVEKEREAYRRRTAAFQQDLEAKYHAMISENRRAVAQLSLELEKEQNRTASYREALISQGRKLVEEKKLLEQERAQVMQEKRQVQPLRSAYLSCLQREENWQRRARLLLKEFEAVLTERQNIYCSLFLPRSKRLEIEKSLLVRASVDPVAADLEMAAGLTDIFQHDTYCGDVWNTNKRQNGRLMWLYLKYWELVVELKKFKRVEEAILEK

SEQ ID NO: 839315 - protein, 297 aa, Homo sapiens; identical to SEQ ID NO: 839314

SEQ ID NO: 839316 - protein, 302 aa, Homo sapiens
MATQAYTELQAAPPPSQPPQAPPQAQPQPPPPPPPAAPQPPQPPTAAATPQPQYVTELQSPQPQAQPPGGQKQYVTELPAVPAPSQPTGAPTPSPAPQQYIVVTVSEGAMRASETVSEASPGSTASQTGVPTQVVQQVQGTQQRLLVQTSVQAKPGHVSPLQLTNIQVPQQALPTQRLVVQSAAPGSKGGQVSLTVHGTQQVHSPPEQSPVQANSSSSKTAGAPTGTVPQQLQVHGVQQSVPVTQERSVVQATPQAPKPGPVQPLTVQGLQPVHVAQEVCVSPSYPTGKGAGPGLGLGSAGP

SEQ ID NO: 839317 - protein, 211 aa, Homo sapiens
PISLLQPLPTRSSQRHTHEACSCTLAKSTLVEVAQHLVDLCGVLQQQNSLEQWAAWLDGVVSQVLKPYQGSAGFPKAAKLFLLKWSFYSSMVIRDLTLRSAASFGSFHLIRLLYDEYMYYLIEHRVAQAKGETPIAVMGEFANLATSLNPLDPDKDEEEEEEEESEDELPQDISLAAGGESPALGPETLEPPAKLARTDARGLFVQALPSS

SEQ ID NO: 839318 - protein, 979 aa, Homo sapiens
MATQAYTELQAAPPPSQPPQAPPQAQPQPPPPPPPAAPQPPQPPTAAATPQPQYVTELQSPQPQAQPPGGQKQYVTELPAVPAPSQPTGAPTPSPAPQQYIVVTVSEGAMRASETVSEASPGSTASQTGVPTQVVQQVQGTQQRLLVQTSVQAKPGHVSPLQLTNIQVPQQALPTQRLVVQSAAPGSKGGQVSLTVHGTQQVHSPPEQSPVQANSSSSKTAGAPTGTVPQQLQVHGVQQSVPVTQERSVVQATPQAPKPGPVQPLTVQGLQPVHVAQEVQQLQQVPVPHVYSSQVQYVEGGDASYTASAIRSSTYSYPETPLYTQTASTSYYEAAGTATQVSTPATSQAVASSGSMPMYVSGSQVVASSTSTGAGASNSSGGGGSGGGGGGGGGGGGGGSGSTGGGGSGAGTYVIQGGYMLGSASQSYSHTTRASPATVQWLLDNYETAEGVSLPRSTLYCHYLLHCQEQKLEPVNAASFGKLIRSVFMGLRTRRLGTRGNSKYHYYGLRIKASSPLLRLMEDQQHMAMRGQPFSQKQRLKPIQKMEGMTNGVAVGQQPSTGLSDISAQVQQYQQFLDASRSLPDFTELDLQGKVLPEGVGPGDIKAFQVLYREHCEAIVDVMVNLQFTLVETLWKTFWRYNLSQPSEAPPLAVHDEAEKRLPKAILVLLSKFEPVLQWTKHCDNVLYQGLVEILIPDVLRPIPSALTQAIRNFAKSLESWLTHAMVNIPEEMLRVKVAAAGAFAQTLRRYTSLNHLAQAARAVLQNTAQINQMLSDLNRVDFANVQEQASWVCRCEDRVVQRLEQDFKVTLQQQNSLEQWAAWLDGVVSQVLKPYQGSAGFPKAAKLFLLKWSFYSSMVIRDLTLRSAASFGSFHLIRLLYDEYMYYLIEHRVAQAKGETPIAVMGEFANLATSLNPLDPDKDEEEEEEEESEDELPQDISLAAGGESPALGPETLEPPAKLARTDARGLFVQALPSS

SEQ ID NO: 839319 - protein, 360 aa, Homo sapiens
STWLTHAMVNIFEEMLRVKVPVTQAIRNFAKSLESWLTHAMVNIPEEMLRVKVPVTQAIRNFAKSLESWLTHAMVNIPEEMLRVKGALTQAIRNFAKSLESWLTHAMVNIPEEMLRVKVAAAGAFAQTLRRYTSLNHLAQAARAVLQNTAQINQMLSDLNRVDFANVQEQASWVCRCEDRVVQRLEQDFKVTLQQQNSLEQWAAWLDGVVSQVLKPYQGSAGFPKAAKLFLLKWSFYSSMVIRDLTLRSAASFGSFHLIRLLYDEYMYYLIEHRVAQAKGETPIAVMGEFANLATSLNPLDPDKDEEEEEEEESEDELPQDISLAAGGESPALGPETLEPPAKLARTDARGLFVQALPSS

SEQ ID NO: 839320 - protein, 658 aa, Homo sapiens
MEKASGRQSIALSTVETGTVNPGLELMEKEVEPEGSKRTDAQGHSLGDGLGPSTYQRRSRWPFSKARSFCKTHASLFKKILLGLLCLAYAAYLLAACILNFQRALALFVITCLVIFVLVHSFLKKLLGKKLTRCLKPFENSRLRLWTKWVFAGVSLVGLILWLALDTAQRPEQLIPFAGICMFILILFACSKHHSAVSWRTVFSGLGLQFVFGILVIRTDLGYTVFQWLGEQVQIFLNYTVAGSSFVFGDTLVKDVFAFQALPIIIFFGCVVSILYYLGLVQWVVQKVAWFLQITMGTTATETLAVAGNIFVGMTEAPLLIRPYLGDMTLSEIHAVMTGGFATISGTVLGAFIAFGVDASSLISASVMAAPCALASSKLAYPEVEESKFKSEEGVKLPRGKERNVLEAASNGAVDAIGLATNVAANLIAFLAVLAFINAALSWLGELVDIQGLTFQVICSYLLRPMVFMMGVEWTDCPMVAEMVGIKFFINEFVAYQQLSQYKNKRLSGMEEWIEGEKQWISVRAEIITTFSLCGFANLSSIGITLGGLTSIVPHRKSDLSKVVVRALFTGACVSLISACMAGILYVPRGAEADCVSFPNTSFTNRTYETYMCCRGLFQSTSLNGTNPPSFSGPWEDKEFSAMALTNCCGFYNNTVCA

SEQ ID NO: 839321 - protein, 553 aa, Homo sapiens
MEKASGRQSIALSTVETGTVNPGLELMEKEVEPEGSKRTDAQGHSLGDGLGPSTYQRRSRWPFSKARSFCKTHASLFKKILLGLLCLAYAAYLLAACILNFQRALALFVITCLVIFVLVHSFLKKLLGKKLTRCLKPFENSRLEALDEMVSWRTVFSGLGLQFVFGILVIRTDLGYTVFQWLGEQVQIFLNYTVAGSSFVFGDTLVKDVFAFQALPIIIFFGCVVSILYYLGLVQWVVQKVSVFFQVAWFLQITMGTTATETLAVAGNIFVGMTEAPLLIRPYLGDMTLSEIHAVMTGGFATISGTVLGAFIAFGVDASSLISASVMAAPCALASSKLAYPEVEESKFKSEEGVKLPRGKERNVLEAASNGAVDAIGLATNVAANLIAFLAVLAFINAALSWLGELVDIQGLTFQVICSYLLRPMVFMMGVEWTDCPMVAEMVGIKFFINEFVAYQQLSQYKNKRLSGMEEWIEGEKQWISVRAEIITTFSLCGFANLSSIGITLGGLTSIVPHRKSDLSKVVVRALFTGACVSLISACMAGRCLSSDGDTAA

SEQ ID NO: 839322 - protein, 658 aa, Homo sapiens; identical to SEQ ID NO: 839320

SEQ ID NO: 839323 - protein, 110 aa, Homo sapiens
CSDTSLYRQKQRPREGRETFKVTQHLWKSQLHGWASWPQARSCPLPAFLLLYSSDTLSALGPGRDAALKEAHILKFFCLCPSRVLASGFLEGPRSGRSFSLLFVPAQTYM

SEQ ID NO: 839324 - protein, 815 aa, Homo sapiens
CVSAFPPFLLFVSRFAWEAVPGFQGSTGSLMANATRRESEVDQKFQGSVSFKDVTVGFTQEEWQHLDPSQRALYRDVMLENYSNLVSVGYCAHKPEVIFRLEQGEEPWRLEEEFPSQSFPEVWTADHLKERSQENQSKHLWEVVFINNEMLTKEQGNVIGIPFNMDVSSFPSRKMFCQYDSCGMSFNTVSELVISKINYLGKKSDEFNACGKLLLNIKHDETHTREKNEVLKNRNTLSHRENTLQHEKIQTLDHNFEYSICQETLLEKAVFNTRKRENAEENNCDYNEFGRTFCDSSSLLFHQIPPSKDSHYEFSDCEKFLCVKSTLSKHDGVPVKHYDCGESGNNFRRKLCLSQLQKGDKGEKHFECNECGKAFWEKSHLTRHQRVHTGEKHFQCNQCGKTFWEKSNLTKHQRSHTGEKPFECNECGKAFSHKSALTLHQRTHTGEKPYQCNACGKTFYQKSDLTKHQRTHTGQKPYECYECGKSFCMNSHLTVHQRTHTGEKPFECLECGKSFCQKSHLTQHQRTHIGDKPYECNACGKTFYHKSVLTRHQIIHTGLKPYECYECGKTFCLKSDLTIHQRTHTGEKPFACPECGKFFSHKSTLSQHYRTHTGEKPYECHECGKIFYNKSYLTKHNRTHTGEKPYECNECGKTFCQKSQLTQHQRIHIGEKPYECNECGKAFCHKSALIVHQRTHTQEKPYKCNECGKSFCVKSGLILHERKHTGEKPYECNECGKSFSHKSSLTVHHRAHTGEKSCQCNECGKIFYRKSDLAKHQRSHTGEKPYECNTCRKTFSQKSNLIVHQRTHIGEKPYE

SEQ ID NO: 839325 - protein, 131 aa, Homo sapiens [sequence omitted]

SEQ ID NO: 839326 - protein, 371 aa, Homo sapiens
TGEKPHKCEVCGMAFHHSSVLRQHKRTHTGQKPYECYECGKSFCMNSHLTVHQRTHTGEKPFECLECGKSFCQKSHLTQHQRTHIGDKPYECNACGKTFYHKSVLTRHQIIHTGLKPYECYECGKTFCLKSDLTIHQRTHTGEKPFACPECGKFFSHKSTLSQHYRTHTGEKPYECHECGKIFYNKSYLTKHNRTHTGEKPYECNECGKTFCQKSQLTQHQRIHIGEKPYECNECGKAFCHKSALIVHQRTHTQEKPYKCNECGKSFCVKSGLILHERKHTGEKPYECNECGKSFSHKSSLTVHHRAHTGEKSCQCNECGKIFYRKSDLAKHQRSHTGEKPYECNTCRKTFSQKSNLIVHQRTHIGEKPYE

SEQ ID NO: 839327 - protein, 116 aa, Homo sapiens
MNKVDQKFQGSVSFKDVTVGFTQEEWQHLDPSQRALYRDVMLENYSNLVSVGYCAHKPEVIFRLEQGEEPWRLEEEFPSQSFPGSSWLWWFPRLSLFWMTLTVWRNPGEKSGQLIT

SEQ ID NO: 839328 - protein, 116 aa, Homo sapiens; identical to SEQ ID NO: 839327

SEQ ID NO: 839329 - protein, 778 aa, Homo sapiens [sequence omitted]

SEQ ID NO: 839330 - protein, 804 aa, Homo sapiens
MNKVDQKFQGSVSFKDVTVGFTQEEWQHLDPSQRALYRDVMLENYSNLVSVGYCAHKPEVIFRLEQGEEPWRLEEEFPSQSFPGSSWLWWFPRLSLFWMTLTVWRNPGEEVWTADHLKERSQENQSKHLWEVVFINNEMLTKEQGNVIGIPFNMDVSSFPSRKMFCQYDSCGMSFNTVSELVISKINYLGKKSDEFNACGKLLLNIKHDETHTREKNEVLKNRNTLSHRENTLQHEKIQTLDHNFEYSICQETLLEKAVFNTRKRENAEENNCDYNEFGRTFCDSSSLLFHQIPPSKDSHYEFSDCEKFLCVKSTLSKHDGVPVKHYDCGESGNNFRRKLCLSQLQKGDKGEKHFECNECGKAFWEKSHLTRHQRVHTGEKHFQCNQCGKTFWEKSNLTKHQRSHTGEKPFECNECGKAFSHKSALTLHQRTHTGEKPYQCNACGKTFYQKSDLTKHQRTHTGQKPYECYECGKSFCMNSHLTVHQRTHTGEKPFECLECGKSFCQKSHLTQHQRTHIGDKPYECNACGKTFYHKSVLTRHQIIHTGLKPYECYECGKTFCLKSDLTIHQRTHTGEKPFACPECGKFFSHKSTLSQHYRTHTGEKPYECHECGKIFYNKSYLTKHNRTHTGEKPYECNECGKTFCQKSQLTQHQRIHIGEKPYECNECGKAFCHKSALIVHQRTHTQEKPYKCNECGKSFCVKSGLILHERKHTGEKPYECNECGKSFSHKSSLTVHHRAHTGEKSCQCNECGKIFYRKSDLAKHQRSHTGEKPYECNTCRKTFSQKSNLIVHQRTHIGEKPYE

SEQ ID NO: 839331 - protein, 778 aa, Homo sapiens [sequence omitted]

SEQ ID NO: 839332 - protein, 120 aa, Homo sapiens
MNKVDQKFQGSVSFKDVTVGFTQEEWQHLDPSQRALYRDVMLENYSNLVSVGYCAHKPEVIFRLEQGEEPWRLEEEFPSQSFPEVWTADHLKERSQENQSKHLWEVVFINNEMLTKEQGP

SEQ ID NO: 839333 - protein, 81 aa, Homo sapiens
HLKTAMSNMPAVFQRNLKGDRDRIRLIAKTHDRREHAQAIPVPHLLPPTPPSVPITCAQESAACRVTKTSGMFLHTLLLWL

SEQ ID NO: 839334 - protein, 103 aa, Homo sapiens
MTKGALSASVNSLLYKGRRRGTEWQHLASLGCCVKERCQAFLICHCRGKGVIYVGLFEGCIPSEVFHQTAIIHLDESLRNFRRRETSRPPGFWFLNDMKRILC

SEQ ID NO: 839335 - protein, 1498 aa, Homo sapiens
MKSEKVPSSPAEAEKGPSLLLKDMRQKTELQQIGKKIPSSFTSVDKVNIEAVGGEKCALQNSPRSQKQQTCTDNTGDSDDSASGIEDVSDDLSKMKNDESNKENSSEMDYLENATVIDESALTPEQRLGLKQAEERLERDHIFRLEKRSPEYTNCRYLCKLCLIHIENIQGAHKHIKEKRHKKNILEKQEESELRSLPPPSPAHLAALSVAVIELAKEHGITDDDLRVRQEIVEEMSKVITTFLPECSLRLYGSSLTRFALKSSDVNIDIKFPPKMNHPDLLIKVLGILKKNVLYVDVESDFHAKVPVVVCRDRKSGLLCRVSAGNDMACLTTDLLTALGKIEPVFIPLVLAFRYWAKLCYIDSQTDGGIPSYCFALMVMFFLQQRKPPLLPCLLGSWIEGFDPKRMDDFQLKGIVEEKFVKWECNSSSATEKNSIAEENKAKADQPKDDTKKTETDNQSNAMKEKHGKSPLALETPNRVSLGQLWLELLKFYTLDFALEEYVICVRIQDILTRENKNWPKRRIAIEDPFSVKRNVARSLNSQLVYEYVVERFRAAYRYFACPQTKGGNKSTVDFKKREKGKISNKKPVKSNNMATNGCILLGETTEKINAEREQPVQCDEMDCTSQRCIIDNNNLLVNELDFADHGQDSSSLSTSKSSEIEPKLDKKQDDLAPSETCLKKELSQCNCIDLSKSPDPDKSTGTDCRSNLETESSHQSVCTDTSATSCNCKATEDASDLNDDDNLPTQELYYVFDKFILTSGKPPTIVCSICKKDGHSKNDCPEDFRKIDLKPLPPMTNRFREILDLVCKRCFDELSPPCSEQHNREQILIGLEKFIQKEYDEKARLCLFGSSKNGFGFRDSDLDICMTLEGHENAEKLNCKEIIENLAKILKRHPGLRNILPITTAKVPIVKFEHRRSGLEGDISLYNTLAQHNTRMLATYAAIDPRVQYLGYTMKVFAKRCDIGDASRGSLSSYAYILMVLYFLQQRKPPVIPVLQEIFDGKQIPQRMVDGWNAFFFDKTEELKKRLPSLGKNTESLGELWLGLLRFYTEEFDFKEYVISIRQKKLLTTFEKQWTSKCIAIEDPFDLNHNLGAGVSRKMTNFIMKAFINGRKLFGTPFYPLIGREAEYFFDSRVLTDGELAPNDRCCRVCGKIGHYMKDCPKRKSSLLFRLKKKDSEEEKEGNEEEKDSRDVLDPRDLHDTRDFRDPRDLRCFICGDAGHVRRECPEVKLARQRNSSVAAAQLVRNLVNAQQVAGSAQQQGDQSIRTRQSSECSESPSYSPQPQPFPQNSSQSAAITQPSSQPGSQPKLGPPQQGAQPPHQVQMPLYNFPQSPPAQYSPMHNMGLLPMHPLQIPAPSWPIHGPVIHSAPGSAPSNIGLNDPSIIFAQPAARPVAIPNTSHDGHWPRTVAPNSLVNSGAVGNSEPGFRGLTPPIPWEHAPRPHFPLVPASWPYGLHQNFMHQGNARFQPNKPFYTQDRCATRRCRERCPHPPRGNVSE

SEQ ID NO: 839336 - protein, 821 aa, Homo sapiens
MKSEKVPSSPAEAEKGPSLLLKDMRQKTELQQIGKKIPSSFTSVDKVNIEAVGGEKCALQNSPRSQKQQTCTDNTGDSDDSASGIEDVSDDLSKMKNDESNKENSSEMDYLENATVIDESALTPEQRLGLKQAEERLERDHIFRLEKRSPEYTNCRYLCKLCLIHIENIQGAHKHIKEKRHKKNILEKQEESELRSLPPPSPAHLAALSVAVIELAKEHGITDDDLRVRQEIVEEMSKVITTFLPECSLRLYGSSLTRFALKSSDVNIDIKFPPKMNHPDLLIKVLGILKKNVLYVDVESDFHAKVPVVVCRDRKSGLLCRVSAGNDMACLTTDLLTALGKIEPVFIPLVLAFRYWAKLCYIDSQTDGGIPSYCFALMVMFFLQQRKPPLLPCLLGSWSPLALETPNRVSLGQLWLELLKFYTLDFALEEYVICVRIQDILTRENKNWPKRRIAIEDPFSVKRNVARSLNSQLVYEYVVERFRAAYRYFACPQTKGGNKSTVDFKKREKGKISNKKPVKSNNMATNGCILLGETTEKINAEREQPVQCDEMDCTSQRCIIDNNNLLVNELDFADHGQDSSSLSTSKSSEIEPKLDKKQDDLAPSETCLKKELSQCNCIDLSKSPDPDKSTGTDCRSNLETESSHQSVCTDTSATSCNCKATEDASDLNDDDNLPTQELYYVFDKFILTSGKPPTIVCSICKKDGHSKNDCPEDFRKIDLKPLPPMTNRFREILDLVCKRCFDELSPPCSEQHNREQILIGLEKFIQKEYDEKARLCLFGSSKNGFGFRDSDLDICMTLEGHENAEALIVGGDCPSSREEKD

SEQ ID NO: 839337 - protein, 848 aa, Homo sapiens
MKSEKVPSSPAEAEKGPSLLLKDMRQKTELQQIGKKIPSSFTSVDKVNIEAVGGEKCALQNSPRSQKQQTCTDNTGDSDDSASGIEDVSDDLSKMKNDESNKENSSEMDYLENATVIDESALTPEQRLGLKQAEERLERDHIFRLEKRSPEYTNCRYLCKLCLIHIENIQGAHKHIKEKRHKKNILNVHLGCMAPSLTRFALKSSDVNIDIKFPPKMNHPDLLIKVLGILKKNVLYVDVESDFHAKVPVVVCRDRKSGLLCRVSAGNDMACLTTDLLTALGKIEPVFIPLVLAFRYWAKLCYIDSQTDGGIPSYCFALMVMFFLQQRKPPLLPCLLGSWIEGFDPKRMDDFQLKGIVEEKFVKWECNSSSATEKNSIAEENKAKADQPKDDTKKTETDNQSNAMKEKHGKSPLALETPNRVSLGQLWLELLKFYTLDFALEEYVICVRIQDILTRENKNWPKRRIAIEDPFSVKRNVARSLNSQLVYEYVVERFRAAYRYFACPQTKGGNKSTVDFKKREKGKISNKKPVKSNNMATNGCILLGETTEKINAEREQPVQCDEMDCTSQRCIIDNNNLLVNELDFADHGQDSSSLSTSKSSEIEPKLDKKQDDLAPSETCLKKELSQCNCIDLSKSPDPDKSTGTDCRSNLETESSHQSVCTDTSATSCNCKATEDASDLNDDDNLPTQELYYVFDKFILTSGKPPTIVCSICKKDGHSKNDCPEDFRKIDLKPLPPMTNRFREILDLVCKRCFDELSPPCSEQHNREQILIGLEKFIQKEYDEKARLCLFGSSKNGFGFRDSDLDICMTLEGHENAEALIVGRRLSKLQGRKRLIGQGRSVPGLLNSN

SEQ ID NO: 839338 - protein, 657 aa, Homo sapiens
MSKVITTFLPECSLRLYGSSLTRFALKSSDVNIDIKFPPKMNHPDLLIKVLGILKKNVLYVDVESDFHAKVPVVVCRDRKSGLLCRVSAGNDMACLTTDLLTALGKIEPVFIPLVLAFRYWAKLCYIDSQTDGGIPSYCFALMVMFFLQQRKPPLLPCLLGSWIEGFDPKRMDDFQLKGIVEEKFVKWECNSSSATEKNSIAEENKAKADQPKDDTKKTETDNQSNAMKEKHGKSPLALETPNRVSLGQLWLELLKFYTLDFALEEYVICVRIQDILTRENKNWPKRRIAIEDPFSVKRNVARSLNSQLVYEYVVERFRAAYRYFACPQTKGGNKSTVDFKKREKGKISNKKPVKSNNMATNGCILLGETTEKINAEREQPVQCDEMDCTSQRCIIDNNNLLVNELDFADHGQDSSSLSTSKSSEIEPKLDKKQDDLAPSETCLKKELSQCNCIDLSKSPDPDKSTGTDCRSNLETESSHQSVCTDTSATSCNCKATEDASDLNDDDNLPTQELYYVFDKFILTSGKPPTIVCSICKKDGHSKNDCPEDFRKIDLKPLPPMTNRFREILDLVCKRCFDELSPPCSEQHNREQILIGLEKFIQKEYDEKARLCLFGSSKNGFGFRDSDLDICMTLEGHENAEALIVGGDCPSSREEKD

SEQ ID NO: 839339 - protein, 531 aa, Homo sapiens
SHPRLLPYTRVNPSSSLLLWSRIEGFDPKRMDDFQLKGIVEEKFVKWECNSSSATEKNSIAEENKAKADQPKDDTKKTETDNQSNAMKEKHGKSPLALETPNRVSLGQLWLELLKFYTLDFALEEYVICVRIQDILTRENKNWPKRRIAIEDPFSVKRNVARSLNSQLVYEYVVERFRAAYRYFACPQTKGGNKSTVDFKKREKGKISNKKPVKSNNMATNGCILLGETTEKINAEREQPVQCDEMDCTSQRCIIDNNNLLVNELDFADHGQDSSSLSTSKSSEIEPKLDKKQDDLAPSETCLKKELSQCNCIDLSKSPDPDKSTGTDCRSNLETESSHQSVCTDTSATSCNCKATEDASDLNDDDNLPTQELYYVFDKFILTSGKPPTIVCSICKKDGHSKNDCPEDFRKIDLKPLPPMTNRFREILDLVCKRCFDELSPPCSEQHNREQILIGLEKFIQKEYDEKARLCLFGSSKNGFGFRDSDLDICMTLEGHENAEALIVGRRLSKLQGRKRLIGQGRSVPGLLNSN

SEQ ID NO: 839340 - protein, 848 aa, Homo sapiens; identical to SEQ ID NO: 839337

SEQ ID NO: 839341 - protein, 848 aa, Homo sapiens; identical to SEQ ID NO: 839337

SEQ ID NO: 839342 - protein, 848 aa, Homo sapiens; identical to SEQ ID NO: 839337

SEQ ID NO: 839343 - protein, 848 aa, Homo sapiens; identical to SEQ ID NO: 839337

SEQ ID NO: 839344 - protein, 519 aa, Homo sapiens
MVLYFLQQRKPPVIPVLQEIFDGKQIPQRMVDGWNAFFFDKTEELKKRLPSLGKNTESLGELWLGLLRFYTEEFDFKEYVISIRQKKLLTTFEKQWTSKCIAIEDPFDLNHNLGAGVSRKMTNFIMKAFINGRKLFGTPFYPLIGREAEYFFDSRVLTDGELAPNDRCCRVCGKIGHYMKDCPKRKSSLLFRLKKKDSEEEKEGNEEEKDSRDVLDPRDLHDTRDFRDPRDLRCFICGDAGHVRRECPEVKLARQRNSSVAAAQLVRNLVNAQQVAGSAQQQGDQSIRTRQSSECSESPSYSPQPQPFPQNSSQSAAITQPSSQPGSQPKLGPPQQGAQPPHQVQMPLYNFPQSPPAQYSPMHNMGLLPMHPLQIPAPSWPIHGPVIHSAPGSAPSNIGLNDPSIIFAQPAARPVAIPNTSHDGHWPRTVAPNSLVNSGAVGNSEPGFRGLTPPIPWEHAPRPHFPLVPASWPYGLHQNFMHQGNARFQPNKPFYTQDRCATRRCRERCPHPPRGNVSE

SEQ ID NO: 839345 - protein, 110 aa, Homo sapiens
SSEIEPKLDKKQDDLAPSETCLKKELSQCNCIDLSKSPDPDKSTGTDCRSNLETESSHQSVCTDTSATSCNCKATEDASDLNDDDNLPTQELYYVFDKFILTSGKVGYSL

SEQ ID NO: 839346 - protein, 48 aa, Homo sapiens
MFYMWRCWTCKRLKKKDSEEEKDGNEEEKDSRDVLDPRDLHDTRDFRD

SEQ ID NO: 839347 - protein, 848 aa, Homo sapiens; identical to SEQ ID NO: 839337

SEQ ID NO: 839348 - protein, 848 aa, Homo sapiens; identical to SEQ ID NO: 839337

SEQ ID NO: 839349 - protein, 848 aa, Homo sapiens; identical to SEQ ID NO: 839337

SEQ ID NO: 839350 - protein, 848 aa, Homo sapiens; identical to SEQ ID NO: 839337

SEQ ID NO: 839351 - protein, 848 aa, Homo sapiens; identical to SEQ ID NO: 839337

SEQ ID NO: 839352 - protein, 562 aa, Homo sapiens
MLATYAAIDPRVQYLGYTMKVFAKRCDIGDASRGSLSSYAYILMVLYFLQQRKPPVIPVLQEIFDGKQIPQRMVDGWNAFFFDKTEELKKRLPSLGKNTESLGELWLGLLRFYTEEFDFKEYVISIRQKKLLTTFEKQWTSKCIAIEDPFDLNHNLGAGVSRKMTNFIMKAFINGRKLFGTPFYPLIGREAEYFFDSRVLTDGELAPNDRCCRVCGKIGHYMKDCPKRKSSLLFRLKKKDSEEEKEGNEEEKDSRDVLDPRDLHDTRDFRDPRDLRCFICGDAGHVRRECPEVKLARQRNSSVAAAQLVRNLVNAQQVAGSAQQQGDQSIRTRQSSECSESPSYSPQPQPFPQNSSQSAAITQPSSQPGSQPKLGPPQQGAQPPHQVQMPLYNFPQSPPAQYSPMHNMGLLPMHPLQIPAPSWPIHGPVIHSAPGSAPSNIGLNDPSIIFAQPAARPVAIPNTSHDGHWPRTVAPNSLVNSGAVGNSEPGFRGLTPPIPWEHAPRPHFPLVPASWPYGLHQNFMHQGNARFQPNKPFYTQDRCATRRCRERCPHPPRGNVSE

SEQ ID NO: 839353 - protein, 848 aa, Homo sapiens; identical to SEQ ID NO: 839337

SEQ ID NO: 839354 - protein, 97 aa, Homo sapiens
AYGHKCTKVIPKRCQSGGNPGHLENAITISDQEDHRYEGKSKEPLQDNVIATYEEHEDSVYAVDWSSADPWLFASLSYDGRLVINRVPRALKYHILL

SEQ ID NO: 839355 - protein, 107 aa, Homo sapiens
MEDDAPVIYGLEFQARALTPQTAETDAIRFLVGTQSLKYDNQIHIIDFDDENNIINKNVLLHQAGEIWHISASPADRGVLTTCYNRTFRQQSSLVLVVSLLLCSVCP

SEQ ID NO: 839356 - protein, 119 aa, Homo sapiens [sequence omitted]

SEQ ID NO: 839357 - protein, 414 aa, Homo sapiens
MEDDAPVIYGLEFQARALTPQTAETDAIRFLVGTQSLKYDNQIHIIDFDDENNIINKNVLLHQAGEIWHISASPADRGVLTTCYNRTFCCVLSLDSFGALGKSAAQLFIALATSSDSKVLTCAAVWRMPKELESGSHESPDDSSSTAQTLELLCHLDNTAHGNMACVVWEPMGDGKKIISLADNHILLWDLQESSSQAVLASSASLEGKGQLKFTSGRWSPHHNCTQVATANDTTLRGWDTRSMSQIYCIENAHGQLVRDLDFNPNKQYYLASCGDDCKVKFWDTRNVTEPVKTLEEHSHWVWNVRYNHSHDQLVLTGSSDSRVILSNMVSISSEPFGHLVDDDDISDQEDHRSEEKSKEPLQDNVIATYEEHEDSVYAVDWSSADPWLFASLSYDGRLVINRVPRALKYHILL

SEQ ID NO: 839358 - protein, 243 aa, Homo sapiens
MGDGKKIISLADNHILLWDLQESSSQAVLASSASLEGKGQLKFTSGRWSPHHNCTQVATANDTTLRGWDTRSMSQIYCIENAHGQLVRDLDFNPNKQYYLASCGDDCKVKFWDTRNVTEPVKTLEEHSHWVWNVRYNHSHDQLVLTGSSDSRVILSNMVSISSEPFGHLVDDDDISDQEDHRSEEKSKEPLQDNVIATYEEHEDSVYAVDWSSADPWLFASLSYDGRLVINRVPRALKYHILL

SEQ ID NO: 839359 - protein, 287 aa, Homo sapiens
MPKELESGSHESPDDSSSTAQTLELLCHLDNTAHGNMACVVWEPMGDGKKIISLADNHILLWDLQESSSQAVLASSASLEGKGQLKFTSGRWSPHHNCTQVATANDTTLRGWDTRSMSQIYCIENAHGQLVRDLDFNPNKQYYLASCGDDCKVKFWDTRNVTEPVKTLEEHSHWVWNVRYNHSHDQLVLTGSSDSRVILSNMVSISSEPFGHLVDDDDISDQEDHRSEEKSKEPLQDNVIATYEEHEDSVYAVDWSSADPWLFASLSYDGRLVINRVPRALKYHILL

SEQ ID NO: 839360 - protein, 299 aa, Homo sapiens
LYGSAEVRILIPIPSASSTRLHMSPDDSSSTAQTLELLCHLDNTAHGNMACVVWEPMGDGKKIISLADNHILLWDLQESSSQAVLASSASLEGKGQLKFTSGRWSPHHNCTQVATANDTTLRGWDTRSMSQIYCIENAHGQLVRDLDFNPNKQYYLASCGDDCKVKFWDTRNVTEPVKTLEEHSHWVWNVRYNHSHDQLVLTGSSDSRVILSNMVSISSEPFGHLVDDDDISDQEDHRSEEKSKEPLQDNVIATYEEHEDSVYAVDWSSADPWLFASLSYDGRLVINRVPRALKYHILL

SEQ ID NO: 839361 - protein, 243 aa, Homo sapiens; identical to SEQ ID NO: 839358

SEQ ID NO: 839362 - protein, 171 aa, Homo sapiens
MSQIYCIENAHGQLVRDLDFNPNKQYYLASCGDDCKVKFWDTRNVTEPVKTLEEHSHWVWNVRYNHSHDQLVLTGSSDSRVILSNMVSISSEPFGHLVDDDDISDQEDHRSEEKSKEPLQDNVIATYEEHEDSVYAVDWSSADPWLFASLSYDGRLVINRVPRALKYHILL

SEQ ID NO: 839363 - protein, 236 aa, Homo sapiens
MEDDAPVIYGLEFQESSSQAVLASSASLEGKGQLKFTSGRWSPHHNCTQVATANDTTLRGWDTRSMSQIYCIENAHGQLVRDLDFNPNKQYYLASCGDDCKVKFWDTRNVTEPVKTLEEHSHWVWNVRYNHSHDQLVLTGSSDSRVILSNMVSISSEPFGHLVDDDDISDQEDHRSEEKSKEPLQDNVIATYEEHEDSVYAVDWSSADPWLFASLSYDGRLVINRVPRALKYHILL

SEQ ID NO: 839364 - protein, 267 aa, Homo sapiens
MIPSHIFDGYKAKIPSTARPEGHRYASGEMSVVRPHRVLGWRRWRQPLPAGQERRGDESTLGRGIRQGPGKPVCARSTQWLFLIHLLFSFAVLPSPSAQIYCIENAHGQLVRDLDFNPNKQYYLASCGDDCKVKFWDTRNVTEPVKTLEEHSHWVWNVRYNHSHDQLVLTGSSDSRVILSNMVSISSEPFGHLVDDDDISDQEDHRSEEKSKEPLQDNVIATYEEHEDSVYAVDWSSADPWLFASLSYDGRLVINRVPRALKYHILL

SEQ ID NO: 839365 - protein, 115 aa, Homo sapiens
MKNMYHSSYLPAWVSQMFMLTFGTSLSLSVVWEPMGDGKKIISLADNHILLWDLQESSSQAVVSKSNNTAFVSVFLNQTPHVLTHRWELNNEITWTQGGEHHTPGPVVGLGEREG

SEQ ID NO: 839366 - protein, 387 aa, Homo sapiens
MEDDAPVIYGLEFQARALTPQTAETDAIRFLVGTQSLKYDNQIHIIDFDDENNIINKNVLLHQAGEIWHISASPADRGVLTTCYNRTSDSKVLTCAAVWRMPKELESGSHESPDDSSSTAQTLELLCHLDNTAHGNMACVVWEPMGDGKKIISLADNHILLWDLQESSSQAVLASSASLEGKGQLKFTSGRWSPHHNCTQVATANDTTLRGWDTRSMSQIYCIENAHGQLVRDLDFNPNKQYYLASCGDDCKVKFWDTRNVTEPVKTLEEHSHWVWNVRYNHSHDQLVLTGSSDSRVILSNMVSISSEPFGHLVDDDDISDQEDHRSEEKSKEPLQDNVIATYEEHEDSVYAVDWSSADPWLFASLSYDGRLVINRVPRALKYHILL

SEQ ID NO: 839367 - protein, 256 aa, Homo sapiens
MEDDAPVIYGLEFQARALTPQTAETDAIRFLVGTQSLKYDNQIHIIDFDDENNIINKNVLLHQAGEIWHISASPADRGVLTTCYNRTSDSKVLTCAAVWRMPKELESGSHESPDDSSSTAQTLELLCHLDNTAHGNMACVVWEPMGDGKKIISLADNHILLWDLQESSSQAVREESEHSEGACTDPVCAIIPRLEALWGRGTLESGNRDGPRHLHLPRASLTEGGPATSLTQGRRTRHGPHSQKDPPRASRMEEGP

SEQ ID NO: 839368 - protein, 394 aa, Homo sapiens
MEDDAPVIYGLEFQARALTPQTAETDAIRFLVGTQSLKYDNQIHIIDFDDENNIINKNVLLHQAGEIWHISASPADRGVLTTCYNRTSDSKVLTCAAVWRMPKELESGSHESPDDSSSTAQTLELLCHLDNTAHGNMACVVWEPMGDGKKIISLADNHILLWDLQESSSQAVENIVTPQLASSASLEGKGQLKFTSGRWSPHHNCTQVATANDTTLRGWDTRSMSQIYCIENAHGQLVRDLDFNPNKQYYLASCGDDCKVKFWDTRNVTEPVKTLEEHSHWVWNVRYNHSHDQLVLTGSSDSRVILSNMVSISSEPFGHLVDDDDISDQEDHRSEEKSKEPLQDNVIATYEEHEDSVYAVDWSSADPWLFASLSYDGRLVINRVPRALKYHILL

SEQ ID NO: 839369 - protein, 366 aa, Homo sapiens
MEDDAPVIYGLEFQARALTPQTAETDAIRFLVGTQSLKYDNQIHIIDFDDENNIINKNVLLHQAGEIWHISASPADRGVLTTCYNRTSDSKVLTCAAVWRMPKELESGSHESPDDSSSTAQTLELLCHLDNTAHGNMACVVWEPMGDGKKIISLADNHILLWDLQESSSQAVLASSASLEGKGQLKFTSGRWSPHHNQIYCIENAHGQLVRDLDFNPNKQYYLASCGDDCKVKFWDTRNVTEPVKTLEEHSHWVWNVRYNHSHDQLVLTGSSDSRVILSNMVSISSEPFGHLVDDDDISDQEDHRSEEKSKEPLQDNVIATYEEHEDSVYAVDWSSADPWLFASLSYDGRLVINRVPRALKYHILL

SEQ ID NO: 839370 - protein, 341 aa, Homo sapiens
MEDDAPVIYGLEFQARALTPQTAETDAIRFLVGTQSLKYDNQIHIIDFDDENNIINKNVLLHQAGEIWHISASPADRGVLTTCYNRSKCGFSNVVWEPMGDGKKIISLADNHILLWDLQESSSQAVLASSASLEGKGQLKFTSGRWSPHHNCTQVATANDTTLRGWDTRSMSQIYCIENAHGQLVRDLDFNPNKQYYLASCGDDCKVKFWDTRNVTEPVKTLEEHSHWVWNVRYNHSHDQLVLTGSSDSRVILSNMVSISSEPFGHLVDDDDISDQEDHRSEEKSKEPLQDNVIATYEEHEDSVYAVDWSSADPWLFASLSYDGRLVINRVPRALKYHILL

SEQ ID NO: 839371 - protein, 243 aa, Homo sapiens; identical to SEQ ID NO: 839358

SEQ ID NO: 839372 - protein, 277 aa, Homo sapiens
MKNMYHSSYLPAWVSQMFMLTFGTSLSLSVVWEPMGDGKKIISLADNHILLWDLQESSSQAVLASSASLEGKGQLKFTSGRWSPHHNCTQVATANDTTLRGWDTRSMSQIYCIENAHGQLVRDLDFNPNKQYYLASCGDDCKVKFWDTRNVTEPVKTLEEHSHWVWNVRYNHSHDQLVLTGSSDSRVILSNMVSISSEPFGHLVDDDDISDQEDHRSEEKSKEPLQDNVIATYEEHEDSVYAVDWSSADPWLFASLSYDGRLVINRVPRALKYHILL

SEQ ID NO: 839373 - protein, 171 aa, Homo sapiens; identical to SEQ ID NO: 839362

SEQ ID NO: 839374 - protein, 282 aa, Homo sapiens
MEDDAPVIYGLEFQARALTPQTAETDAIRFLVGTQSLKYDNQIHIIDFDDENNIINKNVLLHQAGEIWHISASPADRGVLTTCYNRTSDSKVLTCAAVWRMPKELESGSHESPDDSSSTAQTLELLCHLDNTAHGNMACVVWEPMGDGKKIISLADNHILLWDLQESSSQAVLASSASLEGKGQLKFTSGRWSPHHNCTQVATANDTTLRGWDTRSMSQIYCIENAHGQLVRDLDFNPNKQYYLASCGDDCKVKFWDTRNVTEPVKTLEEHSHWLGRSWLLQ

SEQ ID NO: 839375 - protein, 1258 aa, Homo sapiens
MPEQERQITAREGASRKILSKLSLPTRAWEPAMKKSFAFDNVGYEGGLDGLGPSSQVATSTVRILGMTCQSCVKSIEDRISNLKGIISMKVSLEQGSATVKYVPSVVCLQQVCHQIGDMGFEASIAEGKAASWPSRSLPAQEAVVKLRVEGMTCQSCVSSIEGKVRKLQGVVRVKVSLSNQEAVITYQPYLIQPEDLRDHVNDMGFEAAIKSKVAPLSLGPIDIERLQSTNPKRPLSSANQNFNNSETLGHQGSHVVTLQLRIDGMHCKSCVLNIEENIGQLLGVQSIQVSLENKTAQVKYDPSCTSPVALQRAIEALPPGNFKVSLPDGAEGSGTDHRSSSSHSPGSPPRNQVQGTCSTTLIAIAGMTCASCVHSIEGMISQLEGVQQISVSLAEGTATVLYNPSVISPEELRAAIEDMGFEASVVSESCSTNPLGNHSAGNSMVQTTDGTPTSVQEVAPHTGRLPANHAPDILAKSPQSTRAVAPQKCFLQIKGMTCASCVSNIERNLQKEAGVLSVLVALMAGKAEIKYDPEVIQPLEIAQFIQDLGFEAAVMEDYAGSDGNIELTITGMTCASCVHNIESKLTRTNGITYASVALATSKALVKFDPEIIGPRDIIKIIESKTSEALAKLMSLQATEATVVTLGEDNLIIREEQVPMELVQRGDIVKVVPGGKFPVDGKVLEGNTMADESLITGEAMPVTKKPGSTVIARSINAHGSVLIKATHVGNDTTLAQIVKLVEEAQMSKNPNKHISQTEVIIRFAFQTSITVLCIACPCSLGLATPTAVMVGTGVAAQNGILIKGGKPLEMAHKIKTVMFDKTGTITHGVPRVMRVLLLGDVATLPLRKVLAVVGTAEASSEHPLGVAVTKYCKEELGTETLGYCTDFQAVPGCGIGCKVSNVEGILAHSERPLSAPASHLNEAGSLPAEKDAVPQTFSVLIGNREWLRRNGLTISSDVSDAMTDHEMKGQTAILVAIDGVLCGMIAIADAVKQEAALAVHTLQSMGVDVVLITGDNRKTARAIATQVGINKVFAEVLPSHKVAKVQELQNKGKKVAMVGDGVNDSPALAQADMGVAIGTGTDVAIEAADVVLIRNDLLDVVASIHLSKRTVRRIRINLVLALIYNLVGIPIAAGVFMPIGIVLQPWMGSAAMAASSVSVVLSSLQLKCYKKPDLERYEAQAHGHMKPLTASQVSVHIGMDDRWRDSPRATPWDQVSYVSQVSLSSLTSDKPSRHSAAADDDGDKWSLLLNGRDEEQYI

SEQ ID NO: 839376 - protein, 1374 aa, Homo sapiens
MPEQERQITAREGASRKILSKLSLPTRAWEPAMKKSFAFDNVGYEGGLDGLGPSSQVATSTVRILGMTCQSCVKSIEDRISNLKGIISMKVSLEQGSATVKYVPSVVCLQQVCHQIGDMGFEASIAEGKAASWPSRSLPAQEAVVKLRVEGMTCQSCVSSIEGKVRKLQGVVRVKVSLSNQEAVITYQPYLIQPEDLRDHVNDMGFEAAIKSKVAPLSLGPIDIERLQSTNPKRPLSSANQNFNNSETLGHQGSHVVTLQLRIDGMHCKSCVLNIEENIGQLLGVQSIQVSLENKTAQVKYDPSCTSPVALQRAIEALPPGNFKVSLPDGAEGSGTDHRSSSSHSPGSPPRNQVQGTCSTTLIAIAGMTCASCVHSIEGMISQLEGVQQISVSLAEGTATVLYNPSVISPEELRAAIEDMGFEASVVSESCSTNPLGNHSAGNSMVQTTDGTPTSVQEVAPHTGRLPANHAPDILAKSPQSTRAVAPQKCFLQIKGMTCASCVSNIERNLQKEAGVLSVLVALMAGKAEIKYDPEVIQPLEIAQFIQDLGFEAAVMEDYAGSDGNIELTITGMTCASCVHNIESKLTRTNGITYASVALATSKALVKFDPEIIGPRDIIKIIEEIGFHASLAQRNPNAHHLDHKMEIKQWKKSFLCSLVFGIPVMALMIYMLIPSNEPHQSMVLDHNIIPGLSILNLIFFILCTFVQLLGGWYFYVQAYKSLRHRSANMDVLIVLATSIAYVYSLVILVVAVAEKAERSPVTFFDTPPMLFVFIALGRWLEHLAKSKTSEALAKLMSLQATEATVVTLGEDNLIIREEQVPMELVQRGDIVKVVPGGKFPVDGKVLEGNTMADESLITGEAMPVTKKPGSTVIARSINAHGSVLIKATHVGNDTTLAQIVKLVEEAQMSKAPIQQLADRFSGYFVPFIIIMSTLTLVVWIVIGFIDFGVVQKYFPNPNKHISQTEVIIRFAFQTSITVLCIACPCSLGLATPTAVMVGTGVAAQNGILIKGGKPLEMAHKIKTVMFDKTGTITHGVPRVMRVLLLGDVATLPLRKVLAVVGTAEASSEHPLGVAVTKYCKEELGTETLGYCTDFQAVPGCGIGCKVSNVEGILAHSERPLSAPASHLNEAGSLPAEKDAVPQTFSVLIGNREWLRRNGLTISSDVSDAMTDHEMKGQTAILVAIDGVLCGMIAIADAVKQEAALAVHTLQSMGVDVVLITGDNRKTARAIATQVGINKVFAEVLPSHKVAKVQELQNKGKKVAMVGDGVNDSPALAQADMGVAIGTGTDVAIEAADVVLIRNDLLDVVASIHLSKRTVRRIRINLVLALIYNLVGIPIAAGVFMPIGIVLQPWMGSAAMAASSVSVVLSSLQLK

SEQ ID NO: 839377 - protein, 1374 aa, Homo sapiens; identical to SEQ ID NO: 839376

SEQ ID NO: 839378 - protein, 640 aa, Homo sapiens
MPEQERQITAREGASRKILSKLSLPTRAWEPAMKKSFAFDNVGYEGGLDGLGPSSQVATSTVRILGMTCQSCVKSIEDRISNLKGIISMKVSLEQGSATVKYVPSVVCLQQVCHQIGDMGFEASIAEGKAASWPSRSLPAQEAVVKLRVEGMTCQSCVSSIEGKVRKLQGVVRVKVSLSNQEAVITYQPYLIQPEDLRDHVNDMGFEAAIKSKVAPLSLGPIDIERLQSTNPKRPLSSANQNFNNSETLGHQGSHVVTLQLRIDGMHCKSCVLNIEENIGQLLGVQSIQVSLENKTAQVKYDPSCTSPVALQRAIEALPPGNFKVSLPDGAEGSGTDHRSSSSHSPGSPPRNQVQGTCSTTLIAIAGMTCASCVHSIEGMISQLEGVQQISVSLAEGTATVLYNPSVISPEELRAAIEDMGFEASVVSESCSTNPLGNHSAGNSMVQTTDGTPTSVQEVAPHTGRLPANHAPDILAKSPQSTRAVAPQKCFLQIKGMTCASCVSNIERNLQKEAGVLSVLVALMAGKAEIKYDPEVIQPLEIAQFIQDLGFEAAVMEDYAGSDGNIELTITGMTCASCVHNIESKLTRTNGITYASVALATSKALVKFDPEIIGPRDIIKIIEVSNSLKNCSHLFKNSNI

SEQ ID NO: 839379 - protein, 1465 aa, Homo sapiens
MPEQERQITAREGASRKILSKLSLPTRAWEPAMKKSFAFDNVGYEGGLDGLGPSSQVATSTVRILGMTCQSCVKSIEDRISNLKGIISMKVSLEQGSATVKYVPSVVCLQQVCHQIGDMGFEASIAEGKAASWPSRSLPAQEAVVKLRVEGMTCQSCVSSIEGKVRKLQGVVRVKVSLSNQEAVITYQPYLIQPEDLRDHVNDMGFEAAIKSKVAPLSLGPIDIERLQSTNPKRPLSSANQNFNNSETLGHQGSHVVTLQLRIDGMHCKSCVLNIEENIGQLLGVQSIQVSLENKTAQVKYDPSCTSPVALQRAIEALPPGNFKVSLPDGAEGSGTDHRSSSSHSPGSPPRNQVQGTCSTTLIAIAGMTCASCVHSIEGMISQLEGVQQISVSLAEGTATVLYNPSVISPEELRAAIEDMGFEASVVSESCSTNPLGNHSAGNSMVQTTDGTPTSVQEVAPHTGRLPANHAPDILAKSPQSTRAVAPQKCFLQIKGMTCASCVSNIERNLQKEAGVLSVLVALMAGKAEIKYDPEVIQPLEIAQFIQDLGFEAAVMEDYAGSDGNIELTITGMTCASCVHNIESKLTRTNGITYASVALATSKALVKFDPEIIGPRDIIKIIEEIGFHASLAQRNPNAHHLDHKMEIKQWKKSFLCSLVFGIPVMALMIYMLIPSNEPHQSMVLDHNIIPGLSILNLIFFILCTFVQLLGGWYFYVQAYKSLRHRSANMDVLIVLATSIAYVYSLVILVVAVAEKAERSPVTFFDTPPMLFVFIALGRWLEHLAKSKTSEALAKLMSLQATEATVVTLGEDNLIIREEQVPMELVQRGDIVKVVPGGKFPVDGKVLEGNTMADESLITGEAMPVTKKPGSTVIARSINAHGSVLIKATHVGNDTTLAQIVKLVEEAQMSKAPIQQLADRFSGYFVPFIIIMSTLTLVVWIVIGFIDFGVVQKYFPNPNKHISQTEVIIRFAFQTSITVLCIACPCSLGLATPTAVMVGTGVAAQNGILIKGGKPLEMAHKIKTVMFDKTGTITHGVPRVMRVLLLGDVATLPLRKVLAVVGTAEASSEHPLGVAVTKYCKEELGTETLGYCTDFQAVPGCGIGCKVSNVEGILAHSERPLSAPASHLNEAGSLPAEKDAVPQTFSVLIGNREWLRRNGLTISSDVSDAMTDHEMKGQTAILVAIDGVLCGMIAIADAVKQEAALAVHTLQSMGVDVVLITGDNRKTARAIATQVGINKVFAEVLPSHKVAKVQELQNKGKKVAMVGDGVNDSPALAQADMGVAIGTGTDVAIEAADVVLIRNDLLDVVASIHLSKRTVRRIRINLVLALIYNLVGIPIAAGVFMPIGIVLQPWMGSAAMAASSVSVVLSSLQLKCYKKPDLERYEAQAHGHMKPLTASQVSVHIGMDDRWRDSPRATPWDQVSYVSQVSLSSLTSDKPSRHSAAADDDGDKWSLLLNGRDEEQYI

SEQ ID NO: 839380 - protein, 1465 aa, Homo sapiens; identical to SEQ ID NO: 839379

SEQ ID NO: 839381 - protein, 519 aa, Homo sapiens
MPLTLSCFQNPNKHISQTEVIIRFAFQTSITVLCIACPCSLGLATPTAVMVGTGVAAQNGILIKGGKPLEMAHKIKTVMFDKTGTITHGVPRVMRVLLLGDVATLPLRKVLAVVGTAEASSEHPLGVAVTKYCKEELGTETLGYCTDFQAVPGCGIGCKVSNVEGILAHSERPLSAPASHLNEAGSLPAEKDAVPQTFSVLIGNREWLRRNGLTISSDVSDAMTDHEMKGQTAILVAIDGVLCGMIAIADAVKQEAALAVHTLQSMGVDVVLITGDNRKTARAIATQVGINKVFAEVLPSHKVAKVQELQNKGKKVAMVGDGVNDSPALAQADMGVAIGTGTDVAIEAADVVLIRNDLLDVVASIHLSKRTVRRIRINLVLALIYNLVGIPIAAGVFMPIGIVLQPWMGSAAMAASSVSVVLSSLQLKCYKKPDLERYEAQAHGHMKPLTASQVSVHIGMDDRWRDSPRATPWDQVSYVSQVSLSSLTSDKPSRHSAAADDDGDKWSLLLNGRDEEQYI

SEQ ID NO: 839382 - protein, 249 aa, Homo sapiens
LCSQPFSILGFGDIVVPGFLVAYCCRFDVQVCSRQIYFVACTVAYAVGLLVTFMAMVLMQMGQPALLYLVSSTLLTSLAVAACRQELSLFWTGQGRAKMCGLGCAPSAGSRQKQEGAADAHTASTLERGTSRGAGDLDSNPGEDTTEIVTISENEATNPEDRSDSSEGWSDAHLDPNELPFIPPGASEELMPLMPMAMLIPLMPLMPPPSELGHVHAQAQAHETGLPWAGLHKRKGLKVRKSMSTQAPL

SEQ ID NO: 839383 - protein, 150 aa, Homo sapiens
LCSQPFSILGFGDIVVPGFLVAYCCRFDVQVCSRQIYFVACRTHWAFPTACSSCTVCGCPLSRTAPPSGWSDAHLDPNELPFIPPGASEELMPLMPMAMLIPLMPLMPPPSELGHVHAQAQAHETGLPWAGLHKRKGLKVRKSMSTQAPL

SEQ ID NO: 839384 - protein, 172 aa, Homo sapiens
MHEEAQRHGCVTCLRSPTWWAGVWPLPHPGATLASSGIHSSELGSLWAALCPGRWREGPAGRERWAGGGWGPAVSQRLFASPVFSPGQWEPAPPTVGQWAAWGLFSSSLSFLLSPHFSISSLSTQRFWTACLSGPSRGWPGVLVSMLGGWEGSDSSFAASCSVAWVGLWPEV

SEQ ID NO: 839385 - protein, 454 aa, Homo sapiens
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPRKKSKLFSRLRRKKNSDNAPAKGNKSPSPPDGSPAATPEIRVNHEPEPAGGATPGATLPKSPSQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 839386 - protein, 518 aa, Homo sapiens
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQLRKGPPVPPPPKHTPSKEVKQEQILSLFEDTFVPEISVTTPSQPTESPAGSLPSGEPSAAEGTFAVSWPSQTAEPGPAQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 839387 - protein, 593 aa, Homo sapiens
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKPVSLLEKAAPQWCQGKLQAHLVAQTNLLRNQAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQLRKGPPVPPPPKHTPSKEVKQEQILSLFEDTFVPEISVTTPSQFEAPGPFSEQASLLDLDFDPLPPVTSPVKAPTPSGQSIPWDLWEPTESPAGSLPSGEPSAAEGTFAVSWPSQTAEPGPAQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 839388 - protein, 519 aa, Homo sapiens
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQFEAPGPFSEQASLLDLDFDPLPPVTSPVKAPTPSGQSIPWDLWEPTESPAGSLPSGEPSAAEGTFAVSWPSQTAEPGPAQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 839389 - protein, 409 aa, Homo sapiens
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 839390 - protein, 550 aa, Homo sapiens
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKPVSLLEKAAPQWCQGKLQAHLVAQTNLLRNQAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQFEAPGPFSEQASLLDLDFDPLPPVTSPVKAPTPSGQSIPWDLWEPTESPAGSLPSGEPSAAEGTFAVSWPSQTAEPGPAQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 839391 - protein, 490 aa, Homo sapiens
RRESLAGCLTVAFPLPACLSSVCVCLPGEPRCENAGARGCASCLRGPRPQALLGGRGETGLTSQPALPVQAGGEEMMRKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 839392 - protein, 365 aa, Homo sapiens
MHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 839393 - protein, 409 aa, Homo sapiens; identical to SEQ ID NO: 839389

SEQ ID NO: 839394 - protein, 518 aa, Homo sapiens; identical to SEQ ID NO: 839386

SEQ ID NO: 839395 - protein, 518 aa, Homo sapiens; identical to SEQ ID NO: 839386

SEQ ID NO: 839396 - protein, 518 aa, Homo sapiens; identical to SEQ ID NO: 839386

SEQ ID NO: 839397 - protein, 518 aa, Homo sapiens; identical to SEQ ID NO: 839386

SEQ ID NO: 839398 - protein, 173 aa, Homo sapiens
MPTESPAGSLPSGEPSAAEGTFAVSWPSQTAEPGPAQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 839399 - protein, 71 aa, Homo sapiens
AVQLERQGSPARRSPSAARAPPSSRTWRCRRPEWPFKRQLIVRRGRAGGADRGLRPGPSPLPPSVPASLAG

SEQ ID NO: 839400 - protein, 369 aa, Homo sapiens
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQPAEASEVAGGTQPAAGAQEPGETAASEAASSSLPAVVVETFPATPRHPGKGPLFLAAAVGGAQTPA

SEQ ID NO: 839401 - protein, 266 aa, Homo sapiens
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPSGAGGCRATMLA

SEQ ID NO: 839402 - protein, 304 aa, Homo sapiens
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPRKKSKLFSRLPERRTAAPPGQGSSFPGSCCGWGPDTSLAWLCPADGLCAV

SEQ ID NO: 839403 - protein, 71 aa, Homo sapiens; identical to SEQ ID NO: 839399

SEQ ID NO: 839404 - protein, 482 aa, Homo sapiens
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQLRKGPPVPPPPKHTPSKEVKQEQILSLFEDTFVPEISVTTPSQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 839405 - protein, 439 aa, Homo sapiens
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 839406 - protein, 475 aa, Homo sapiens
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQPTESPAGSLPSGEPSAAEGTFAVSWPSQTAEPGPAQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 839407 - protein, 497 aa, Homo sapiens
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPRKKSKLFSRLRRKKNSDNAPAKGNKSPSPPDGSPAATPEIRVNHEPEPAGGATPGATLPKSPSQLRKGPPVPPPPKHTPSKEVKQEQILSLFEDTFVPEISVTTPSQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 839408 - protein, 424 aa, Homo sapiens
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPRKKSKLFSRLRRKKNSDNAPAKGNKSPSPPDGSPAATPEIRVNHEPEPAGGATPGATLPKSPSQSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 839409 - protein, 452 aa, Homo sapiens
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQLRKGPPVPPPPKHTPSKEVKQEQILSLFEDTFVPEISVTTPSQSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 839410 - protein, 417 aa, Homo sapiens
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQLTRTSAIQSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 839411 - protein, 506 aa, Homo sapiens
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKPVSLLEKAAPQWCQGKLQAHLVAQTNLLRNQAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQPTESPAGSLPSGEPSAAEGTFAVSWPSQTAEPGPAQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 839412 - protein, 607 aa, Homo sapiens
GSSWPPLAALLVPGWLLPVQGLLCCCLWHSWAWAQGIESCGEVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKPVSLLEKAAPQWCQGKLQAHLVAQTNLLRNQAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQLRKGPPVPPPPKHTPSKEVKQEQILSLFEDTFVPEISVTTPSQFEAPGPFSEQASLLDLDFDPLPPVTSPVKAPTPSGQSIPWDLWEPTESPAGSLPSGEPSAAEGTFAVSWPSQTAEPGPAQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 839413 - protein, 317 aa, Homo sapiens
HSRRQCPPAVSQHSPFPGRAGHRAGSVTHLLPAVPSPALCGRVMGPEHHCLAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 839414 - protein, 360 aa, Homo sapiens
HSRRQCPPAVSQHSPFPGRAGHRAGSVTHLLPAVPSPALCGRVMGPEHHCLAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQLRKGPPVPPPPKHTPSKEVKQEQILSLFEDTFVPEISVTTPSQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 839415 - protein, 282 aa, Homo sapiens
MSPPNPVLCCAFPRGPSPAADPQLRKGPPVPPPPKHTPSKEVKQEQILSLFEDTFVPEISVTTPSQFEAPGPFSEQASLLDLDFDPLPPVTSPVKAPTPSGQSIPWDLWEPTESPAGSLPSGEPSAAEGTFAVSWPSQTAEPGPAQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 839416 - protein, 154 aa, Homo sapiens
ALVPFCRRVVTLPKSPSQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 839417 - protein, 342 aa, Homo sapiens
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQLRKGPPVPPPPKHTPSKPRHPGKGPLFLAAAVGGAQTPA

SEQ ID NO: 839418 - protein, 159 aa, Homo sapiens
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKPRHPGKGPLFLAAAVGGAQTPA

SEQ ID NO: 839419 - protein, 81 aa, Homo sapiens
PSLLRSVNSMGPLGGKLHVCSLSSPWGSHSSVCVQAHMLLACSQVHAPHTPPTRRTHRHVLTHRELVKPPASSHSAASPSG

SEQ ID NO: 839420 - protein, 351 aa, Homo sapiens
ARGGGEARAGVRAPGVGVGGGNRRGRRDSAGQRDPATLDSASPPARVAAPQPLRIMEHLKAFDDEINAFLDNMFGPRDSRVRGWFMLDSYLPTFFLTVMYLLSIWLGNKYMKNRPALSLRGILTLYNLGITLLSAYMLAELILSTWEGGYNLQCQDLTSAGEADIRVAKVLWWYYFSKSVEFLDTIFFVLRKKTSQITFLHVYHHASMFNIWWCVLNWIPCGQSFFGPTLNSFIHILMYSYYGLSVFPSMHKYLWWKKYLTQAQLVQFVLTITHTMSAVVKPCGFPFGCLIFQSSYMLTLVILFLNFYVQTYRKKPMKKDMQEPPAGKEVKNGFSKAYFTAANGVMNKKAQ

SEQ ID NO: 839421 - protein, 351 aa, Homo sapiens; identical to SEQ ID NO: 839420

SEQ ID NO: 839422 - protein, 451 aa, Homo sapiens
MAKLYEAVTFKDVAVIFTEEELGLLDPAQRKLYRDVMLENFRNLLSVGGKIQTEMETFPEAGTHEEFSCKQIWEQIASDLTRSQDTTISNSQLFEQDDNPSQIKARLSTVHTREKPFQGENCKQFFSDVSFFDLPQQLYSGEKSHTCDECGKSFCYISALHIHQRVHMGVKCYKCDVCGKEFSQSSRLQTHQRVHTGEKPFKCEQCGKGFRCRSALKVHCKLHMREKPYNCEKCGKAFMHNFQLQKHHRIHTGEKPFKCEICGKSFCLRSSLNRHCMVHTAEKLYKSEKYGRGFIDRLDLHKHQMIHMGQKPYNCKECGKSFKWSSYLLVHQRVHTGEKPYKCEECGKGYISKSGLDFHHRTHTGERSYNCDNCGKSFRHASSILNHKKLHCQRKPLKCEDCGKRLVCRSYCKDQQRDHSGENPSKCEDCGKRYKRRLNLDIILSLFLNDI

SEQ ID NO: 839423 - protein, 482 aa, Homo sapiens
MAKLYEAVTFKDVAVIFTEEELGLLDPAQRKLYRDVMLENFRNLLSVGHQPFHGDTFHFLREEKFWVMGTTSQREGNLGGKIQTEMETFPEAGTHEEFSCKQIWEQIASDLTRSQDTTISNSQLFEQDDNPSQIKARLSTVHTREKPFQGENCKQFFSDVSFFDLPQQLYSGEKSHTCDECGKSFCYISALHIHQRVHMGVKCYKCDVCGKEFSQSSRLQTHQRVHTGEKPFKCEQCGKGFRCRSALKVHCKLHMREKPYNCEKCGKAFMHNFQLQKHHRIHTGEKPFKCEICGKSFCLRSSLNRHCMVHTAEKLYKSEKYGRGFIDRLDLHKHQMIHMGQKPYNCKECGKSFKWSSYLLVHQRVHTGEKPYKCEECGKGYISKSGLDFHHRTHTGERSYNCDNCGKSFRHASSILNHKKLHCQRKPLKCEDCGKRLVCRSYCKDQQRDHSGENPSKCEDCGKRYKRRLNLDIILSLFLNDI

SEQ ID NO: 839424 - protein, 516 aa, Homo sapiens
GSLSHFHILRVLPNESPFLGARNHPMIDSGEKKPGRRAEEAVTFKDVAVIFTEEELGLLDPAQRKLYRDVMLENFRNLLSVGHQPFHGDTFHFLREEKFWVMGTTSQREGNLGGKIQTEMETFPEAGTHEEFSCKQIWEQIASDLTRSQDTTISNSQLFEQDDNPSQIKARLSTVHTREKPFQGENCKQFFSDVSFFDLPQQLYSGEKSHTCDECGKSFCYISALHIHQRVHMGVKCYKCDVCGKEFSQSSRLQTHQRVHTGEKPFKCEQCGKGFRCRSALKVHCKLHMREKPYNCEKCGKAFMHNFQLQKHHRIHTGEKPFKCEICGKSFCLRSSLNRHCMVHTAEKLYKSEKYGRGFIDRLDLHKHQMIHMGQKPYNCKECGKSFKWSSYLLVHQRVHTGEKPYKCEECGKGYISKSGLDFHHRTHTGERSYNCDNCGKSFRHASSILNHKKLHCQRKPLKCEDCGKRLVCRSYCKDQQRDHSGENPSKCEDCGKRYKRRLNLDIILSLFLNDI

SEQ ID NO: 839425 - protein, 75 aa, Homo sapiens
GTKKQRRMIRRGPPALGGETAASGRHKGFCGVAPGLTALIIPGFHLDALAGEAQDALWLDPCTEPPAQPPRGLKP

SEQ ID NO: 839426 - protein, 415 aa, Homo sapiens
FANLTSVGAMAPARCFSARLRTVFQGVGHWALSTWAGLKPSRLLPQRASPRLLSVGRADLAKHQELPGKKLLSEKKLKRYFVDYRRVLVCGGNGGAGASCFHSEPRKEFGGPDGGDGGNGGHVILRVDQQVKSLSSVLSRYQGFSGEDGGSKNCFGRSGAVLYIRVPVGTLVKEGGRVVADLSCVGDEYIAALGGAGGKGNRFFLANNNRAPVTCTPGQPGQQRVLHLELKTVAHAGMVGFPNAGKSSLLRAISNARPAVASYPFTTLKPHVGIVHYEGHLQIAVADIPGIIRGAHQNRGLGSAFLRHIERCRFLLFVVDLSQPEPWTQVDDLKYELEMYEKGLSARPHAIVANKIDLPEAQANLSQLRDHLGQEVIVLSALTGENLEQLLLHLKVLYDAYAEAELGQGRQPLRW

SEQ ID NO: 839427 - protein, 178 aa, Homo sapiens
MVGFPNAGKSSLLRAISNARPAVASYPFTTLKPHVGIVHYEGHLQIAVADIPGIIRGAHQNRGLGSAFLRHIERCRFLLFVVDLSQPEPWTQVDDLKYELEMYEKGLSARPHAIVANKIDLPEAQANLSQLRDHLGQEVIVLSALTGENLEQLLLHLKVLYDAYAEAELGQGRQPLRW

SEQ ID NO: 839428 - protein, 304 aa, Homo sapiens
MVVVTQGTEILVLALVDQQVKSLSSVLSRYQGFSGEDGGSKNCFGRSGAVLYIRVPVGTLVKEGGRVVADLSCVGDEYIAALGGAGGKGNRFFLANNNRAPVTCTPGQPGQQRVLHLELKTVAHAGMVGFPNAGKSSLLRAISNARPAVASYPFTTLKPHVGIVHYEGHLQIAVADIPGIIRGAHQNRGLGSAFLRHIERCRFLLFVVDLSQPEPWTQVDDLKYELEMYEKGLSARPHAIVANKIDLPEAQANLSQLRDHLGQEVIVLSALTGENLEQLLLHLKVLYDAYAEAELGQGRQPLRW

SEQ ID NO: 839429 - protein, 415 aa, Homo sapiens; identical to SEQ ID NO: 839426

SEQ ID NO: 839430 - protein, 415 aa, Homo sapiens; identical to SEQ ID NO: 839426

SEQ ID NO: 839431 - protein, 183 aa, Homo sapiens
AQLWGPAVPQVPVGTLVKEGGRVVADLSCVGDEYIAALGGAGGKGNRFFLANNNRAPVTCTPGQPGQQRVLHLELKTVAHAGMVGFPNAGKSSLLRAISNARAGSPLGLCLSKPGCEFGGFECIKCLVDTGELWCFWVSGPRLLAWDALMLGSIPCPPPRLPSVFPAPVSLRRLMSQLLICAD

SEQ ID NO: 839432 - protein, 136 aa, Homo sapiens
FANLTSVGAMAPARCFSARLRTVFQGVGHWALSTWAGLKPSRLLPQRASPRLLSVGRADLAKHQELPGKKLLSEKKLKRYFVDYRRVLVCGGNGGAGASCFHSEPRKEFGGPDGGDGGNGGHVILRGRCPGAVQRG

SEQ ID NO: 839433 - protein, 122 aa, Homo sapiens
FANLTSVGAMAPARCFSARLRTVFQGVGHWALSTWAGLKPSRLLPQRASPRLLSVGRADLAKHQELPGKKLLSEKKLVRLLELEQLACLLLRRHRVWFRVLLWVSSLLMLVDDLSDGARGAS

SEQ ID NO: 839434 - protein, 68 aa, Homo sapiens
TDTALTKVLPRAVPPSSLFPPGGIPQRREVLTAPGHFKRQTRRGFLPVHHPEAPRRDRPLRRPPTNSR

SEQ ID NO: 839435 - protein, 75 aa, Homo sapiens; identical to SEQ ID NO: 839425

SEQ ID NO: 839436 - protein, 415 aa, Homo sapiens; identical to SEQ ID NO: 839426

SEQ ID NO: 839437 - protein, 260 aa, Homo sapiens
AQLWGPAVPQVPVGTLVKEGGRVVADLSCVGDEYIAALGGAGGKGNRFFLANNNRAPVTCTPGQPGQQRVLHLELKTVAHAGMVGFPNAGKSSLLRAISNARPAVASYPFTTLKPHVGIVHYEGHLQIAVADIPGIIRGAHQNRGLGSAFLRHIERCRFLLFVVDLSQPEPWTQVDDLKYELEMYEKGLSARPHAIVANKIDLPEAQANLSQLRDHLGQEVIVLSALTGENLEQLLLHLKVLYDAYAEAELGQGRQPLRW

SEQ ID NO: 839438 - protein, 416 aa, Homo sapiens
FANLTSVGAMAPARCFSARLRTVFQGVGHWALSTWAGLKPSRLLPQRASPRLLSVGRADLAKHQELPGKKLLSEKKLKRYFVDYRRVLVCGGNGGAGASCFHSEPRKEFGGPDGGDGGNGGHVILRVDQQVKSLSSVLSRYQGFSGEDGGSKNCFGRSGAVLYIRVPVGTLVKEGGRVVADLSCVGDEYIAALGGAGGKGNRFFLANNNRAPVTCTPGQPGQQRVLHLELKTVAHAGMVGFPNAGKSSLLRAISNARPAVASYPFTTLKPHVGIVHYEGHLQIAVADIPGIIRGAHQNRGLGSAFLRHIERCRFLLFVVDLSQPEPWTQVDDLKYELEMYEKGLSARPHAIVANKIDLPEAQANLSQLRDHLGQEVIVLSALTGENLEQLLLHLRAESICVRCEEENRFWKLGERV

SEQ ID NO: 839439 - protein, 290 aa, Homo sapiens
FANLTSVGAMAPARCFSARLRTVFQGVGHWALSTWAGLKPSRLLPQRASPRLLSVGRADLAKHQELPGKKLLSEKKLKRYFVDYRRVLVCGGNGGAGASCFHSEPRKEFGGPDGGDGGNGGHVILRVDQQVKSLSSVLSRYQGFSGEDGGSKNCFGRSGAVLYIRVPVGTLVKEGGRVVADLSCVGDEYIAALGGAGGKGNRFFLANNNRAPVTCTPGQPGQQRVLHLELKTVAHAGMVGFPNAGKSSLLRAISNARPAVASYPFTTLKPHVGIVHYEGHLQIAGSHPIP

SEQ ID NO: 839440 - protein, 238 aa, Homo sapiens
FANLTSVGAMAPARCFSARLRTVFQGVGHWALSTWAGLKPSRLLPQRASPRLLSVGRADLAKHQELPGKKLLSEKKLKRYFVDYRRVLVCGGNGGAGASCFHSEPRKEFGGPDGGDGGNGGHVILRVDQQVKSLSSVLSRYQGFSGEDGGSKNCFGRSGAVLYIRVSRDCRTWPCPRCSGSSSSWGPPCDPRGPCGLMPTARKQHNGNGGWQTAGKQPHPSKQTQTGICTRVSHHVHV

SEQ ID NO: 839441 - protein, 118 aa, Homo sapiens
VDPETHCHAERCFLSWFCDDILSPNTNYEVTWYTSWSPCPECAGEVAEFLARHSNVNLTIFTARLCYSWPQGHSIVPPCLTTSSPLSQALLVEALHPPPQSCSPSLGAPNLTLPISPA

SEQ ID NO: 839442 - protein, 130 aa, Homo sapiens
VDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNLRPAWATRQSPISTKKKYKKKARCGGMHL

SEQ ID NO: 839443 - protein, 67 aa, Homo sapiens
TSWSPCPECAGEVAEFLARHSNVNLTIFTARLCYFWDTDYQEGLCSLSQEGASVKIMGYKGETWGAE

SEQ ID NO: 839444 - protein, 58 aa, Homo sapiens
HCSFLDVPAVLCILRMALQRIFMVSSRFRCWPYLILHCVTPWEYLASVPCLRRSLTLQ

SEQ ID NO: 839445 - protein, 407 aa, Homo sapiens
MELLEEDLTCPICCSLFDDPRVLPCSHNFCKKCLEGILEGSVRNSLWRPAPFKCPTCRKETSATGINSLQVNYSLKGIVEKYNKIKISPKMPVCKGHLGQPLNIFCLTDMQLICGICATRGEHTKHVFCSIEDAYAQERDAFESLFQSFETWRRGDALSRLDTLETSKRKSLQLLTKDSDKVKEFFEKLQHTLDQKKNEILSDFETMKLAVMQAYDPEINKLNTILQEQRMAFNIAEAFKDVSEPIVFLQQMQEFREKIKVIKETPLPPSNLPASPLMKNFDTSQWEDIKLVDVDKLSLPQDTGTFISKIPWSFYKLFLLILLLGLVIVFGPTMFLEWSLFDDLATWKGCLSNFTSYLTKTADFIEQSVFYWEQVTDGFFIFNERFKNFTLVVLNNVAEFVCKYKLL

SEQ ID NO: 839446 - protein, 213 aa, Homo sapiens [sequence omitted]

SEQ ID NO: 839447 - protein, 407 aa, Homo sapiens; identical to SEQ ID NO: 839445

SEQ ID NO: 839448 - protein, 407 aa, Homo sapiens; identical to SEQ ID NO: 839445

SEQ ID NO: 839449 - protein, 410 aa, Homo sapiens
MDVMELLEEDLTCPICCSLFDDPRVLPCSHNFCKKCLEGILEGSVRNSLWRPAPFKCPTCRKETSATGINSLQVNYSLKGIVEKYNKIKISPKMPVCKGHLGQPLNIFCLTDMQLICGICATRGEHTKHVFCSIEDAYAQERDAFESLFQSFETWRRGDALSRLDTLETSKRKSLQLLTKDSDKVKEFFEKLQHTLDQKKNEILSDFETMKLAVMQAYDPEINKLNTILQEQRMAFNIAEAFKDVSEPIVFLQQMQEFREKIKVIKETPLPPSNLPASPLMKNFDTSQWEDIKLVDVDKLSLPQDTGTFISKIPWSFYKLFLLILLLGLVIVFGPTMFLEWSLFDDLATWKGCLSNFSSYLTKTADFIEQSVFYWEQVTDGFFIFNERFKNFTLVVLNNVAEFVCKYKLL

SEQ ID NO: 839450 - protein, 272 aa, Homo sapiens
MSSQELVTLNVGGKIFTTRFSTIKQFPASRLARMLDGRDQEFKMVGGQIFVDRDGDLFSFILDFLRTHQLLLPTEFSDYLRLQREALFYELRSLVDLLNPYLLQPRPALVEVHFLSRNTQAFFRVFGSCSKTIEMLTGRITVFTEQPSAPTWNGNFFPPQMTLLPLPPQRPSYHDLVFQCGSDSTTDNQTGVRYVSIKPDNRKLANGTNVLGLLIDTLLKEGFHLVSTRTVSSEDKTECYSFERIKSPEVLITNETPKPETIIIPEQSQIKK

SEQ ID NO: 839451 - protein, 407 aa, Homo sapiens
MELLEEDLTCPICCSLFDDPRVLPCSHNFCKKCLEGILEGSVRNSLWRPAPFKCPTCRKETSATGINSLQVNYSLKGIVEKYNKIKISPKMPVCKGHLGQPLNIFCLTDMQLICGICATRGEHTKHVFCSIEDAYAQERDAFESLFQSFETWRRGDALSRLDTLETSKRKSLQLLTKDSDKVKEFFEKLQHTLDQKKNEILSDFETMKLAVMQAYDPEINKLNTILQEQRMAFNIAEAFKDVSEPIVFLQQMQEFREKIKVIKETPLPPSNLPASPLMKNFDTSQWEDIKLVDVDKLSLPQDTGTFISKIPWSFYKLFLLILLLGLVIVFGPTMFLEWSLFDDLATWKGCLSNFSSYLTKTADFIEQSVFYWEQVTDGFFIFNERFKNFTLVVLNNVAEFVCKYKLL

SEQ ID NO: 839452 - protein, 229 aa, Homo sapiens
MSSQELVTLNVGGKIFTTRFSTIKQFPASRLARMLDGRDQEFKMVGGQIFVDRDGDLFSFILDFLRTHQLLLPTEFSDYLRLQREALFYELRSLVDLLNPYLLQPRPALVEVHFLSRNTQAFFRVFGSCSKTIEMLTGRITVFTEQPSAPTWNGNFFPPQMTLLPLPPQRPSYHDLVFQCGSDSTTDNQTGVRLVCNGVISAHHNLRLWGSSDSPASASRVAGITGMFL

SEQ ID NO: 839453 - protein, 142 aa, Homo sapiens
MISTARVPADKPVRIAFSLNDASDDTPPEDSIPLVFPELDQQLQPLPPCHDSEESMEVFKQHCQIAEEYHEVKKEITLLEQRKKELIAKLDQAEKEKVDAAELVREFEALTEENRTLRLAQSQCVEQLEKLRIQYQKRQGSS

SEQ ID NO: 839454 - protein, 278 aa, Homo sapiens
MVQLIAPLEVMWNEAADLKPLALSRRLECSGGIMAHYSPDLLGPEMESRYFAQVGLEHLASSSPPAFGFLKCLDYSISVLCSATSLAMLEDNPKVSKLATGDWMLTLKPKSITVPVEIPSSPLAGRPRRRRRLRCPHDQHSQVPADKPVRIAFSLNDASDDTPPEDSIPLVFPELDQQLQPLPPCHDSEESMEVFKQHCQIAEEYHEVKKEITLLEQRKKELIAKLDQAEKEKVDAAELVREFEALTEENRTLRLAQSQCVEQLEKLRIQYQKRQGSS

SEQ ID NO: 839455 - protein, 163 aa, Homo sapiens
MVQLIAPLEVMWNEAADLKPLALSRRLECSGGIMAHYSPDLLGPEMESRYFAQVGLEHLASSSPPAFGFLKCLDYSISVLCSATSLAMLEDNPKVSKLATGDWMLTLKPKSITVPVEIPSSPLGSRYVAQAGLELLSSRDPPSSASQSAGITGMSHRAWLKLN

SEQ ID NO: 839456 - protein, 133 aa, Homo sapiens
MASNSEIQAWLSDYDDTPPEDSIPLVFPELDQQLQPLPPCHDSEESMEVFKQHCQIAEEYHEVKKEITLLEQRKKELIAKLDQAEKEKVDAAELVREFEALTEENRTLRLAQSQCVEQLEKLRIQYQKRQGSS

SEQ ID NO: 839457 - protein, 124 aa, Homo sapiens
MGNMADDTPPEDSIPLVFPELDQQLQPLPPCHDSEESMEVFKQHCQIAEEYHEVKKEITLLEQRKKELIAKLDQAEKEKVDAAELVREFEALTEENRTLRLAQSQCVEQLEKLRIQYQKRQGSS

SEQ ID NO: 839458 - protein, 142 aa, Homo sapiens; identical to SEQ ID NO: 839453

SEQ ID NO: 839459 - protein, 242 aa, Homo sapiens
MVQLIAPLEVMWNEAADLKPLALSRRLECSGGIMAHYSPDLLGPEMESRYFAQVGLEHLASSSPPAFGFLKCLDYSISVLCSATSLAMLEDNPKVSKLATGDWMLTLKPKSITVPVEIPSSPLDDTPPEDSIPLVFPELDQQLQPLPPCHDSEESMEVFKQHCQIAEEYHEVKKEITLLEQRKKELIAKLDQAEKEKVDAAELVREFEALTEENRTLRLAQSQCVEQLEKLRIQYQKRQGSS

SEQ ID NO: 839460 - protein, 142 aa, Homo sapiens; identical to SEQ ID NO: 839453

SEQ ID NO: 839461 - protein, 142 aa, Homo sapiens; identical to SEQ ID NO: 839453

SEQ ID NO: 839462 - protein, 185 aa, Homo sapiens
DQQQLNQSSVTACSQEKEPVVRFPRRCDEKLEDPGEGGGSGAHMISTARVPADKPVRIAFSLNDASDDTPPEDSIPLVFPELDQQLQPLPPCHDSEESMEVFKQHCQIAEEYHEVKKEITLLEQRKKELIAKLDQAEKEKVDAAELVREFEALTEENRTLRLAQSQCVEQLEKLRIQYQKRQGSS

SEQ ID NO: 839463 - protein, 124 aa, Homo sapiens
MVQLIAPLEVMWNEAADLKPLALSRRLECSGGIMAHYSPDLLGPEMESRYFAQVGLEHLASSSPPAFGFLKCLDYSISVLCSATSLAMLEDNPKVSKLATGDWMLTLKPKSITVPVEIPSSPLG

SEQ ID NO: 839464 - protein, 684 aa, Homo sapiens
MPRPALSVTSFCHRLGKRERKQSFMGNSGNSWSHTPFPKLELGLGPQPMAPRELPTCSICLERLRDPISLDCGHDFCIRCFSTHRLPGCEPPCCPECRKICKQKRGLRSLGEKMKLLPQRPLPPALQVWGLGLISQTQEEEGGFGPILEHQDTELQAEHIPGSGAGPEMLRGPSLLLAQETCPVRAEPLLLVRINASGGLILRMGAINRCLKHPLARDTPVCLLAVLGEQHSGKSFLLNHLLQGLPGLESGEGGRPRGGEASLQGCRWGANGLARGIWMWSHPFLLGKEGKKVAVFLVDTGDAMSPELSRETRIKLCALTTMLSSYQILSTSQELKDTDLDYLEMFVHVAEVMGKHYGMVPIQHLDLLVRDSSHPNKAGQGHVGNIFQRLSGRYPKVQELLQGKRARCCLLPAPGRRRMNQGHASPGGDTDDDFRHLLGAYVSDVLSAAPQHAKSRCQGYWNEGRAVARGDRRLLTGQQLAQEIKNLSGWMGRTGPGFTSPDEMAAQLHDLRKVEAAKREFEEYVRQQDVATKRIFSALRVLPDTMRNLLSTQKDAILARHGVALLCKGRDQTLEALEAELQATAKAFMDSYTMRFCGHLAAVGGAVGAGLMGLAGGVVGAGMAAAALAAEAGMVAAGAAVGATGAAVVGGGVGAGLAATVGCMEKEEDERLLEGDREPLLQEE

SEQ ID NO: 839465 - protein, 632 aa, Homo sapiens
MPRPALSVTSFCHRLGKRERKQSFMGNSGNSWSHTPFPKLELGLGPQPMAPRELPTCSICLERLRDPISLDCGHDFCIRCFSTHRLPGCEPPCCPECRKICKQKRGLRSLGEKMKLLPQRPLPPALQETCPVRAEPLLLVRINASGGLILRMGAINRCLKHPLARDTPVCLLAVLGEQHSGKSFLLNHLLQGLPGLESGEGGRPRGGEASLQGCRWGANGLARGIWMWSHPFLLGKEGKKVAVFLVDTGDAMSPELSRETRIKLCALTTMLSSYQILSTSQELKDTDLDYLEMFVHVAEVMGKHYGMVPIQHLDLLVRDSSHPNKAGQGHVGNIFQRLSGRYPKVQELLQGKRARCCLLPAPGRRRMNQGHASPGGDTDDDFRHLLGAYVSDVLSAAPQHAKSRCQGYWNEGRAVARGDRRLLTGQQLAQEIKNLSGWMGRTGPGFTSPDEMAAQLHDLRKVEAAKREFEEYVRQQDVATKRIFSALRVLPDTMRNLLSTQKDAILARHGVALLCKGRDQTLEALEAELQATAKAFMDSYTMRFCGHLAAVGGAVGAGLMGLAGGVVGAGMAAAALAAEAGMVAAGAAVGATGAAVVGGGVGAGLAATVGCMEKEEDERLLEGDREPLLQEE

SEQ ID NO: 839466 - protein, 38 aa, Homo sapiens
MEPVSHAAIYWRAFYLQSPSEQRSRTRKSLACFRNREK

SEQ ID NO: 839467 - protein, 73 aa, Homo sapiens
HRYSRVESREPPLCSDPPKWLLQWLVDNNFQHSVNVSCAHPEWLAGQSILNVDLKDFVCGLYFCFKILYITHL

SEQ ID NO: 839468 - protein, 899 aa, Homo sapiens
MQLKYLNLSNNRITTLEAGCFDNLSSSLLVVKLNRNRMSMIPPKIFKLPHLQFLELKRNRIKIVEGLTFQGLDSLRSLKMQRNGISKLKDGAFFGLNNMEELELEHNNLTRVNKGWLYGLRMLQQLYVSQNAIERISPDAWEFCQRLSELDLSYNQLTRLDESAFVGLSLLERLNLGDNRVTHIADGVFRFLSNLQTLDLRNNEISWAIEDASEAFAGLTSLTKLILQGNQIKSITKKAFIGLESLEHLDLNNNAIMSIQENAFSQTHLKELILNTSSLLCDCHLKWLLQWLVDNNFQHSVNVSCAHPEWLAGQSILNVDLKDFVCDDFLKPQIRTHPETIIALRGMNVTLTCTAVSSSDSPMSTVWRKDSEILYDVDTENFVRYWQQAGEALEYTSILHLFNVNFTDEGKYQCIVTNHFGSNYSQKAKLTVNEMPSFLKTPMDLTIRTGAMARLECAAEGHPAPQISWQKDGGTDFPAARERRMHVMPEDDVFFIANVKIEDMGIYSCMAQNTAGGLSANASLTVLETPSFIRPLEDKTVTRGETAVLQCIAGGSPAPRLNWTKDDGPLLVTERHFFAAANQLLIIVDAGLEDAGKYTCIMSNTLGTERGHIYLNVISSPNCDSSQSSIGHEDDGWTTVGIVIIVVVCCVVGTSLIWVIVIYHMRRKNEDYSITNTEELNLPADIPSYLSSQGTLSEPQEGYSNSEAGSHQQLMPPANGYIHKGTDGGTGTRVICSDCYDNANIYSRTREYCPYTYIAEEDVLDQTLSSLMVQMPKETYLVHPPQDTTALESLIPSANREPSAFPTNHERISEKKLPSTQMSGETLQRPVWNINRELGLPHPPFSQQPVHESPQLHQNEGLAGREPDCSASSMSCHRLQDHAFDFSRTRNIQDGSEGT

SEQ ID NO: 839469 - protein, 473 aa, Homo sapiens
MAPAPLGVPEEQLLGCRSRVLSRLLFIAQTALLLLPAAGAGLCPAPCSCRIPLLDCSRRKLPAPSWRALSGLLPPDTAILDFSHNRLSNWNISLESQTLQEVKMNYNELTEIPYFGEPTSNITLLSLVHNIIPEINAQALQFYPALESLDLSSNIISEIKTSSFPRMQLKYLNLSNNRITTLEAGCFDNLSSSLLVVKLNRNRMSMIPPKIFKLPHLQFLELKRNRIKIVEGLTFQGLDSLRSLKMQRNGISKLKDGAFFGLNNMEELELEHNNLTRVNKGWLYGLRMLQQLYVSQNAIERISPDAWEFCQRLSELDLSYNQLTRLDESAFVGLSLLERLNLGDNRVTHIADGVFRFLSNLQTLDLRNNEISWAIEDASEAFAGLTSLTKLILQGNQIKSITKKAFIGLESLEHLDLNNNAIMSIQENAFSQTHLKELYGAVTPIGSDSSLDPQTSHPGPQVCTFEAIVFTPD

SEQ ID NO: 839470 - protein, 438 aa, Homo sapiens [sequence omitted]

SEQ ID NO: 839471 - protein, 1065 aa, Homo sapiens
MAPAPLGVPEEQLLGCRSRVLSRLLFIAQTALLLLPAAGAGLCPAPCSCRIPLLDCSRRKLPAPSWRALSGLLPPDTAILDFSHNRLSNWNISLESQTLQEVKMNYNELTEIPYFGEPTSNITLLSLVHNIIPEINAQALQFYPALESLDLSSNIISEIKTSSFPRMQLKYLNLSNNRITTLEAGCFDNLSSSLLVVKLNRNRMSMIPPKIFKLPHLQFLELKRNRIKIVEGLTFQGLDSLRSLKMQRNGISKLKDGAFFGLNNMEELELEHNNLTRVNKGWLYGLRMLQQLYVSQNAIERISPDAWEFCQRLSELDLSYNQLTRLDESAFVGLSLLERLNLGDNRVTHIADGVFRFLSNLQTLDLRNNEISWAIEDASEAFAGLTSLTKLILQGNQIKSITKKAFIGLESLEHLDLNNNAIMSIQENAFSQTHLKELILNTSSLLCDCHLKWLLQWLVDNNFQHSVNVSCAHPEWLAGQSILNVDLKDFVCDDFLKPQIRTHPETIIALRGMNVTLTCTAVSSSDSPMSTVWRKDSEILYDVDTENFVRYWQQAGEALEYTSILHLFNVNFTDEGKYQCIVTNHFGSNYSQKAKLTVNEMPSFLKTPMDLTIRTGAMARLECAAEGHPAPQISWQKDGGTDFPAARERRMHVMPEDDVFFIANVKIEDMGIYSCMAQNTAGGLSANASLTVLETPSFIRPLEDKTVTRGETAVLQCIAGGSPAPRLNWTKDDGPLLVTERHFFAAANQLLIIVDAGLEDAGKYTCIMSNTLGTERGHIYLNVISSPNCDSSQSSIGHEDDGWTTVGIVIIVVVCCVVGTSLIWVIVIYHMRRKNEDYSITNTEELNLPADIPSYLSSQGTLSEPQEGYSNSEAGSHQQLMPPANGYIHKGTDGGTGTRVICSDCYDNANIYSRTREYCPYTYIAEEDVLDQTLSSLMVQMPKETYLVHPPQDTTALESLIPSANREPSAFPTNHERISEKKLPSTQMSGETLQRPVWNINRELGLPHPPFSQQPVHESPQLHQNEGLAGREPDCSASSMSCHRLQDHAFDFSRTRNIQDGSEGT

SEQ ID NO: 839472 - protein, 553 aa, Homo sapiens
MNVTLTCTAVSSSDSPMSTVWRKDSEILYDVDTENFVRYWQQAGEALEYTSILHLFNVNFTDEGKYQCIVTNHFGSNYSQKAKLTVNEMPSFLKTPMDLTIRTGAMARLECAAEGHPAPQISWQKDGGTDFPAARERRMHVMPEDDVFFIANVKIEDMGIYSCMAQNTAGGLSANASLTVLETPSFIRPLEDKTVTRGETAVLQCIAGGSPAPRLNWTKDDGPLLVTERHFFAAANQLLIIVDAGLEDAGKYTCIMSNTLGTERGHIYLNVISSPNCDSSQSSIGHEDDGWTTVGIVIIVVVCCVVGTSLIWVIVIYHMRRKNEDYSITNTEELNLPADIPSYLSSQGTLSEPQEGYSNSEAGSHQQLMPPANGYIHKGTDGGTGTRVICSDCYDNANIYSRTREYCPYTYIAEEDVLDQTLSSLMVQMPKETYLVHPPQDTTALESLIPSANREPSAFPTNHERISEKKLPSTQMSGETLQRPVWNINRELGLPHPPFSQQPVHESPQLHQNEGLAGREPDCSASSMSCHRLQDHAFDFSRTRNIQDGSEGT

SEQ ID NO: 839473 - protein, 473 aa, Homo sapiens; identical to SEQ ID NO: 839469

SEQ ID NO: 839474 - protein, 31 aa, Homo sapiens
RKYSQQNIDKFNPAVHKKNYRPYPRRICLRH

SEQ ID NO: 839475 - protein, 116 aa, Homo sapiens
MEAGLTSPPRWAGSAAGALPLLRVPLLAALETGWTAWVGLRICSAPCGDRCQGQTIREKRIVEAANKKEVDYEAGDIPTEWEAWIRRTRKTPPTMEEILKNEKHRRRNQNKKPRFL

SEQ ID NO: 839476 - protein, 113 aa, Homo sapiens
LLEGLQDGGRPDFSASVGWVGGWSITPTAGPAAGSAGNWVDGMGWSQDLFRALWRSLSREVKEHVGTDQFGNKYYYIPQYKNWRGEVAAWAAIAWSVIARTNYSREKNCRSSK

SEQ ID NO: 839477 - protein, 119 aa, Homo sapiens
LLEGLQDGGRPDFSASVGWVGGWSITPTAGPAAGSAGNWVDGMGWSQDLFRALWRSLSREVKEHVGTDQFGNKYYYIPQYKNWRGQTIREKRIVEAANKKEVDYEAGDIPTEWEGNTKE

SEQ ID NO: 839478 - protein, 113 aa, Homo sapiens; identical to SEQ ID NO: 839476

SEQ ID NO: 839479 - protein, 148 aa, Homo sapiens
LLEGLQDGGRPDFSASVGWVGGWSITPTAGPAAGSAGNWVDGMGWSQDLFRALWRSLSREVKEHVGTDQFGNKYYYIPQYKNWRGQTIREKRIVEAANKKEVDYEAGDIPTEWEAWIRRTRKTPPTMEEILKNEKHRRRNQNKKPRFL

SEQ ID NO: 839480 - protein, 389 aa, Homo sapiens
LLEGLQDGGRPDFSASVGWVGGWSITPTAGPAAGSAGNWVDGMGWSQDLFRALWRSLSREVKEHVGTDQFGNKYYYIPQYKNWRGQTIREKRIVEAANKKTKKKKKNFVGAGLGPRKSFLKPPSLFGAPGPPEVYGRTSWATKVWSPGENPGAMAPRWLGFLPQLKNSAPGGNTRSGFGETKLQEGEVRRGPVAGSNTQGGVQGRGVRKSRNLGGPDVWKQRENQSQELNTEQYQQQDRSNADKQQDTEPADKVNSEETETIPAESMHYYAQEYKDSEQSRHPWPHATRQNVGPRRGNEGTTTINTNTAQNNRTITQGQSRQDNNGEPAGKEETNAETPTLRNSGEDNNKNNASPARKHEQTRTTNTHAPHRLRHTQANREQTREQPTN

SEQ ID NO: 839481 - protein, 118 aa, Homo sapiens
LLEGLQDGGRPDFSASVGWVGGWSITPTAGPAAGSAGNWVDGMGWSQDLFRALWRSLSREVKEHVGTDQFGNKYYYIPQYKNWRAWIRRTRKTPPTMEEILKNEKHRRRNQNKKPRFL

SEQ ID NO: 839482 - protein, 113 aa, Homo sapiens; identical to SEQ ID NO: 839476

SEQ ID NO: 839483 - protein, 113 aa, Homo sapiens; identical to SEQ ID NO: 839476

SEQ ID NO: 839484 - protein, 67 aa, Homo sapiens
MNSEVPMNSDRYSSAPLLSPLDSAFFLRICTEVKPPALLELQLLLLGSLESPSIKAFLGLHMCLSGC

SEQ ID NO: 839485 - protein, 156 aa, Homo sapiens
MSRKSGIGHEASLKRKAEEKLESYRKKIHMKNQAEEKAAEQFRMRLKNKQDEMKLEGDLRRSQRACQQLDVQKNIQVPREAWYWLRLEEETEEDEEEKEQDEDEYKSEDLSVLEKLQILTSYLREEHLYCIWCGTAYEDKEDLSSNCPGPTSADHD

SEQ ID NO: 839486 - protein, 60 aa, Homo sapiens
MRSARSTALNRGEQRAVRYYSHMKLNMAEEEDYMSDSFINVQEDIRPGLPMLRQIREARR

SEQ ID NO: 839487 - protein, 164 aa, Homo sapiens
VEPIPLNIKTGKSGIGHEASLKRKAEEKLESYRKKIHMKNQAEEKAAEQFRMRLKNKQDEMKLEGDLRRSQRACQQLDVQKNIQVPREAWYWLRLEEETEEDEEEKEQDEDEYKSEDLSVLEKLQILTSYLREEHLYCIWCGTAYEDKEDLSSNCPGPTSADHD

SEQ ID NO: 839488 - protein, 142 aa, Homo sapiens
LSDNQRMDKLEKTNSSLRKQNLDLLEQFRMRLKNKQDEMKLEGDLRRSQRACQQLDVQKNIQVPREAWYWLRLEEETEEDEEEKEQDEDEYKSEDLSVLEKLQILTSYLREEHLYCIWCGTAYEDKEDLSSNCPGPTSADHD

SEQ ID NO: 839489 - protein, 105 aa, Homo sapiens
WGKGKPSETQRQARDDRDQGRGDWIQEGTQSRKRQMSPRVGHFSPGILTQGARIVPRARTPGPGRTRLKQLPSLARPLRETSPGPRAPTLTPAPTSLGQALPGYP

SEQ ID NO: 839490 - protein, 396 aa, Homo sapiens
KRGQLEKKQPECEEAHGREVQEEEKKQKFWHLFPGCAKMGDWSFLGNFLEEVHKHSTVVGKVWLTVLFIFRMLVLGTAAESSWGDEQADFRCDTIQPGCQNVCYDQAFPISHIRYWVLQIIFVSTPSLVYMGHAMHTVRMQEKRKLREAERAKEVRGSGSYEYPVAEKAELSCWEEGNGRIALQGTLLNTYVCSILIRTTMEVGFIVGQYFIYGIFLTTLHVCRRSPCPHPVNCYVSRPTEKNVFIVFMLAVAALSLLLSLAELYHLGWKKIRQRFVKPRQHMAKCQLSGPSVGIVQSCTPPPDFNQCLENGPGGKFFNPFSNNMASQQNTDNLVTEQVRGQEQTPGEGFIQVRYGQKPEVPNGVSPGHRLPHGYHSDKRRLSKASSKARSDDLSV

SEQ ID NO: 839491 - protein, 358 aa, Homo sapiens
MGDWSFLGNFLEEVHKHSTVVGKVWLTVLFIFRMLVLGTAAESSWGDEQADFRCDTIQPGCQNVCYDQAFPISHIRYWVLQIIFVSTPSLVYMGHAMHTVRMQEKRKLREAERAKEVRGSGSYEYPVAEKAELSCWEEGNGRIALQGTLLNTYVCSILIRTTMEVGFIVGQYFIYGIFLTTLHVCRRSPCPHPVNCYVSRPTEKNVFIVFMLAVAALSLLLSLAELYHLGWKKIRQRFVKPRQHMAKCQLSGPSVGIVQSCTPPPDFNQCLENGPGGKFFNPFSNNMASQQNTDNLVTEQVRGQEQTPGEGFIQVRYGQKPEVPNGVSPGHRLPHGYHSDKRRLSKASSKARSDDLSV

SEQ ID NO: 839492 - protein, 363 aa, Homo sapiens
SLHFQTVPPGRTQTGRGLQHKAASTGRRKFWHLFPGCAKMGDWSFLGNFLEEVHKHSTVVGKVWLTVLFIFRMLVLGTAAESSWGDEQADFRCDTIQPGCQNVCYDQAFPISHIRYWVLQIIFVSTPSLVYMGHAMHTVRMQEKRKLREAERAKEVRGSGSYEYPVAEKAELSCWEEGNGRIALQGTLLNTYVCSILIRTTMEVGFIVGQYFIYGIFLTTLHVCRRSPCPHPVNCYVSRPTEKNVFIVFMLAVAALSLLLSLAELYHLGWKKIRQRFVKPRQHMAKCQLSGPSVGIVQSCTPPPDFNQCLENGPGGKFFNPFSNNMASQQNTDNLITLPPPRKSSKFPANRQHESRNLHYMCS

SEQ ID NO: 839493 - protein, 318 aa, Homo sapiens
KRGQLEKKQPECEEAHGREVQEEEKKQKFWHLFPGCAKMGDWSFLGNFLEEVHKHSTVVGKVWLTVLFIFRMLVLGTAAESSWGDEQADFRCDTIQPGCQNVCYDQAFPISHIRYWVLQIIFVSTPSLVYMGHAMHTVRMQEKRKLREAERAKEVRGSGSYEYPVAEKAELSCWEEGNGRIALQGTLLNTYVCSILIRTTMEVGFIVGQYFIYGIFLTTLHVCRRSPCPHPVNCYVSRPTEKNVFIVFMLAVAALSLLLSLAELYHLGWKKIRQRFVKPRQHMAKCQLSGPSVGIVQSCTPPPTSISTLTSIKDPLDL

SEQ ID NO: 839494 - protein, 358 aa, Homo sapiens; identical to SEQ ID NO: 839491

SEQ ID NO: 839495 - protein, 358 aa, Homo sapiens; identical to SEQ ID NO: 839491

SEQ ID NO: 839496 - protein, 327 aa, Homo sapiens
KRGQLEKKQPECEEAHGREVQEEEKKQKFWHLFPGCAKMGDWSFLGNFLEEVHKHSTVVGKVWLTVLFIFRMLVLGTAAESSWGDEQADFRCDTIQPGCQNVCYDQAFPISHIRYWVLQIIFVSTPSLVYMGHAMHTVRMQEKRKLREAERAKEVRGSGSYEYPVAEKAELSCWEEGNGRIALQGTLLNTYVCSILIRTTMEVGFIVGQYFIYGIFLTTLHVCRRSPCPHPVNCYVSRPTEKNVFIVFMLAVAALSLLLSLAELYHLGWKKIRQRFVKPRQHMAKCQLSGPSVGIVQSCTPPPDFNQCLENGPGGKFFNPFSNLSFC

SEQ ID NO: 839497 - protein, 100 aa, Homo sapiens
CDPPAWASQSAGITGVSYASVPNWYQVLCWVCFSGWSASPWVDAVIIAILQWGKLRHMGLKNLPEVILPEVGKLGSSRPCLVPVCFQDLRAWMIPAFRDH

SEQ ID NO: 839498 - protein, 348 aa, Homo sapiens [sequence omitted]

SEQ ID NO: 839499 - protein, 326 aa, Homo sapiens
MRQTPLTCSGHTRPVVDLAFSGITPYGYFLISACKDGKPMLRQGDTGDWIGTFLGHKGAVWGATLNKDATKAATAAADFTAKVWDAVSGDELMTLAHKHIVKTVDFTQDSNYLLTGGQDKLLRIYDLNKPEAEPKEISGHTSGIKKALWCSEDKQILSADDKTVRLWDHATMTEVKSLNFNMSVSSMEYIPEGEILVITYGRSIAFHSAVSLDPIKSFEAPATINSASLHPEKEFLVAGGEDFKLYKYDYNSGEELESYKGHFGPIHCVRFSPDGELYASGSEDGTLRLWQTVVGKTYGLWKCVLPEEIASENSDCIFPSAPDVKA

SEQ ID NO: 839500 - protein, 348 aa, Homo sapiens [sequence omitted]

SEQ ID NO: 839501 - protein, 177 aa, Homo sapiens [sequence omitted]

SEQ ID NO: 839502 - protein, 348 aa, Homo sapiens [sequence omitted]

SEQ ID NO: 839503 - protein, 161 aa, Homo sapiens
VTGASKDLLGQTYCTMKSNRSSISLDPIKSFEAPATINSASLHPEKEFLVAGGEDFKLYKYDYNSGEELESYKGHFGPIHCVRFSPDGELYASGSEDGTLRLWQTVVGKTYGLWKCVLPEEDSGELAKPKIGFPETTEEELEEIASENSDCIFPSAPDVKA

SEQ ID NO: 839504 - protein, 176 aa, Homo sapiens
MRQTPLTCSGHTRPVVDLAFSGITPYGYFLISACKDGKPMLRQGDTGDWIGTFLGHKGAVWGATLNKDATKAATAAADFTAKVWDAVSGDELMTLAHKHIVKTVDFTQDSNYLLTGGQDKLLRIYDLNKPEAEPKEISGHTSGIKKALWCSEDKQILSADDKTVRTGDCLPIEQKI

SEQ ID NO: 839505 - protein, 60 aa, Homo sapiens
MRQTPLTCSGHTRPVVDLAFSGITPYGYFLISACKDGKPMLRNERFLKSVLDHPLPNERF

SEQ ID NO: 839506 - protein, 348 aa, Homo sapiens [sequence omitted]

SEQ ID NO: 839507 - protein, 329 aa, Homo sapiens
MRQTPLTCSGHTRPVVDLAFSGITPYGYFLISACKDGKPMLRQGDTGDWIGTFLGHKGAVWGATLNKDATKAATAAADFTAKVWDAVSGDELMTLAHKHIVKTVDFTQDSNYLLTGGQDKLLRIYDLNKPEAEPKEISGHTSGIKKALWCSEDKQILSADDKTVRLWDHATMTEVKSLNFNMSVSSMEYIPEGEILVITYGRSIAFHSAVSLDPIKSFEAPATINSASLHPEKEFLVAGGEDFKLYKYDYNSGEELELYASGSEDGTLRLWQTVVGKTYGLWKCVLPEEDSGELAKPKIGFPETTEEELEEIASENSDCIFPSAPDVKA

SEQ ID NO: 839508 - protein, 256 aa, Homo sapiens
MTLAHKHIVKTVDFTQDSNYLLTGGQDKLLRIYDLNKPEAEPKEISGHTSGIKKALWCSEDKQILSADDKTVRLWDHATMTEVKSLNFNMSVSSMEYIPEGEILVITYGRSIAFHSAVSLDPIKSFEAPATINSASLHPEKEFLVAGGEDFKLYKYDYNSGEELESYKGHFGPIHCVRFSPDGELYASGSEDGTLRLWQTVVGKTYGLWKCVLPEEDSGELAKPKIGFPETTEEELEEIASENSDCIFPSAPDVKA

SEQ ID NO: 839509 - protein, 351 aa, Homo sapiens
MRQTPLTCSGHTRPVVDLAFSGITPYGYFLISACKDGKPMLRQGDTGDWIGTFLGHKGAVWGATLNKDATKAATAAADFTAKVWDAVSGDELMTLAHKHIVKTVDFTQRIVTLLLPRATRIHLVTHLCTSPTREAEPKEISGHTSGIKKALWCSEDKQILSADDKTVRLWDHATMTEVKSLNFNMSVSSMEYIPEGEILVITYGRSIAFHSAVSLDPIKSFEAPATINSASLHPEKEFLVAGGEDFKLYKYDYNSGEELESYKGHFGPIHCVRFSPDGELYASGSEDGTLRLWQTVVGKTYGLWKCVLPEEDSGELAKPKIGFPETTEEELEEIASENSDCIFPSAPDVKA

SEQ ID NO: 839510 - protein, 167 aa, Homo sapiens
CTRRRSSYYFVHHDLCPGLVPRRVHAHAESLDPIKSFEAPATINSASLHPEKEFLVAGGEDFKLYKYDYNSGEELESYKGHFGPIHCVRFSPDGELYASGSEDGTLRLWQTVVGKTYGLWKCVLPEEDSGELAKPKIGFPETTEEELEEIASENSDCIFPSAPDVKA

SEQ ID NO: 839511 - protein, 109 aa, Homo sapiens
MRQTPLTCSGHTRPVVDLAFSGITPYGYFLISACKDGKPMLRQGDTGDWIGTFLGHKGAVWGATLNKDATKAATAAADFTAVSVAKMANFGVLCSLCPEIIKNFSVRYS

SEQ ID NO: 839512 - protein, 778 aa, Homo sapiens
MPAFLGLKCLGKLCSSEKSKVTSSERTSARGSNRKRLIVEDRRVSGTSFTAHRRATITHLLYLCPKDYCPRGRVCNSVDPFVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLEAGDKHYHPSCARCSRCNQMFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPGNEPSSGRNSPLPYRPDSLPLTPTYAQAPKHFHVPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 839513 - protein, 220 aa, Homo sapiens
SCGRRPRTGSRRGPGPGGRSGAAFFPAPCGAVQRLPAPAPAACTMSARVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSKKMVAAVGREWTTDNQKRKTNDPGSSENF

SEQ ID NO: 839514 - protein, 462 aa, Homo sapiens
MFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPGNEPSSGRNSPLPYRPDSLPLTPTYAQAPKHFHVPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 839515 - protein, 718 aa, Homo sapiens
MLMTLEMTELTDPHHTMGDYKVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLEAGDKHYHPSCARCSRCNQMFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPGNEPSSGRNSPLPYRPDSLPLTPTYAQAPKHFHVPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 839516 - protein, 701 aa, Homo sapiens
MGLYVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLEAGDKHYHPSCARCSRCNQMFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPGNEPSSGRNSPLPYRPDSLPLTPTYAQAPKHFHVPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 839517 - protein, 401 aa, Homo sapiens
MFTEGEEMYLQGSTVWHPDCKQSTKTEEKLRAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 839518 - protein, 778 aa, Homo sapiens [sequence omitted]

SEQ ID NO: 839519 - protein, 427 aa, Homo sapiens
MFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 839520 - protein, 575 aa, Homo sapiens
SQWVCRHWRDPVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLRQVTNITTPAVHDAADATRCSQKERKCIFKSPRTLSPTPSAEGYQDVRDRMIHRSTSQGSINSPVYSRHSYTPTTSRSPQHFHRPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 839521 - protein, 197 aa, Homo sapiens [sequence omitted]

SEQ ID NO: 839522 - protein, 126 aa, Homo sapiens [sequence omitted]

SEQ ID NO: 839523 - protein, 778 aa, Homo sapiens; identical to SEQ ID NO: 839512

SEQ ID NO: 839524 - protein, 778 aa, Homo sapiens; identical to SEQ ID NO: 839512

SEQ ID NO: 839525 - protein, 191 aa, Homo sapiens
MFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPDQGINIYRKPPIYKQHVLFEVILLLLI

SEQ ID NO: 839526 - protein, 269 aa, Homo sapiens
MFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPDQGINIYRKPPIYKQHAALAAQSKSSEDIIKFSKFPAAQAPDPSETPKIETDHWPGPPSFAVVGPDMKRRSSGREEDDEELLRRRQLQEEQLMKKKPTVSKNEES

SEQ ID NO: 839527 - protein, 194 aa, Homo sapiens
MFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPVKFPGALLTGGLYSERSLCAGFCALLRRSN

SEQ ID NO: 839528 - protein, 187 aa, Homo sapiens
MFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPVRVTVPGFTLYNKLCFCDFFPYY

SEQ ID NO: 839529 - protein, 270 aa, Homo sapiens
SQWVCRHWRDPVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLEAGDKHYHPSCARCSRCNQMFTEGEEMYLQGNLGKSTERILEY

SEQ ID NO: 839530 - protein, 154 aa, Homo sapiens [sequence omitted]

SEQ ID NO: 839531 - protein, 708 aa, Homo sapiens
SQWVCRHWRDPVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLEAGDKHYHPSCARCSRCNQMFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPGNEPSSGRNSPLPYRPDSLPLTPTYAQAPKHFHVPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 839532 - protein, 626 aa, Homo sapiens
MYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLEAGDKHYHPSCARCSRCNQMFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPGNEPSSGRNSPLPYRPDSLPLTPTYAQAPKHFHVPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 839533 - protein, 700 aa, Homo sapiens
MAHVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLEAGDKHYHPSCARCSRCNQMFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPGNEPSSGRNSPLPYRPDSLPLTPTYAQAPKHFHVPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 839534 - protein, 427 aa, Homo sapiens; identical to SEQ ID NO: 839519

SEQ ID NO: 839535 - protein, 778 aa, Homo sapiens; identical to SEQ ID NO: 839512

SEQ ID NO: 839536 - protein, 124 aa, Homo sapiens
HYERISVTVRTLGSCSVLGSKPWSPFGPAGSSPCLFPLLSSLAKRPWPPLCPFGYKEGIDDSVAWGQERDTLHEHFSSHLIPPSQGKRHLAPEVFREIFGMSIQEFDRLPLWRRNDMKKKAKLF

SEQ ID NO: 839537 - protein, 778 aa, Homo sapiens; identical to SEQ ID NO: 839512

SEQ ID NO: 839538 - protein, 272 aa, Homo sapiens
MFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKANV

SEQ ID NO: 839539 - protein, 353 aa, Homo sapiens
MFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYRHSQIATACEPMRDPL

SEQ ID NO: 839540 - protein, 187 aa, Homo sapiens; identical to SEQ ID NO: 839528

SEQ ID NO: 839541 - protein, 296 aa, Homo sapiens
SQWVCRHWRDPVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLEAGDKHYHPSCARCSRCNQMFTEGEEMYLQGSTVWHPDCKQSTKTEEKLRLCWYTLLRSVHEEVEAQGS

SEQ ID NO: 839542 - protein, 585 aa, Homo sapiens [sequence omitted]

SEQ ID NO: 839543 - protein, 661 aa, Homo sapiens
MAFDVSCFFWVVLFSAGCKVITSWDQMCIEKEANKTYNCENLGLSEIPDTLPNTTEFLEFSFNFLPTIHNRTFSRLMNLTFLDLTRCQINWIHEDTFQSHHQLSTLVLTGNPLIFMAETSLNGPKSLKHLFLIQTGISNLEFIPVHNLENLESLYLGSNHISSIKFPKDFPARNLKVLDFQNNAIHYISREDMRSLEQAINLSLNFNGNNVKGIELGAFDSTVFQSLNFGGTPNLSVIFNGLQNSTTQSLWLGTFEDIDDEDISSAMLKGLCEMSVESLNLQEHRFSDISSTTFQCFTQLQELDLTATHLKGLPSGMKGLNLLKKLVLSVNHFDQLCQISAANFPSLTHLYIRGNVKKLHLGVGCLEKLGNLQTLDLSHNDIEASDCCSLQLKNLSHLQTLNLSHNEPLGLQSQAFKECPQLELLDLAFTRLHINAPQSPFQNLHFLQVLNLTYCFLDTSNQHLLAGLPVLRHLNLKGNHFQDGTITKTNLLQTVGSLEVLILSSCGLLSIDQQAFHSLGKMSHVDLSHNSLTCDSIDSLSHLKGIYLNLAANSINIISPRLLPILSQQSTINLSHNPLDCTCSNIHFLTWYKENLHKLEGSEETTCANPPSLRGVKLSDVKLSCGITAIGIFFLIVFLLLLAILLFFAVKYLLRWKYQHI

SEQ ID NO: 839544 - protein, 1437 aa, Homo sapiens
RGTLYGGREDAADVLAASPEAAPGGAGGIVSLIWPPECQGGVPAAVIMVKEQFRETDVAKKISHICFGMKSPEEMRQQAHIQVVSKNLYSQDNQHAPLLYGVLDHRMGTSEKDRPCETCGKNLADCLGHYGYIDLELPCFHVGYFRAVIGILQMICKTCCHIMLSQEEKKQFLDYLKRPGLTYLQKRGLKKKISDKCRKKNICHHCGAFNGTVKKCGLLKIIHEKYKTNKKVVDPIVSNFLQSFETAIEHNKEVEPLLGRAQENLNPLVVLNLFKRIPAEDVPLLLMNPEAGKPSDLILTRLLVPPLCIRPSVVSDLKSGTNEDDLTMKLTEIIFLNDVIKKHRISGAKTQMIMEDWDFLQLQCALYINSELSGIPLNMAPKKWTRGFVQRLKGKQGRFRGNLSGKRVDFSGRTVISPDPNLRIDEVAVPVHVAKILTFPEKVNKANINFLRKLVQNGPEVHPGANFIQQRHTQMKRFLKYGNREKMAQELKYGDIVERHLIDGDVVLFNRQPSLHKLSIMAHLARVKPHRTFRFNECVCTPYNADFDGDEMNLHLPQTEEAKAEALVLMGTKANLVTPRNGEPLIAAIQDFLTGAYLLTLKDTFFDRAKACQIIASILVGKDEKIKVRLPPPTILKPVTLWTGKQIFSVILRPSDDNPVRANLRTKGKQYCGKGEDLCANDSYVTIQNSELMSGSMDKGTLGSGSKNNIFYILLRDWGQNEAADAMSRLARLAPVYLSNRGFSIGIGDVTPGQGLLKAKYELLNAGYKKCDEYIEALNTGKLQQQPGCTAEETLEALILKELSVIRDHAGSACLRELDKSNSPLTMALCGSKGSFINISQMIACVGQQAISGSRVPDGFENRSLPHFEKHSKLPAAKGFVANSFYSGLTPTEFFFHTMAGREGLVDTAVKTAETGYMQRRLVKSLEDLCSQYDLTVRSSTGDIIQFIYGGDGLDPAAMEGKDEPLEFKRVLDNIKAVFPCPSEPALSKNELILTTESIMKKSEFLCCQDSFLQEIKKFIKGVSEKIKKTRDKYGINDNGTTEPRVLYQLDRITPTQVEKFLETCRDKYMRAQMEPGSAVGALCAQSIGEPGTQMTLKTFHFAGVASMNITLGVPRIKEIINASKAISTPIITAQLDKDDDADYARLVKGRIEKTLLGEISEYIEEVFLPDDCFILVKLSLERIRLLRLEVNAETVRYSICTSKLRVKPGDVAVHGEAVVCVTPRENSKSSMYYVLQFLKEDLPKVVVQGIPEVSRAVIHIDEQSGKEKYKLLVEGDNLRAVMATHGVKGTRTTSNNTYEVEKTLGIEAARTTIINEIQYTMVNHGMSIDRRHVMLLSDLMTYKGEVLGITRFGLAKMKESVLMLASFEKTADHLFDAAYFGQKDSVCGVSECIIMGIPMNIGTGLFKLLHKADRDPNPPKRPLIFDTNEFHIPLVT

SEQ ID NO: 839545 - protein, 1314 aa, Homo sapiens
RGTLYGGREDAADVLAASPEAAPGGAGGIVSLIWPPECQGGVPAAVIMVKEQFRETDVAKKISHICFGMKSPEEMRQQAHIQVVSKNLYSQDNQHAPLLYGVLDHRMGTSEKDRPCETCGKNLADCLGHYGYIDLELPCFHVGYFRAVIGILQMICKTCCHIMLSQEEKKQFLDYLKRPGLTYLQKRGLKKKISDKCRKKNICHHCGAFNGTVKKCGLLKIIHEKYKTNKKVVDPIVSNFLQSFETAIEHNKEVEPLLGRAQENLNPLVVLNLFKRIPAEDVPLLLMNPEAGKPSDLILTRLLVPPLCIRPSVVSDLKSGTNEDDLTMKLTEIIFLNDVIKKHRISGAKTQMIMEDWDFLQLQCALYINSELSGIPLNMAPKKWTRGFVQRLKGKQGRFRGNLSGKRVDFSGRTVISPDPNLRIDEVAVPVHVAKILTFPEKVNKANINFLRKLVQNGPEVHPGANFIQQRHTQMKRFLKYGNREKMAQELKYGDIVERHLIDGDVVLFNRQPSLHKLSIMAHLARVKPHRTFRFNECVCTPYNADFDGDEMNLHLPQTEEAKAEALVLMGTKANLVTPRNGEPLIAAIQDFLTGAYLLTLKDTFFDRAKACQIIASILVGKDEKIKVRLPPPTILKPVTLWTGKQIFSVILRPSDDNPVRANLRTKGKQYCGKGEDLCANDSYVTIQNSELMSGSMDKGTLGSGSKNNIFYILLRDWGQNEAADAMSRLARLAPVYLSNRGFSIGIGDVTPGQGLLKAKYELLNAGYKKCDEYIEALNTGKLQQQPGCTAEETLERRLVKSLEDLCSQYDLTVRSSTGDIIQFIYGGDGLDPAAMEGKDEPLEFKRVLDNIKAVFPCPSEPALSKNELILTTESIMKKSEFLCCQDSFLQEIKKFIKGVSEKIKKTRDKYGINDNGTTEPRVLYQLDRITPTQVEKFLETCRDKYMRAQMEPGSAVGALCAQSIGEPGTQMTLKTFHFAGVASMNITLGVPRIKEIINASKAISTPIITAQLDKDDDADYARLVKGRIEKTLLGEISEYIEEVFLPDDCFILVKLSLERIRLLRLEVNAETVRYSICTSKLRVKPGDVAVHGEAVVCVTPRENSKSSMYYVLQFLKEDLPKVVVQGIPEVSRAVIHIDEQSGKEKYKLLVEGDNLRAVMATHGVKGTRTTSNNTYEVEKTLGIEAARTTIINEIQYTMVNHGMSIDRRHVMLLSDLMTYKGEVLGITRFGLAKMKESVLMLASFEKTADHLFDAAYFGQKDSVCGVSECIIMGIPMNIGTGLFKLLHKADRDPNPPKRPLIFDTNEFHIPLVT

SEQ ID NO: 839546 - protein, 1414 aa, Homo sapiens
RGTLYGGREDAADVLAASPEAAPGGAGGIVSLIWPPECQGGVPAAVIMVKEQFRETDVAKKISHICFGMKSPEEMRQQAHIQVVSKNLYSQDNQHAPLLYGVLDHRMGTSEKDRPCETCGKNLADCLGHYGYIDLELPCFHVGYFRAVIGILQMICKTCCHIMLSQEEKKQFLDYLKRPGLTYLQKRGLKKKISDKCRKKNICHHCGAFNGTVKKCGLLKIIHEKYKTNKKVVDPIVSNFLQSFETAIEHNKEVEPLLGRAQENLNPLVVLNLFKRIPAEDVPLLLMNPEAGKPSDLILTRLLVPPLCIRPSVVSDLKSGTNEDDLTMKLTEIIFLNDVIKKHRISGAKTQMIMEDWDFLQLQCALYINSELSGIPLNMAPKKWTRGFVQRLKGKQGRFRGNLSGKRVDFSGRTVISPDPNLRIDEVAVPVHVAKILTFPEKVNKANINFLRKLVQNGPEVHPGANFIQQRHTQMKRFLKYGNREKMAQELKYGDIVERHLIDGDVVLFNRQPSLHKLSIMAHLARVKPHRTFRFNECVCTPYNADFDGDEMNLHLPQTEEAKAEALVLMGTKANLVTPRNGEPLIAAIQDFLTGAYLLTLKDTFFDRAKACQIIASILVGKDEKIKVRLPPPTILKPVTLWTGKQIFSVILRPSDDNPVRANLRTKGKQYCGKGEDLCANDSYVTIQNSELMSGSMDKGTLGSGSKNNIFYILLRDWGQNEAADAMSRLARLAPVYLSNRGFSIGIGDVTPGQGLLKAKYELLNAGYKKCDEYIEALNTGKLQQQPGCTAEETLEALILKELSVIRDHAGSACLRELDKSNSPLTMALCGSKGSFINISQMIACVGQQAISGSRVPDGFENRSLPHFEKHSKLPAAKGFVANSFYSGLTPTEFFFHTMAGREGLVDTAVKTAETGYMQRRLVKSLEDLCSQYDLTVRSSTGDIIQFIYGGDGLDPAAMEGKDEPLEFKRVLDNIKAVFPCPSEPALSKNELILTTESIMKKSEFLCCQDSFLQEIKKFIKGVSEKIKKTRDKYGINDNGTTEPRVLYQLDRITPTQVEKFLETCRDKYMRAQMEPGSAVGALCAQSIGEPGTQMTLKTFHFAGVASMNITLGVPRIKEIINASKAISTPIITAQLDKDDDADYARLDDCFILVKLSLERIRLLRLEVNAETVRYSICTSKLRVKPGDVAVHGEAVVCVTPRENSKSSMYYVLQFLKEDLPKVVVQGIPEVSRAVIHIDEQSGKEKYKLLVEGDNLRAVMATHGVKGTRTTSNNTYEVEKTLGIEAARTTIINEIQYTMVNHGMSIDRRHVMLLSDLMTYKGEVLGITRFGLAKMKESVLMLASFEKTADHLFDAAYFGQKDSVCGVSECIIMGIPMNIGTGLFKLLHKADRDPNPPKRPLIFDTNEFHIPLVT

SEQ ID NO: 839547 - protein, 1027 aa, Homo sapiens
RGTLYGGREDAADVLAASPEAAPGGAGGIVSLIWPPECQGGVPAAVIMVKEQFRETDVAKKISHICFGMKSPEEMRQQAHIQVVSKNLYSQDNQHAPLLYGVLDHRMGTSEKDRPCETCGKNLADCLGHYGYIDLELPCFHVGYFRAVIGILQMICKTCCHIMLSQEEKKQFLDYLKRPGLTYLQKRGLKKKISDKCRKKNICHHCGAFNGTVKKCGLLKIIHEKYKTNKKVVDPIVSNFLQSFETAIEHNKEVEPLLGRAQENLNPLVVLNLFKRIPAEDVPLLLMNPEAGKPSDLILTRLLVPPLCIRPSVVSDLKSGTNEDDLTMKLTEIIFLNDVIKKHRISGAKTQMIMEDWDFLQLQCALYINSELSGIPLNMAPKKWTRGFVQRLKGKQGRFRGNLSGKRVDFSGRTVISPDPNLRIDEVAVPVHVAKILTFPEKVNKANINFLRKLVQNGPEVHPGANFIQQRHTQMKRFLKYGNREKMAQELKYGDIVERHLIDGDVVLFNRQPSLHKLSIMAHLARVKPHRTFRFNECVCTPYNADFDGDEMNLHLPQTEEAKAEALVLMGTKANLVTPRNGEPLIAAIQDFLTGAYLLTLKDTFFDRAKACQIIASILVGKDEKIKVRLPPPTILKPVTLWTGKQIFSVILRPSDDNPVRANLRTKGKQYCGKGEDLCANDSYVTIQNSELMSGSMDKGTLGSGSKNNIFYILLRDWGQNEAADAMSRLARLAPVYLSNRGFSIGIGDVTPGQGLLKAKYELLNAGYKKCDEYIEALNTGKLQQQPGCTAEETLEALILKELSVIRDHAGSACLRELDKSNSPLTMALCGSKGSFINISQMIACVGQQAISGSRVPDGFENRSLPHFEKHSKLPAAKGFVANSFYSGLTPTEFFFHTMAGREGLVDTAVKTAETGYMQRRLVKSLEDLCSQYDLTVRSSTGDIIQFIYGGDGLDPAAMEGKDEPLEFKRVLDNIKAVFPCPSEPALSKNELILTTESIMKKSEFLCCQDSFLQSSEVELVTVYGHM

SEQ ID NO: 839548 - protein, 1437 aa, Homo sapiens; identical to SEQ ID NO: 839544

SEQ ID NO: 839549 - protein, 1437 aa, Homo sapiens; identical to SEQ ID NO: 839544

SEQ ID NO: 839550 - protein, 72 aa, Homo sapiens
PLRLFPSSVAHVTGPLGCELHPIRGEAAPGDAKTGFSGLSGIRWGPLGPPSSGKLQNSVIHQLEHRDKEIQA

SEQ ID NO: 839551 - protein, 348 aa, Homo sapiens
RAGTGLLLSGGGSMAAGAAEAAVAAVEEVGSAGQFEELLRLKAKSLLVVHFWAPWAPQCAQMNEVMAELAKELPQVSFVKLEAEGVPEVSEKYEISSVPTFLFFKNSQKIDRLDGAHAPELTKKVQRHASSGSFLPSANEHLKEDLNLRLKKLTHAAPCMLFMKGTPQEPRCGFSKQMVEILHKHNIQFSSFDIFSDEEVRQGLKAYSSWPTYPQLYVSGELIGGLDIIKELEASEELDTICPKAPKLEERLKVLTNKASVMLFMKGNKQEAKCGFSKQILEILNSTGVEYETFDILEDEEVRQGLKAYSNWPTYPQLYVKGELVGGLDIVKELKENGELLPILRGEN

SEQ ID NO: 839552 - protein, 348 aa, Homo sapiens; identical to SEQ ID NO: 839551

SEQ ID NO: 839553 - protein, 348 aa, Homo sapiens; identical to SEQ ID NO: 839551

SEQ ID NO: 839554 - protein, 348 aa, Homo sapiens; identical to SEQ ID NO: 839551

SEQ ID NO: 839555 - protein, 348 aa, Homo sapiens; identical to SEQ ID NO: 839551

SEQ ID NO: 839556 - protein, 395 aa, Homo sapiens
RAGTGLLLSGGGSMAAGAAEAAVAAVEEVGSAGQFEELLRLKAKSLLVVHFWAPWAPQCAQMNEVMAELAKELPQVSFVKLEAEGVPEVSEKYEISSVPTFLFFKNSQKIDRLDGAHAPELTKKVQRHASSGSFLPSANEHLKEDLNLRLKKLTHAAPCMLFMKGTPQEPRCGFSKQMVEILHKHNIQFSSFDIFSDEEVRQGLKAYSSWPTYPQLYVSGELIGGLDIIKELEASEELDTICPKAPKLEERLKVLTNKASVMLFMKGNKQEAKCGFSKQILEILNSTGVEYETFDILEDEEVRQGLKAYSNWPTYPQLYVKGELVGGLDIVKELKENGELLPILRGELGAVHDLVLRNGLGIENSCFLSYMFCVFHNVVLNKCMLHFFPTKNRMQ

SEQ ID NO: 839557 - protein, 315 aa, Homo sapiens
MLTSVRACRERSLLVVHFWAPWAPQCAQMNEVMAELAKELPQVSFVKLEAEGVPEVSEKYEISSVPTFLFFKNSQKIDRLDGAHAPELTKKVQRHASSGSFLPSANEHLKEDLNLRLKKLTHAAPCMLFMKGTPQEPRCGFSKQMVEILHKHNIQFSSFDIFSDEEVRQGLKAYSSWPTYPQLYVSGELIGGLDIIKELEASEELDTICPKAPKLEERLKVLTNKASVMLFMKGNKQEAKCGFSKQILEILNSTGVEYETFDILEDEEVRQGLKAYSNWPTYPQLYVKGELVGGLDIVKELKENGELLPILRGEN

SEQ ID NO: 839558 - protein, 284 aa, Homo sapiens
RAGTGLLLSGGGSMAAGAAEAAVAAVEEVGSAGQFEELLRLKAKSLLVVHFWAPWAPQCAQMNEVMAELAKELPQVSFVKLEAEGVPEVSEKYEISSVPTFLFFKNSQKIDRLDGAHAPELTKKVQRHASSGSFLPSANEHLKEDLNLRLKKLTHAAPCMLFMKGTPQEPRCGFSKQMVEILHKHNIQFSSFDIFSDEEVRQGLKAYSSWPTYPQLYVSGELIGGLDIIKELEASEELDTICPKAPKLEERLKVLTNKASVMLFMKGNKQGAKCGFRKQFWNTK

SEQ ID NO: 839559 - protein, 317 aa, Homo sapiens
MAAGAAEAAVAAVEEVGSAGQFEELLRLKAKSLLVVHFWAPWAPQCAQMNEVMAELAKELPQVSFVKLEAEGVPEVSEKYEISSVPTFLFFKNSQKIDRLDGAHAPELTNLKEDLNLRLKKLTHAAPCMLFMKGTPQEPRCGFSKQMVEILHKHNIQFSSFDIFSDEEVRQGLKAYSSWPTYPQLYVSGELIGGLDIIKELEASEELDTICPKAPKLEERLKVLTNKASVMLFMKGNKQEAKCGFSKQILEILNSTGVEYETFDILEDEEVRQGLKAYSNWPTYPQLYVKGELVGGLDIVKELKENGELLPILRGEN

SEQ ID NO: 839560 - protein, 114 aa, Homo sapiens
GREARLEAPAPALAPTPTAVQARGTRPSRPLAWAAPPRDGGGGDSAVPQWRGGGRGGAETPALRATERDPRLRAPPFLCPPGGSGRLGVGPLLFSLPSGTPLSQEERRGKAPLH

SEQ ID NO: 839561 - protein, 81 aa, Homo sapiens
SRGSHMIAPRSMKGNKQEAKCGFSKQILEILNSTGVEYETFDILEDEEVRQGLKAYSNWPTYPQLYVKGELVEQLMWDTDA

SEQ ID NO: 839562 - protein, 335 aa, Homo sapiens
MAAGAAEAAVAAVEEVGSAGQFEELLRLKAKSLLVVHFWAPWAPQCAQMNEVMAELAKELPQVSFVKLEAEGVPEVSEKYEISSVPTFLFFKNSQKIDRLDGAHAPELTKKVQRHASSGSFLPSANEHLKEDLNLRLKKLTHAAPCMLFMKGTPQEPRCGFSKQMVEILHKHNIQFSSFDIFSDEEVRQGLKAYSSWPTYPQLYVSGELIGGLDIIKELEASEELDTICPKAPKLEERLKVLTNKASVMLFMKGNKQEAKCGFSKQILEILNSTGVEYETFDILEDEEVRQGLKAYSNWPTYPQLYVKGELVGGLDIVKELKENGELLPILRGEN

SEQ ID NO: 839563 - protein, 335 aa, Homo sapiens; identical to SEQ ID NO: 839562

SEQ ID NO: 839564 - protein, 348 aa, Homo sapiens; identical to SEQ ID NO: 839551

SEQ ID NO: 839565 - protein, 356 aa, Homo sapiens
RAGTGLLLSGGGSMAAGAAEAAVAAVEEVGSAGQFEELLRLKAKSLLVVHFWAPWAPQCAQMNEVMAELAKELPQVSFVKLEAEGVPEVSEKYEISSVPTFLFFKNSQKIDRLDGAHAPELTKKVQRHASSGSFLPSANEHLKEDLNLRLKKLTHAAPCMLFMKGTPQEPRCGFSKQMVEILHKHNIQFSSFDIFSDEEVRQGLKAYSSWPTYPQLYVSGELIGGLDIIKELEASEELDTICPKAPKLEERLKVLTNKASVMLFMKGNKQEAKCGFSKQILEILNSTGVEYETFDILEDEEVRQGLKAYSNWPTYPQLYVKGELVGGLDIVKTGSGSALQPGRQSETWSQKKKKRI

SEQ ID NO: 839566 - protein, 189 aa, Homo sapiens
MLFMKGTPQEPRCGFSKQMVEILHKHNIQFSSFDIFSDEEVRQGLKAYSSWPTYPQLYVSGELIGGLDIIKELEASEELDTICPKAPKLEERLKVLTNKASVMLFMKGNKQEAKCGFSKQILEILNSTGVEYETFDILEDEEVRQGLKAYSNWPTYPQLYVKGELVGGLDIVKELKENGELLPILRGEN

SEQ ID NO: 839567 - protein, 95 aa, Homo sapiens
SRGSHMIAPRSMKGNKQEAKCGFSKQILEILNSTGVEYETFDILEDEEVRQGLKAYSNWPTYPQLYVKGELVGGLDIVKELKENGELLPILRGEN

SEQ ID NO: 839568 - protein, 1121 aa, Homo sapiens
MPIVDKLKEALKPGRKDSADDGELGKLLASSAKKVLLQKIEFEPASKSFSYQLEALKSKYVLLNPKTEGASRHKSGDDPPARRQGSEHTYESCGDGVPAPQKVLFPTERLSLRWERVFRVGAGLHNLGNTCFLNATIQCLTYTPPLANYLLSKEHARSCHQGSFCMLCVMQNHIVQAFANSGNAIKPVSFIRDLKKIARHFRFGNQEDAHEFLRYTIDAMQKACLNGCAKLDRQTQATTLVHQIFGGYLRSRVKCSVCKSVSDTYDPYLDVALEIRQAANIVRALELFVKADVLSGENAYMCAKCKKKVPASKRFTIHRTSNVLTLSLKRFANFSGGKITKDVGYPEFLNIRPYMSQNNGDPVMYGLYAVLVHSGYSCHAGHYYCYVKASNGQWYQMNDSLVHSSNVKVVLNQQAYVLFYLRIPGSKKSPEGLISRTGSSSLPGRPSVIPDHSKKNIGNGIISSPLTGKRQDSGTMKKPHTTEEIGVPISRNGSTLGLKSQNGCIPPKLPSGSPSPKLSQTPTHMPTILDDPGKKVKKPAPPQHFSPRTAQGLPGTSNSNSSRSGSQRQGSWDSRDVVLSTSPKLLATATANGHGLKGNDESAGLDRRGSSSSSPEHSASSDSTKAPQTPRSGAAHLCDSQETNCSTAGHSKTPPSGADSKTVKLKSPVLSNTTTEPASTMSPPPAKKLALSAKKASTLWRATGNDLRPPPPSPSSDLTHPMKTSHPVVASTWPVHRARAVSPAPQSSSRLQPPFSPHPTLLSSTPKPPGTSEPRSCSSISTALPQVNEDLVSLPHQLPEASEPPRSPSEKRKKTFVGEPQRLGSETCLPQHIREATAAPHGKRKRKKKKRPEDTAASALQEGQTQRQPGSPMYRREGQAQLPAVRRQEDGTQPQVNGQQVGCVTDGHHASSRKRRRKGAEGLGEEGGLHQDPLRHSCSPMGDGDPEAMEESPRKKKKRKQETQRAVEEDGHLKCPRSAKPQDAVVPESSSCAPSANGWCPGDRMGLSQAPPVSWNGERESDVVQELLKYSSDKAYGRKVLTWDGKMSAVSQDAIEDSRQARTETVVDDWDEEFDRGKEKKIKKFKREKRRNFNAFQKLQTRRNFWSVTHPAKAASLSYRR

SEQ ID NO: 839569 - protein, 818 aa, Homo sapiens
MGAIPRVILLSPSLKGWGLLFRLDRQTQATTLVHQIFGGYLRSRVKCSVCKSVSDTYDPYLDVALEIRQAANIVRALELFVKADVLSGENAYMCAKCKKKVPASKRFTIHRTSNVLTLSLKRFANFSGGKITKDVGYPEFLNIRPYMSQNNGDPVMYGLYAVLVHSGYSCHAGHYYCYVKASNGQWYQMNDSLVHSSNVKVVLNQQAYVLFYLRIPGSKKSPEGLISRTGSSSLPGRPSVIPDHSKKNIGNGIISSPLTGKRQDSGTMKKPHTTEEIGVPISRNGSTLGLKSQNGCIPPKLPSGSPSPKLSQTPTHMPTILDDPGKKVKKPAPPQHFSPRTAQGLPGTSNSNSSRSGSQRQGSWDSRDVVLSTSPKLLATATANGHGLKGNDESAGLDRRGSSSSSPEHSASSDSTKAPQTPRSGAAHLCDSQETNCSTAGHSKTPPSGADSKTVKLKSPVLSNTTTEPASTMSPPPAKKLALSAKKASTLWRATGNDLRPPPPSPSSDLTHPMKTSHPVVASTWPVHRARAVSPAPQSSSRLQPPFSPHPTAASALQEGQTQRQPGSPMYRREGQAQLPAVRRQEDGTQPQVNGQQVGCVTDGHHASSRKRRRKGAEGLGEEGGLHQDPLRHSCSPMGDGDPEAMEESPRKKKKRKQETQRAVEEDGHLKCPRSAKPQDAVVPESSSCAPSANGWCPGDRMGLSQAPPVSWNGERESDVVQELLKYSSDKAYGRKVLTWDGKMSAVSQDAIEDSRQARTETVVDDWDEEFDRGKEKKIKKFKREKRRNFNAFQKLQTRRNFWSVTHPAKAASLSYRR

SEQ ID NO: 839570 - protein, 74 aa, Homo sapiens
MLHDDIPTLANYSGGKITKDVGYPEFLNIRPYMSQNNGDPVMYGLYAVLVHSGYSCHAGHYYCYVKLKHAGSSR

SEQ ID NO: 839571 - protein, 1121 aa, Homo sapiens; identical to SEQ ID NO: 839568

SEQ ID NO: 839572 - protein, 917 aa, Homo sapiens
MGLLDGAIPRVILLSPSLKGWGLLFRLDRQTQATTLVHQIFGGYLRSRVKCSVCKSVSDTYDPYLDVALEIRQAANIVRALELFVKADVLSGENAYMCAKCKKKVPASKRFTIHRTSNVLTLSLKRFANFSGGKITKDVGYPEFLNIRPYMSQNNGDPVMYGLYAVLVHSGYSCHAGHYYCYVKASNGQWYQMNDSLVHSSNVKVVLNQQAYVLFYLRIPGSKKSPEGLISRTGSSSLPGRPSVIPDHSKKNIGNGIISSPLTGKRQDSGTMKKPHTTEEIGVPISRNGSTLGLKSQNGCIPPKLPSGSPSPKLSQTPTHMPTILDDPGKKVKKPAPPQHFSPRTAQGLPGTSNSNSSRSGSQRQGSWDSRDVVLSTSPKLLATATANGHGLKGNDESAGLDRRGSSSSSPEHSASSDSTKAPQTPRSGAAHLCDSQETNCSTAGHSKTPPSGADSKTVKLKSPVLSNTTTEPASTMSPPPAKKLALSAKKASTLWRATGNDLRPPPPSPSSDLTHPMKTSHPVVASTWPVHRARAVSPAPQSSSRLQPPFSPHPTLLSSTPKPPGTSEPRSCSSISTALPQVNEDLVSLPHQLPEASEPPRSPSEKRKKTFVGEPQRLGSETCLPQHIREATAAPHGKRKRKKKKRPEDTAASALQEGQTQRQPGSPMYRREGQAQLPAVRRQEDGTQPQVNGQQVGCVTDGHHASSRKRRRKGAEGLGEEGGLHQDPLRHSCSPMGDGDPEAMEESPRKKKKRKQETQRAVEEDGHLKCPRSAKPQDAVVPESSSCAPSANGWCPGDRMGLSQAPPVSWNGERESDVVQELLKYSSDKAYGRKVLTWDGKMSAVSQDAIEDSRQARTETVVDDWDEEFDRGKEKKIKKFKREKRRNFNAFQKLQTRRNFWSVTHPAKAASLSYRR

SEQ ID NO: 839573 - protein, 1121 aa, Homo sapiens; identical to SEQ ID NO: 839568

SEQ ID NO: 839574 - protein, 699 aa, Homo sapiens
MQSRALGFLLGTISPEAAPASTTPWAQSSASKPSEELSSSSSSLTGKRQDSGTMKKPHTTEEIGVPISRNGSTLGLKSQNGCIPPKLPSGSPSPKLSQTPTHMPTILDDPGKKVKKPAPPQHFSPRTAQGLPGTSNSNSSRSGSQRQGSWDSRDVVLSTSPKLLATATANGHGLKGNDESAGLDRRGSSSSSPEHSASSDSTKAPQTPRSGAAHLCDSQETNCSTAGHSKTPPSGADSKTVKLKSPVLSNTTTEPASTMSPPPAKKLALSAKKASTLWRATGNDLRPPPPSPSSDLTHPMKTSHPVVASTWPVHRARAVSPAPQSSSRLQPPFSPHPTLLSSTPKPPGTSEPRSCSSISTALPQVNEDLVSLPHQLPEASEPPRSPSEKRKKTFVGEPQRLGSETCLPQHIREATAAPHGKRKRKKKKRPEDTAASALQEGQTQRQPGSPMYRREGQAQLPAVRRQEDGTQPQVNGQQVGCVTDGHHASSRKRRRKGAEGLGEEGGLHQDPLRHSCSPMGDGDPEAMEESPRKKKKRKQETQRAVEEDGHLKCPRSAKPQDAVVPESSSCAPSANGWCPGDRMGLSQAPPVSWNGERESDVVQELLKYSSDKAYGRKVLTWDGKMSAVSQDAIEDSRQARTETVVDDWDEEFDRGKEKKIKKFKREKRRNFNAFQKLQTRRNFWSVTHPAKAASLSYRR

SEQ ID NO: 839575 - protein, 1121 aa, Homo sapiens; identical to SEQ ID NO: 839568

SEQ ID NO: 839576 - protein, 1121 aa, Homo sapiens; identical to SEQ ID NO: 839568

SEQ ID NO: 839577 - protein, 1121 aa, Homo sapiens; identical to SEQ ID NO: 839568

SEQ ID NO: 839578 - protein, 150 aa, Homo sapiens [sequence omitted]

SEQ ID NO: 839579 - protein, 501 aa, Homo sapiens
MPIVDKLKEALKPGRKDSADDGELGKLLASSAKKVLLQKIEFEPASKSFSYQLEALKSKYVLLNPKTEGASRHKSGDDPPARRQGSEHTYESCGDGVPAPQKVLFPTERLSLRWERVFRVGAGLHNLGNTCFLNATIQCLTYTPPLANYLLSKEHARSCHQGSFCMLCVMQNHIVQAFANSGNAIKPVSFIRDLKKIARHFRFGNQEDAHEFLRYTIDAMQKACLNGCAKLDRQTQATTLVHQIFGGYLRSRVKCSVCKSVSDTYDPYLDVALEIRQAANIVRALELFVKADVLSGENAYMCAKCKKKVPASKRFTIHRTSNVLTLSLKRFANFSGGKITKDVGYPEFLNIRPYMSQNNGDPVMYGLYAVLVHSGYSCHAGHYYCYVKASNGQWYQMNDSLVHSSNVKVVLNQQAYVLFYLRIPGSKKSPEGLISRTGSSSLPGRPSVIPDHSKKNIGNGIISSPLTGKTESHSVAQAGVQWRNLGSLQPPPPSGDGVSLY

SEQ ID NO: 839580 - protein, 1080 aa, Homo sapiens
MPIVDKLKEALKPGRKDSADDGELGKLLASSAKKVLLQKIEFEPASKSFSYQLEALKSKYVLLNPKTEGASRHKSGDDPPARRQGSEHTYESCGDGVPAPQKVLFPTERLSLRWERVFRVGAGLHNLGNTCFLNATIQCLTYTPPLANYLLSKEHARSCHQGSFCMLCVMQNHIVQAFANSGNAIKPVSFIRDLKKIARHFRFGNQEDAHEFLRYTIDAMQKACLNGCAKLDRQTQATTLVHQIFGGYLRSRVKCSVCKSVSDTYDPYLDVALEIRQAANIVRALELFVKADVLSGENAYMCAKCKKKVPASKRFTIHRTSNVLTLSLKRFANFSGGKITKDVGYPEFLNIRPYMSQNNGDPVMYGLYAVLVHSGYSCHAGHYYCYVKASNGQWYQMNDSLVHSSNVKVVLNQQAYVLFYLRIPGSKKSPEGLISRTGSSSLPGRPSVIPDHSKKNIGNGIISSPLTGKRQDSGTMKKPHTTEEIGVPISRNGSTLGLKSQNGCIPPKLPSGSPSPKLSQTPTHMPTILDDPGKKVKKPAPPQHPGYSHCQRAWAEGERRERWPRQEGLQQLQPRALGQQRLHQGPPDPQEWSGPSLRFSGNELFHRWPLQNAAKWSRFKTVKLKSPVLSNTTTEPASTMSPPPAKKLALSAKKASTLWRATGNDLRPPPPSPSSDLTHPMKTSHPVVASTWPVHRARAVSPAPQSSSRLQPPFSPHPTLLSSTPKPPGTSEPRSCSSISTALPQVNEDLVSLPHQLPEASEPPRSPSEKRKKTFVGEPQRLGSETCLPQHIREATAAPHGKRKRKKKKRPEDTAASALQEGQTQRQPGSPMYRREGQAQLPAVRRQEDGTQPQVNGQQVGCVTDGHHASSRKRRRKGAEGLGEEGGLHQDPLRHSCSPMGDGDPEAMEESPRKKKKRKQETQRAVEEDGHLKCPRSAKPQDAVVPESSSCAPSANGWCPGDRMGLSQAPPVSWNGERESDVVQELLKYSSDKAYGRKVLTWDGKMSAVSQDAIEDSRQARTETVVDDWDEEFDRGKEKKIKKFKREKRRNFNAFQKLQTRRNFWSVTHPAKAASLSYRR

SEQ ID NO: 839581 - protein, 1121 aa, Homo sapiens; identical to SEQ ID NO: 839568

SEQ ID NO: 839582 - protein, 823 aa, Homo sapiens
MHLLHRCKKKVPASKRFTIHRTSNVLTLSLKRFANFSGGKITKDVGYPEFLNIRPYMSQNNGDPVMYGLYAVLVHSGYSCHAGHYYCYVKASNGQWYQMNDSLVHSSNVKVVLNQQAYVLFYLRIPGSKKSPEGLISRTGSSSLPGRPSVIPDHSKKNIGNGIISSPLTGKRQDSGTMKKPHTTEEIGVPISRNGSTLGLKSQNGCIPPKLPSGSPSPKLSQTPTHMPTILDDPGKKVKKPAPPQHFSPRTAQGLPGTSNSNSSRSGSQRQGSWDSRDVVLSTSPKLLATATANGHGLKGNDESAGLDRRGSSSSSPEHSASSDSTKAPQTPRSGAAHLCDSQETNCSTAGHSKTPPSGADSKTVKLKSPVLSNTTTEPASTMSPPPAKKLALSAKKASTLWRATGNDLRPPPPSPSSDLTHPMKTSHPVVASTWPVHRARAVSPAPQSSSRLQPPFSPHPTLLSSTPKPPGTSEPRSCSSISTALPQVNEDLVSLPHQLPEASEPPRSPSEKRKKTFVGEPQRLGSETCLPQHIREATAAPHGKRKRKKKKRPEDTAASALQEGQTQRQPGSPMYRREGQAQLPAVRRQEDGTQPQVNGQQVGCVTDGHHASSRKRRRKGAEGLGEEGGLHQDPLRHSCSPMGDGDPEAMEESPRKKKKRKQETQRAVEEDGHLKCPRSAKPQDAVVPESSSCAPSANGWCPGDRMGLSQAPPVSWNGERESDVVQELLKYSSDKAYGRKVLTWDGKMSAVSQDAIEDSRQARTETVVDDWDEEFDRGKEKKIKKFKREKRRNFNAFQKLQTRRNFWSVTHPAKAASLSYRR

SEQ ID NO: 839583 - protein, 459 aa, Homo sapiens
MPIVDKLKEALKPGRKDSADDGELGKLLASSAKKVLLQKIEFEPASKSFSYQLEALKSKYVLLNPKTEGASRHKSGDDPPARRQGSEHTYESCGDGVPAPQKVLFPTERLSLRWERVFRVGAGLHNLGNTCFLNATIQCLTYTPPLANYLLSKEHARSCHQGSFCMLCVMQNHIVQAFANSGNAIKPVSFIRDLKKIARHFRFGNQEDAHEFLRYTIDAMQKACLNGCAKLDRQTQATTLVHQIFGGYLRSRVKCSVCKSVSDTYDPYLDVALEIRQAANIVRALELFVKADVLSGENAYMCAKCKKKVPASKRFTIHRTSNVLTLSLKRFANFSGGKITKDVGYPEFLNIRPYMSQNNGDPVMYGLYAVLVHSGYSCHAGHYYCYVKASNGQWYQMNDSLVHSSNVKVVLNQQAYVLFYLRLPDTHTHANHPRRPWKEGEEASSSTASWLQPLPTGMG

SEQ ID NO: 839584 - protein, 1121 aa, Homo sapiens; identical to SEQ ID NO: 839568

SEQ ID NO: 839585 - protein, 287 aa, Homo sapiens
MLDQVSRARPGSAVSSGHSSLHIGVNRLGSVRMGNATGFPSTVSVAACGASANACGGKNVAGTCVHWVTAGVAPSPCCRRVSVRSCSPSNLLRADCCLSLPSSCSPMGDGDPEAMEESPRKKKKRKQETQRAVEEDGHLKCPRSAKPQDAVVPESSSCAPSANGWCPGDRMGLSQAPPVSWNGERESDVVQELLKYSSDKAYGRKVLTWDGKMSAVSQDAIEDSRQARTETVVDDWDEEFDRGKEKKIKKFKREKRRNFNAFQKLQTRRNFWSVTHPAKAASLSYRR

SEQ ID NO: 839586 - protein, 106 aa, Homo sapiens
MFHRQWSVLAEAAAPGWGYQESGGWWPHVLQVVSRCIAGGSGQAIPCFSGLTPPLCPSPPSPASSAGPLHLLALPVLRKEEVTPPSHLSLLWNSRGWPYCAPLPCE

SEQ ID NO: 839587 - protein, 739 aa, Homo sapiens
MPIVDKLKEALKPGRKDSADDGELGKLLASSAKKVLLQKIEFEPASKSFSYQLEALKSKYVLLNPKTEGASRHKSGDDPPARRQGSEHTYESCGDGVPAPQKVLFPTERLSLRWERVFRVGAGLHNLGNTCFLNATIQCLTYTPPLANYLLSKEHARSCHQGSFCMLCVMQNHIVQAFANSGNAIKPVSFIRDLKKIARHFRFGNQEDAHEFLRYTIDAMQKACLNGCAKLDRQTQATTLVHQIFGGYLRSRVKCSVCKSVSDTYDPYLDVALEIRQAANIVRALELFVKADVLSGENAYMCAKCKKKVPASKRFTIHRTSNVLTLSLKRFANFSGGKITKDVGYPEFLNIRPYMSQNNGDPVMYGLYAVLVHSGYSCHAGHYYCYVKASNGQWYQMNDSLVHSSNVKVVLNQQAYVLFYLRIPGSKKSPEGLISRTGSSSLPGRPSVIPDHSKKNIGNGIISSPLTGKRQDSGTMKKPHTTEEIGVPISRNGSTLGLKSQNGCIPPKLPSGSPSPKLSQTPTHMPTILDDPGKKVKKPAPPQHFSPRTAQGLPGTSNSNSSRSGSQRQGSWDSRDVVLSTSPKLLATATANGHGLKGNDESAGLDRRGSSSSSPEHSASSDSTKAPQTPRSGAAHLCDSQETNCSTAGHSKTPPSGADSKTVKLKSPVLSNTTTEPASTMSPPPAKKLALSAKKASTLWRATGNDLRPPPPSPSSDLTHPMKTSHPVVASTWPVHRAR

SEQ ID NO: 839588 - protein, 54 aa, Homo sapiens
MHLLHRCKKKVPASKRFTIHRTSNVLTLSLKRFANFSGGKITKVSARDTIPGSS

SEQ ID NO: 839589 - protein, 101 aa, Homo sapiens
LAALLHGHLHSQTSLVEDGQGGSGLETPPGNSSERPQVLRPQRRPEGMQLLFVNLKWLSWAQGAPVEKLRKDINGWQMQELAALQLVGVCCSVGVRTLVGV

SEQ ID NO: 839590 - protein, 104 aa, Homo sapiens
PTVEYQGLHSQTSLVEDGQGGSGLETPPGNSSERPQVLRPQRRPEGMQLLFVNLKWLSWAQGAPVEKLRKDINGWQMQEAALGCMLSTSDLCTVEGLRTMLKHD

SEQ ID NO: 839591 - protein, 187 aa, Homo sapiens
TGRGAVRTCSEEARPGAVACRAGDMDPLFQQTHKQVHEIQSCMGRLETADKQSVHIVENEIQASIDQIFSRLERLEILSSKEPPNKRQNARLRVDQLKYDVQHLQTALRNFQHRRHAREQQERQREELLSRTFTTNGTQKKILDIANMLGLSNTVMRLIEKRAFQDKYFMIENSILLCCPGWSAIAQ

SEQ ID NO: 839592 - protein, 236 aa, Homo sapiens
TGRGAVRTCSEEARPGAVACRAGDMDPLFQQTHKQVHEIQSCMGRLETADKQSVHIVENEIQASIDQIFSRLERLEILSSKEPPNKRQNARLRVDQLKYDVQHLQTALRNFQHRRHAREQQERQREELLSRTFTTNDSDTTIPMDESLQFNSSLQKVHNGMDDLILDGHNILDGLRTQRLTLKGTQKKILDIANMLGLSNTVMRLIEKRAFQDKYFMIGGMLLTCVVMFLVVQYLT

SEQ ID NO: 839593 - protein, 236 aa, Homo sapiens; identical to SEQ ID NO: 839592

SEQ ID NO: 839594 - protein, 236 aa, Homo sapiens; identical to SEQ ID NO: 839592

SEQ ID NO: 839595 - protein, 236 aa, Homo sapiens; identical to SEQ ID NO: 839592

SEQ ID NO: 839596 - protein, 236 aa, Homo sapiens; identical to SEQ ID NO: 839592

SEQ ID NO: 839597 - protein, 281 aa, Homo sapiens
MDPLFQQTHKVIYIVACYQNFILFYDGIIFRFMCLPHFVIHSSVDGHLSCFHHWAVENNTAMNSGVEVSVLVSLLNFLRQVHEIQSCMGRLETADKQSVHIVENEIQASIDQIFSRLERLEILSSKEPPNKRQNARLRVDQLKYDVQHLQTALRNFQHRRHAREQQERQREELLSRTFTTNDSDTTIPMDESLQFNSSLQKVHNGMDDLILDGHNILDGLRTQRLTLKGTQKKILDIANMLGLSNTVMRLIEKRAFQDKYFMIGGMLLTCVVMFLVVQYLT

SEQ ID NO: 839598 - protein, 236 aa, Homo sapiens; identical to SEQ ID NO: 839592

SEQ ID NO: 839599 - protein, 218 aa, Homo sapiens
TGRGAVRTCSEEARPGAVACRAGDMDPLFQQTHKQVHEIQSCMGRLETADKQSVHIVENEIQASIDQIFSRLERLEILSSKEPPNKRQNARLRVDQLKYDVQHLQTALRNFQHRRHAREQQERQREELLSRTFTTNDSDTTIPMDESLDGHNILDGLRTQRLTLKGTQKKILDIANMLGLSNTVMRLIEKRAFQDKYFMIGGMLLTCVVMFLVVQYLT

SEQ ID NO: 839600 - protein, 236 aa, Homo sapiens; identical to SEQ ID NO: 839592

SEQ ID NO: 839601 - protein, 219 aa, Homo sapiens
TGRGAVRTCSEEARPGAVACRAGDMDPLFQQTHKQVHEIQSCMGRLETADKQSVHIVENEIQASIDQIFSRLERLEILSSKEPPNKRQNARLRVDQLKYDVQHLQTALRNFQHRRHAREQQERQREELLSRTFTTNDSDTTIPMDESLQFNSSLQKVHNGMDDLILDGHNILDGLRTQRLTLKVGSLLGDREKASCFSLIQQFSNCVYILITCPQIVIF

SEQ ID NO: 839602 - protein, 270 aa, Homo sapiens
TGRGAVRTCSEEARPGAVACRAGDMDPLFQQTHKQVHEIQSCMGRLETADKQSVHIVENEIQASIDQIFSRLERLEILSSKEPPNKRQNARLRVDQLKYDVQHLQTALRNFQHRRHAREQQERQREELLSRTFTTNDSDTTIPMDESLQFNSSLQKVHNGMDDLILDGHNILDGLRTQRLTLKGTQKKILDIANMLGLSNTVMRLIEKRAFQDKYFMIAKDPARQHTLEEGLQGAAEPFVLELWEAEVPAPIMRGLIGHLFVVCTSAFHT

SEQ ID NO: 839603 - protein, 220 aa, Homo sapiens
TGRGAVRTCSEEARPGAVACRAGDMDPLFQQTHKQVHEIQSCMGRLETADKQSVHIVENEIQASIDQIFSRLERLEILSSKEPPNKRQNARLRVDQLKYDVQHLQTALRNFQHRRHAREQQERQREELLSRTFTTNDSDTTIPMDESLQFNSSLQKVHNGMDDLILDGHNILDGLRTQRLTLKGTQKKILDIANMLGLSNTVMRLIEKRAFQDKYFMIAM

SEQ ID NO: 839604 - protein, 189 aa, Homo sapiens
TGRGAVRTCSEEARPGAVACRAGDMDPLFQQTHKQVHEIQSCMGRLETADKQSVHIVENEIQASIDQIFSRLERLEILSSKEPPNKRQNARLRVDQLKYDVQHLQTALRNFQHRRHAREQQERQREELLSRTFTTNGTQKKILDIANMLGLSNTVMRLIEKRAFQDKYFMIGGMLLTCVVMFLVVQYLT

SEQ ID NO: 839605 - protein, 125 aa, Homo sapiens
MGRLETADKQSVHIVENEIQASIDQIFSRLERLEILSSKEPPNKRQNARLRVDQLKYDVQHLQTALRNFQHRRHAREQQERQREELLSRTFTTNVSQARGEGRPALDRSWGLEFRSLSAICFGGV

SEQ ID NO: 839606 - protein, 234 aa, Homo sapiens
EKETSNFLGPRYTQRGKMAQGGRTHRALSSPTLPAFQPCKKIWLFPRGVCLAASPPQTSPPSQPSSMFTPTRKSSFLNRFSLHPLRVAIFGSCNITSYILHQGEGEIPEAGLLFFVKLFFWCIFFLFQKILIVGGCHLSTQHLVFGLQILIPFCWCHCLSFLWKTCATGLSEGCLLQQGQRLKQAWSMQDWVSSPKQSVWGDHMTARWADQNLPWNSHRHCWFPDQHPFLPYSH

SEQ ID NO: 839607 - protein, 236 aa, Homo sapiens; identical to SEQ ID NO: 839592

SEQ ID NO: 839608 - protein, 236 aa, Homo sapiens; identical to SEQ ID NO: 839592

SEQ ID NO: 839609 - protein, 236 aa, Homo sapiens; identical to SEQ ID NO: 839592

SEQ ID NO: 839610 - protein, 194 aa, Homo sapiens
MGRLETADKQSVHIVENEIQASIDQIFSRLERLEILSSKEPPNKRQNARLRVDQLKYDVQHLQTALRNFQHRRHAREQQERQREELLSRTFTTNDSDTTIPMDESLQFNSSLQKVHNGMDDLILDGHNILDGLRTQRLTLKGTQKKILDIANMLGLSNTVMRLIEKRAFQDKYFMIGGMLLTCVVMFLVVQYLT

SEQ ID NO: 839611 - protein, 189 aa, Homo sapiens; identical to SEQ ID NO: 839604

SEQ ID NO: 839612 - protein, 236 aa, Homo sapiens; identical to SEQ ID NO: 839592

SEQ ID NO: 839613 - protein, 219 aa, Homo sapiens; identical to SEQ ID NO: 839601

SEQ ID NO: 839614 - protein, 219 aa, Homo sapiens; identical to SEQ ID NO: 839601

SEQ ID NO: 839615 - protein, 167 aa, Homo sapiens
TGRGAVRTCSEEARPGAVACRAGDMDPLFQQTHKQVHEIQSCMGRLETADKQSVHIVENEIQASIDQIFSRLERLEILSSKEPPNKRQNARLRVDQLKYDVQHLQTALRNFQHRRHAREQQERQREELLSRTFTTNVSQARGEGRPALDRSWGLEFRSLSAICFGGV

SEQ ID NO: 839616 - protein, 149 aa, Homo sapiens
MGRLETADKQSVHIVENEIQASIDQIFSRLERLEILSSKEPPNKRQNARLRVDQLKYDVQHLQTALRNFQHRRHAREQQERQREELLSRTFTTNGTQKKILDIANMLGLSNTVMRLIEKRAFQDKYFMIDKEHMFLTRECALFPTHSHH

SEQ ID NO: 839617 - protein, 248 aa, Homo sapiens [sequence omitted]

SEQ ID NO: 839618 - protein, 248 aa, Homo sapiens [sequence omitted]

SEQ ID NO: 839619 - protein, 248 aa, Homo sapiens [sequence omitted]

SEQ ID NO: 839620 - protein, 216 aa, Homo sapiens
MERASLIQKAKLAEQAERYEDMAAFMKGAVEKGEELSCEERNLLSVAYKNVVGGQRAAWRVLSSIEQKSNEEGSEEKGPEVREYRVFYLKMKGDYYRYLAEVATGDDKKRIIDSARSAYQEAMDISKKEMPPTNPIRLGLALNFSVFHYEIANSPEEAISLAKTTFDEAMADLHTLSEDSYKDSTLIMQLLRDNLTLWTADNAGEEGGEAPQEPQS

SEQ ID NO: 839621 - protein, 248 aa, Homo sapiens [sequence omitted]

SEQ ID NO: 839622 - protein, 126 aa, Homo sapiens
MKGDYYRYLAEVATGDDKKRIIDSARSAYQEAMDISKKEMPPTNPIRLGLALNFSVFHYEIANSPEEAISLAKTTFDEAMADLHTLSEDSYKDSTLIMQLLRDNLTLWTADNAGEEGGEAPQEPQS

SEQ ID NO: 839623 - protein, 163 aa, Homo sapiens
AGGLGAGRAGKISGWTWHTLHLIKEAGDAESRVFYLKMKGDYYRYLAEVATGDDKKRIIDSARSAYQEAMDISKKEMPPTNPIRLGLALNFSVFHYEIANSPEEAISLAKTTFDEAMADLHTLSEDSYKDSTLIMQLLRDNLTLWTADNAGEEGGEAPQEPQS

SEQ ID NO: 839624 - protein, 422 aa, Homo sapiens
MSVGAMKKGVGRAVGLGGGSGCQATEEDPLPDCGACAPGQGGRRWRLPQPAWVEGSSARLWEQATGTGWMDLEASLLPTGPNASNTSDGPDNLTSAGSPPRTGSISYINIIMPSVFGTICLLGIIGNSTVIFAVVKKSKLHWCNNVPDIFIINLSVVDLLFLLGMPFMIHQLMGNGVWHFGETMCTLITAMDANSQFTSTYILTAMAIDRYLATVHPISSTKFRKPSVATLVICLLWALSFISITPVWLYARLIPFPGGAVGCGIRLPNPDTDLYWFTLYQFFLAFALPFVVITAAYVRILQRMTSSVAPASQRSIRLRTKRVTRTAIAICLVFFVCWAPYYVLQLTQLSISRPTLTFVYLYNAAISLGYANSCLNPFVYIVLCETFRKRLVLSVKPAAQGQLRAVSNAQTADEERTESKGT

SEQ ID NO: 839625 - protein, 402 aa, Homo sapiens
MLCPSKTDGSGHSGRIHQETHGEGKRDKISNSEGRENGGRGFQMNGGSLEAEHASRMSVLRAKPMSNSQRLLLLSPGSPPRTGSISYINIIMPSVFGTICLLGIIGNSTVIFAVVKKSKLHWCNNVPDIFIINLSVVDLLFLLGMPFMIHQLMGNGVWHFGETMCTLITAMDANSQFTSTYILTAMAIDRYLATVHPISSTKFRKPSVATLVICLLWALSFISITPVWLYARLIPFPGGAVGCGIRLPNPDTDLYWFTLYQFFLAFALPFVVITAAYVRILQRMTSSVAPASQRSIRLRTKRVTRTAIAICLVFFVCWAPYYVLQLTQLSISRPTLTFVYLYNAAISLGYANSCLNPFVYIVLCETFRKRLVLSVKPAAQGQLRAVSNAQTADEERTESKGT

SEQ ID NO: 839626 - protein, 422 aa, Homo sapiens; identical to SEQ ID NO: 839624

SEQ ID NO: 839627 - protein, 308 aa, Homo sapiens
MASSNTVLMRLVASAYSIAQKAGMIVRRVIAEGDLGIVEKTCATDLQTKADRLAQMSICSSLARKFPKLTIIGEEDLPSEEVDQELIEDSQWEEILKQPCPSQYSAIKEEDLVVWVDPLDGTKEYTEGLLDNVTVLIGIAYEGKAIAGVINQPYYNYEAGPDAVLGRTIWGVLGLGAFGFQLKEVPAGKHIITTTRSHSNKLVTDCVAAMNPDAVLRVGGAGNKIIQLIEGKASAYVFASPGCKKWDTCAPEVILHAVGGKLTDIHGNVLQYHKDVKHMNSAGVLATLRNYDYYASRVPESIKNALVP

SEQ ID NO: 839628 - protein, 272 aa, Homo sapiens
MASSQSVSQSVSQSSVSQSVSQSVVSQSVSQSVSRQSVSQSVSQSSVSQSVSQSVVSQSVSQSVSRQSVSQSVSQSSVSQSVSQSVVSQSVSQSVSRQSVSQSVSQSSVSQSVSQSVVSQSVSQSVSRQSVSQSVSQSSVSQSVSQSVVSQSVSQSVSRQSVSQSVSQSSVSQSVSQSVVSQSVSQSVSRQSVSQSVSQSSVSQSVSQSVVSQSVSQSVSRQSVSQSVSQSSVSQSVSQSVVSQSVSQSVSRQSVSQSVSQSSVSQSVSQSV

SEQ ID NO: 839629 - protein, 272 aa, Homo sapiens
MASSNTVLMRLVASAYSIAQKAGMIVRRVIAEGDLGIVEKTCATDLQTKADRLAQMSICSSLARKFPKLTIIGEELVVWVDPLDGTKEYTEGLLDNVTVLIGIAYEGKAIAGVINQPYYNYEAGPDAVLGRTIWGVLGLGAFGFQLKEVPAGKHIITTTRSHSNKLVTDCVAAMNPDAVLRVGGAGNKIIQLIEGKASAYVFASPGCKKWDTCAPEVILHAVGGKLTDIHGNVLQYHKDVKHMNSAGVLATLRNYDYYASRVPESIKNALVP

SEQ ID NO: 839630 - protein, 323 aa, Homo sapiens
MASSNTVLMRLVASAYSIAQKAGMIVRRVIAEGDLGIVEKTCATDLQTKADRLAQMSICSSLARKFPKLTIIGEEDLPSEEVDQELIEDSQWEEILKQPCPSQYSAIKEEDLVVWVDPLDGTKEYTEGLLDNVTVLIGIAYEGKAIAGVINQPYYNYENNEKQQLREHRNEAKAGPDAVLGRTIWGVLGLGAFGFQLKEVPAGKHIITTTRSHSNKLVTDCVAAMNPDAVLRVGGAGNKIIQLIEGKASAYVFASPGCKKWDTCAPEVILHAVGGKLTDIHGNVLQYHKDVKHMNSAGVLATLRNYDYYASRVPESIKNALVP

SEQ ID NO: 839631 - protein, 323 aa, Homo sapiens; identical to SEQ ID NO: 839630

SEQ ID NO: 839632 - protein, 308 aa, Homo sapiens; identical to SEQ ID NO: 839627

SEQ ID NO: 839633 - protein, 301 aa, Homo sapiens
MASSNTVLMRLVASAYSIAQKAGMIVRRVIAEGDLGIVEKTCATDLQTKADRLAQMSICSSLARKFPKLTIIGEEDLPSEEVDQELIEDSQWEEILKQPCPSQYSAIKEEDLVVWVDPLDGTKEYTEGLLDNVTVLIGIAYEGKAIAGVINQPYYNYENNEKQQLREHRNEAKAGPDAVLGRTIWGVLGLGAFGFQLKEVPAGKHIITTTRSHSNKLVTDCVAAMNPDAVLRVGGAGNKIIQLIEGKASAYVFASPGCKKWDTCAPEVILHAVGGKLTDIHGNVLQYHKDWDYRCEPPHLA

SEQ ID NO: 839634 - protein, 156 aa, Homo sapiens
MASSNTVLMRLVASAYSIAQKAGMIVRRVIAEGDLGIVEKTCATDLQTKADRLAQMSICSSLARKFPKLTIIGEEDLPSEEVDQELIEDSQWEEILKQPCPSQYSAIKEEDLVVWVDPLDGTKEYTEGLLDNVTVLIGIAYEGKAWDYRCEPPHLA

SEQ ID NO: 839635 - protein, 240 aa, Homo sapiens
MSICSSLARKFPKLTIIGEEDLPSEEVDQELIEDSQWEEILKQPCPSQYSAIKEEDLVVWVDPLDGTKEYTEGLLDNVTVLIGIAYEGKAIAGVINQPYYNYEAGPDAVLGRTIWGVLGLGAFGFQLKEVPAGKHIITTTRSHSNKLVTDCVAAMNPDAVLRVGGAGNKIIQLIEGKASAYVFASPGCKKWDTCAPEVILHAVGGKLTDIQDVLVTQVEALTEGLAMESICFQDKLHPKY

SEQ ID NO: 839636 - protein, 308 aa, Homo sapiens; identical to SEQ ID NO: 839627

SEQ ID NO: 839637 - protein, 308 aa, Homo sapiens; identical to SEQ ID NO: 839627

SEQ ID NO: 839638 - protein, 242 aa, Homo sapiens
MASSNTVLMRLVASAYSIAQKAGMIVRRVIAEGDLGIVEKTCATDLQTKADRLAQMSICSSLARKFPKLTIIGEEDLPSEEVDQELIEDSQWEEILKQPCPSQYSAIKEEDLVVWVDPLDGTKEYTEGLLDNVTVLIGIAYEGKAIAGVINQPYYNYEIIQLIEGKASAYVFASPGCKKWDTCAPEVILHAVGGKLTDIHGNVLQYHKDVKHMNSAGVLATLRNYDYYASRVPESIKNALVP

SEQ ID NO: 839639 - protein, 242 aa, Homo sapiens; identical to SEQ ID NO: 839638

SEQ ID NO: 839640 - protein, 295 aa, Homo sapiens
MASSNTVLMRLVASAYSIAQKAGMIVRRVIAEGDLGIVEKTCATDLQTKADRLAQMSICSSLARKFPKLTIIGEEDLPSEEVDQELIEDSQWEEILKQPCPSQYSAIKEEDLVVWVDPLDGTKEYTEGLLDNVTVLIGIAYEGKAIAGVINQPYYNYEAGPDAVLGRTIWGVLGLGAFGFQLKEVPAGKHIITTTRSHSNKLVTDCVAAMNPDAVLRVGGAGNKIIQLIEGKASAYVFASPGCKKWDTCAPEVILHAVGGKLTDIQDVLVTQVEALTEGLAMESICFQDKLHPKY

SEQ ID NO: 839641 - protein, 401 aa, Homo sapiens
MLDSCKLKSACNLPFICNKKIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMGSAFLDLTQLELNRPTDVTLTLKDPHYPDHDLGIILLSVILTPKEGESRDVTMLMRKSWKRSSKELSENEVVGSYFSVKSLFWRTCGRPALPVLGFCRAELQNPYCKNVQFQTQSLRLSDLHRKSHLWRGIVSITLIEGRDLKAMDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYNRCVTGLNR

SEQ ID NO: 839642 - protein, 549 aa, Homo sapiens
MLDSCKLKSACNLPFICNKKIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMGSAFLDLTQLELNRPTDVTLTLKDPHYPDHDLGIILLSVILTPKEGESRDVTMLMRKSWKRSSKELSENEVVGSYFSVKSLFWRTCGRPALPVLGFCRAELQNPYCKNVQFQTQSLRLSDLHRKSHLWRGIVSITLIEGRDLKAMDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYSPLRIFHNLKDVGFLQVKVIRAEGLMAADVTGQKWTILCGHRNTKTETHRSQNQSKGKSLRLHGRNLLTPWKRDDNHSTKAPNCCISAAPQHQGHITGDTTPGKQDNEHKGTQQKNTGRDTTDTDTQTNHSIHHTRRRNQRHTRRPAPPPHPVPTPR

SEQ ID NO: 839643 - protein, 331 aa, Homo sapiens
FFIFRVFQKIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMGSAFLDLTQLELNRPTDVTLTLKDPHYPDHDLGIILLSVILTPKEGESRDVFQTQSLRLSDLHRKSHLWRGIVSITLIEGRDLKAMDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYNRCVTGLNR

SEQ ID NO: 839644 - protein, 503 aa, Homo sapiens
MLDSCKLKSACNLPFICNKKIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMGSAFLDLTQLELNRPTDVTLTLKDPHYPDHDLGIILLSVILTPKEGESRDVTMLMRKSWKRSSKFQTQSLRLSDLHRKSHLWRGIVSITLIEGRDLKAMDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYSPLRIFHNLKDVGFLQVKVIRAEGLMAADVTGQKWTILCGHRNTKTETHRSQNQSKGKSLRLHGRNLLTPWKRDDNHSTKAPNCCISAAPQHQGHITGDTTPGKQDNEHKGTQQKNTGRDTTDTDTQTNHSIHHTRRRNQRHTRRPAPPPHPVPTPR

SEQ ID NO: 839645 - protein, 169 aa, Homo sapiens
MYDRRRYHIILFFITLLMIARFFHILLISCACLQVYVYKSFPHLTFLMPLLSSSSFLSCTLVWVHNTPQRCRCATSPSAPSTPSLLVCEPRLDSSVHVICSYTGLSTTPPLPTLSLPCFSPFRPCASRSFFQLPGGACSLPAPCHYHAHFSACFPLLPFSDWLTLFFKT

SEQ ID NO: 839646 - protein, 141 aa, Homo sapiens
MGRLPPFLISMRRDFPKMPLVLFPLLLFFSPERRNVLADSSSSPLLFPFRSQPYQQALIHCPEMVLKAFQCFGVRISPAKGTILKGKPIEPCKFWHTYLEFAPFSFLKLAIYYSSLFETIWFLLANVLLPGLWHGTSWRES

SEQ ID NO: 839647 - protein, 517 aa, Homo sapiens
MASDGARKQFWKRSNSKLPGSIQHVYGAQHPPFDPLLHGTLLRSTAKMPTTPVKAKRVSTFQEFESNTSDAWDAGEDDDELLAMAAESLNSEVVMETANRVLRNHSQRQGRPTLQEGPGLQQKPRPEAEPPSPPSGDLRLVKSVSESHTSCPAESASDAAPLQRSQSLPHSATVTLGGTSDPSTLSSSALSEREASRLDKFKQLLAGPNTDLEELRRLSWSGIPKPVRPMTWKLLSGYLPANVDRRPATLQRKQKEYFAFIEHYYDSRNDEVHQDTYRQIHIDIPRMSPEALILQPKVTEIFERILFIWAIRHPASGYVQGINDLVTPFFVVFICEYIEAEEVDTVDVSGVPAEVLCNIEADTYWCMSKLLDGIQDNYTFAQPGIQMKVKMLEELVSRIDEQVHRHLDQHEVRYLQFAFRWMNNLLMREVPLRCTIRLWDTYQSEPDGFSHFHLYVCAAFLVRWRKEILEEKDFQELLLFLQNLPTAHWDDEDISLLLAEAYRLKFAFADAPNHYKK

SEQ ID NO: 839648 - protein, 517 aa, Homo sapiens; identical to SEQ ID NO: 839647

SEQ ID NO: 839649 - protein, 439 aa, Homo sapiens
MASDGARKQFWKRSNSKLPGSLLRSTAKMPTTPVKAKRVSTFQEFESNTSDAWDAGEDDDELLAMAAESLNSEVVMETANRVLRNHSQRQGRPTLQEGPGLQQKPRPEAEPPSPPSGDLRLVKSVSESHTSCPAEELRRLSWSGIPKPVRPMTWKLLSGYLPANVDRRPATLQRKQKEYFAFIEHYYDSRNDEVHQDTYRQIHIDIPRMSPEALILQPKVTEIFERILFIWAIRHPASGYVQGINDLVTPFFVVFICEYIEAEEVDTVDVSGVPAEVLCNIEADTYWCMSKLLDGIQDNYTFAQPGIQMKVKMLEELVSRIDEQVHRHLDQHEVRYLQFAFRWMNNLLMREVPLRCTIRLWDTYQSEPDGFSHFHLYVCAAFLVRWRKEILEEKDFQELLLFLQNLPTAHWDDEDISLLLAEAYRLKFAFADAPNHYKK

SEQ ID NO: 839650 - protein, 470 aa, Homo sapiens
MPTTPVKAKRVSTFQEFESNTSDAWDAGEDDDELLAMAAESLNSEVVMETANRVLRNHSQRQGRPTLQEGPGLQQKPRPEAEPPSPPSGDLRLVKSVSESHTSCPAESASDAAPLQRSQSLPHSATVTLGGTSDPSTLSSSALSEREASRLDKFKQLLAGPNTDLEELRRLSWSGIPKPVRPMTWKLLSGYLPANVDRRPATLQRKQKEYFAFIEHYYDSRNDEVHQDTYRQIHIDIPRMSPEALILQPKVTEIFERILFIWAIRHPASGYVQGINDLVTPFFVVFICEYIEAEEVDTVDVSGVPAEVLCNIEADTYWCMSKLLDGIQDNYTFAQPGIQMKVKMLEELVSRIDEQVHRHLDQHEVRYLQFAFRWMNNLLMREVPLRCTIRLWDTYQSEPDGFSHFHLYVCAAFLVRWRKEILEEKDFQELLLFLQNLPTAHWDDEDISLLLAEAYRLKFAFADAPNHYKK

SEQ ID NO: 839651 - protein, 434 aa, Homo sapiens
MAAESLNSEVVMETANRVLRNHSQRQGRPTLQEGPGLQQKPRPEAEPPSPPSGDLRLVKSVSESHTSCPAESASDAAPLQRSQSLPHSATVTLGGTSDPSTLSSSALSEREASRLDKFKQLLAGPNTDLEELRRLSWSGIPKPVRPMTWKLLSGYLPANVDRRPATLQRKQKEYFAFIEHYYDSRNDEVHQDTYRQIHIDIPRMSPEALILQPKVTEIFERILFIWAIRHPASGYVQGINDLVTPFFVVFICEYIEAEEVDTVDVSGVPAEVLCNIEADTYWCMSKLLDGIQDNYTFAQPGIQMKVKMLEELVSRIDEQVHRHLDQHEVRYLQFAFRWMNNLLMREVPLRCTIRLWDTYQSEPDGFSHFHLYVCAAFLVRWRKEILEEKDFQELLLFLQNLPTAHWDDEDISLLLAEAYRLKFAFADAPNHYKK

SEQ ID NO: 839652 - protein, 458 aa, Homo sapiens
MASDGARKQFWKRSNSKLPGSIQHVYGAQHPPFDPLLHGTLLRSTAKMPTTPVKAKRVSTFQEFESNTSDAWDAGEDDDELLAMAAESLNSEVVMETANRVLRNHSQRQGRPTLQEGPGLQQKPRPEAEPPSPPSGDLRLVKSVSESHTSCPAEELRRLSWSGIPKPVRPMTWKLLSGYLPANVDRRPATLQRKQKEYFAFIEHYYDSRNDEVHQDTYRQIHIDIPRMSPEALILQPKVTEIFERILFIWAIRHPASGYVQGINDLVTPFFVVFICEYIEAEEVDTVDVSGVPAEVLCNIEADTYWCMSKLLDGIQDNYTFAQPGIQMKVKMLEELVSRIDEQVHRHLDQHEVRYLQFAFRWMNNLLMREVPLRCTIRLWDTYQSEPDGFSHFHLYVCAAFLVRWRKEILEEKDFQELLLFLQNLPTAHWDDEDISLLLAEAYRLKFAFADAPNHYKK

SEQ ID NO: 839653 - protein, 337 aa, Homo sapiens
MAGRVLTHEVAQPTCFVSCRGSMRPALQGPREEELRRLSWSGIPKPVRPMTWKLLSGYLPANVDRRPATLQRKQKEYFAFIEHYYDSRNDEVHQDTYRQIHIDIPRMSPEALILQPKVTEIFERILFIWAIRHPASGYVQGINDLVTPFFVVFICEYIEAEEVDTVDVSGVPAEVLCNIEADTYWCMSKLLDGIQDNYTFAQPGIQMKVKMLEELVSRIDEQVHRHLDQHEVRYLQFAFRWMNNLLMREVPLRCTIRLWDTYQSEPDGFSHFHLYVCAAFLVRWRKEILEEKDFQELLLFLQNLPTAHWDDEDISLLLAEAYRLKFAFADAPNHYKK

SEQ ID NO: 839654 - protein, 288 aa, Homo sapiens
MTWKLLSGYLPANVDRRPATLQRKQKEYFAFIEHYYDSRNDEVHQDTYRQIHIDIPRMSPEALILQPKVTEIFERILFIWAIRHPASGYVQGINDLVTPFFVVFICEYIEAEEVDTVDVSGVPAEVLCNIEADTYWCMSKLLDGIQDNYTFAQPGIQMKVKMLEELVSRIDEQVHRHLDQHEVRYLQFAFRWMNNLLMREVPLRCTIRLWDTYQSEPDGFSHFHLYVCAAFLVRWRKEILEEKDFQELLLFLQNLPTAHWDDEDISLLLAEAYRLKFAFADAPNHYKK

SEQ ID NO: 839655 - protein, 439 aa, Homo sapiens; identical to SEQ ID NO: 839649

SEQ ID NO: 839656 - protein, 412 aa, Homo sapiens
MASDGARKQFWKRSNSKLPGSIQHVYGAQHPPFDPLLHGTLLRSTAKMPTTPVKAKRVSTFQEFESNTSDAWDAGEDDDELLAMAAESLNSEVVMETANRVLRNHSQRQGRPTLQEGPGLQQKPRPEAEPPSPPSGDLRLVKSVSESHTSCPAESASDAAPLQRSQSLPHSATVTLGGTSDPSTLSSSALSEREASRLDKFKQLLAGPNTDLEELRRLSWSGIPKPVRPMTWKLLSGYLPANVDRRPATLQRKQKEYFAFIEHYYDSRNDEVHQDTYRQIHIDIPRMSPEALILQPKVTEIFERILFIWAIRHPASGYVQGINDLVTPFFVVFICEYIEAEEVDTVDVSGVPAEVLCNIEADTYWCMSKLLDGIQDNYTFAQPGIQMKVKMLEELVSRIDEQVHRTWPTRRG

SEQ ID NO: 839657 - protein, 121 aa, Homo sapiens
PNPMHQAALGKGQARHPPDSMYQVALGKGQVRHLPDSMHQAALGKGQSEPDGFSHFHLYVCAAFLVRWRKEILEEKDFQELLLFLQNLPTAHWDDEDISLLLAEAYRLKFAFADAPNHYKK

SEQ ID NO: 839658 - protein, 517 aa, Homo sapiens; identical to SEQ ID NO: 839647

SEQ ID NO: 839659 - protein, 362 aa, Homo sapiens
MASDGARKQFWKRSNSKLPGSIQHVYGAQHPPFDPLLHGTLLRSTAKMPTTPVKAKRVSTFQEFESNTSDAWDAGEDDDELLAMAAESLNSEVVMETANRVLRNHSQRQGRPTLQEGPGLQQKPRPEAEPPSPPSGDLRLVKSVSESHTSCPAESASDAAPLQRSQSLPHSATVTLGGTSDPSTLSSSALSEREASRLDKFKQLLAGPNTDLEELRRLSWSGIPKPVRPMTWKLLSGYLPANVDRRPATLQRKQKEYFAFIEHYYDSRNDEVHQDTYRQIHIDIPRMSPEALILQPKVTEIFERILFIWAIRHPASGYVQGINDLVTPFFVVFICEYIGQLHLCPTWDSNESENVRRTREPD

SEQ ID NO: 839660 - protein, 476 aa, Homo sapiens
MASDGARKQFWKRSNSKLPGSIQHVYGAQHPPFDPLLHGTLLRSTAKMPTTPVKAKRVSTFQEFESNTSDAWDAGEDDDELLAMAAESLNSEVVMETANRVLRNHSQRQGRPTLQEGPGLQQKPRPEAEPPSPPSGDLRLVKSVSESHTSCPAESASDAAPLQRSQSLPHSATVTLGGTSDPSTLSSSALSEREASRLDKFKQLLAGPNTDLEELRRLSWSGIPKPVRPMTWKLLSGYLPANVDRRPATLQRKQKEYFAFIEHYYDSRNDEVHQDTYRQIHIDIPRMSPEALILQPKVTEIFERILFIWAIRHPASGYVQGINDLVTPFFVVFICEYIEAEEVDTVDVSGVPAEVLCNIEADTYWCMSKLLDGIQDNYTFAQPGIQMKVKMLEELVSRIDEQVHRHLDQHEVRYLQFAFRWMNNLLMREVPLRCTIRLWDTYQSEPDGFSHFHLYVCAAFLVRWRKEILEEKDFQG

SEQ ID NO: 839661 - protein, 391 aa, Homo sapiens
MASDGARKQFWKRSNSKLPGSIQHVYGAQHPPFDPLLHGTLLRSTAKMPTTPVKAKRVSTFQEFESNTSDAWDAGEDDDELLAMAAESLNSEVVMETANRVLRNHSQRQGRPTLQEGPGLQQKPRPEAEPPSPPSGDLRLVKSVSESHTSCPAESASDAAPLQRSQSLPHSATVTLGGTSDPSTLSSSALSEREASRLDKFKQLLAGPNTDLEAEEVDTVDVSGVPAEVLCNIEADTYWCMSKLLDGIQDNYTFAQPGIQMKVKMLEELVSRIDEQVHRHLDQHEVRYLQFAFRWMNNLLMREVPLRCTIRLWDTYQSEPDGFSHFHLYVCAAFLVRWRKEILEEKDFQELLLFLQNLPTAHWDDEDISLLLAEAYRLKFAFADAPNHYKK

SEQ ID NO: 839662 - protein, 517 aa, Homo sapiens; identical to SEQ ID NO: 839647

SEQ ID NO: 839663 - protein, 397 aa, Homo sapiens
MASDGARKQFWKRSNSKLPGSIQHVYGAQHPPFDPLLHGTLLRSTAKMPTTPVKAKRVSTFQEFESNTSDAWDAGEDDDELLAMAAESLNSEVVMETANRVLRNHSQRQGRPTLQEGPGLQQKPRPEAEPPSPPSGDLRLVKSVSESHTSCPAESASDAAPLQRSQSLPHSATVTLGGTSDPSTLSSSALSEREASRLDKFKQLLAGPNTDLEELRRLSWSGIPKPVRPMTWKLLSGYLPANVDRRPATLQRKQKEYFAFIEHYYDSRNDEVHQDTYRQIHIDIPRMSPEALILQPKVTEIFERILFIWAIRHPASGYVQGINDLVTPFFVVFICEYIEAEEVDTVDVSGVPAEVLCNIEADTYWCMSKLLDGIQTTTPLPNLGPLGLKGPLGVPSS

SEQ ID NO: 839664 - protein, 345 aa, Homo sapiens [sequence omitted]

SEQ ID NO: 839665 - protein, 258 aa, Homo sapiens
MASDGARKQFWKRSNSKLPGSIQHVYGAQHPPFDPLLHGTLLRSTAKMPTTPVKAKRVSTFQEFESNTSDAWDAGEDDDELLAMAAESLNSEVVMETANRVLRNHSQRQGRPTLQEGPGLQQKPRPEAEPPSPPSGDLRLVKSVSESHTSCPAESASDAAPLQRSQSLPHSATVTLGGTSDPSTLSSSALSEREASRLDKFKQLLAGPNTDLEELRRLSWSGIPKPVRPMTWKLLSGYLPANVDRRPATLQRKQNINK

SEQ ID NO: 839666 - protein, 163 aa, Homo sapiens [sequence omitted]

SEQ ID NO: 839667 - protein, 251 aa, Homo sapiens
RIAPTHAHWGVRRASLCPVIPVSLGAAELTPRSEMSKLPADSSVPQTGAANGDRDVPQAEVGRGRREPAPAQPEEAGEGAMAAARGGPVPAAREGRMAAARAAPAAAARGAPVAAAALARAAAAGRESPAAAAAREARMAEVARLLGEPVDEEGPEGRPRSRHGNGGLAALPYLRLRHPLSVLGINYQQFLRHYLENYPIAPGRIQELEERRRRFVEACRAREAAFDAEYQAKSSQGGPRYFNLYDSSDCL

SEQ ID NO: 839668 - protein, 267 aa, Homo sapiens
RIAPTHAHWGVRRASLCPVIPVSLGAAELTPRSEMSKLPADSSVPQTGAANGDRDVPQAEVGRGRREPAPAQPEEAGEGAMAAARGGPVPAAREGRMAAARAAPAAAARGAPVAAAALARAAAAGRESPAAAAAREARMAYVFAPGFLPGGGQPHVGHPKGRVPPREGARRPQGPRTRANGKGLAALPYLRLRHPLSVLGINYQQFLRHYLENYPIAPGRIQELEERRRRFVEACRAREAAFDAEYQAKSSQGGPRYFNLYDSSDCL

SEQ ID NO: 839669 - protein, 251 aa, Homo sapiens; identical to SEQ ID NO: 839667

SEQ ID NO: 839670 - protein, 251 aa, Homo sapiens; identical to SEQ ID NO: 839667

SEQ ID NO: 839671 - protein, 434 aa, Homo sapiens
LGSCCRVAGGRAAALRGPGAGGPAARPRLGGDGGGRRHLGQGQPRELAGCGSRADGGFRPSRVVVVAKTTRYEFEQQRYRYAELSEEDLKQLLALKGSSYSGLLERHHIHTKNVEHIIDSLRNEGIEVRLVKRREYDEETVRWADAVIAAGGDGTMLLAASKVLDRLKPVIGVNTDPERSEGHLCLPVRYTHSFPEALQKFYRGEFRWLWRQRIRLYLEGTGINPVPVDLHEQQLSLNQHNRALNIERAHDERSEASGPQLLPVRALNEVFIGESLSSRASYYEISVDDGPWEKQKSSGLNLCTGTGSKAWSFNINRVATQAVEDVLNIAKRQGNLSLPLNRELVEKVTNEYNESLLYSPEEPKILFSIREPIANRVFSSSRQRCFSSKVCVRSRCWDACMVVDGGTSFEFNDGAIASMMINKEDELRTVLLEQ

SEQ ID NO: 839672 - protein, 434 aa, Homo sapiens; identical to SEQ ID NO: 839671

SEQ ID NO: 839673 - protein, 456 aa, Homo sapiens
LGSCCRVAGGRAAALRGPGAGGPAARPRLGGDGGGRRHLGQGQPRELAGCGSRADGGFRPSRVVVVAKTTRYEFEQQRYRYAELSEEDLKQLLALKGSSYSGLLERHHIHTKNVEHIIDSLRNEGIEVRLVKRREYDEETVRWADAVIAAGGDGTMLLAASKVLDRLKPVIGVNTDPERSEGHLCLPVRYTHSFPEALQKFYRGEFRWLWRQRIRLYLEGTGINPVPVDLHEQQLSLNQHNRALNIERAHDERSEASGPQLLPVRALNEVFIGESLSSRMSYSWAVAVDNLRRSIPTLKGLASYYEISVDDGPWEKQKSSGLNLCTGTGSKAWSFNINRVATQAVEDVLNIAKRQGNLSLPLNRELVEKVTNEYNESLLYSPEEPKILFSIREPIANRVFSSSRQRCFSSKVCVRSRCWDACMVVDGGTSFEFNDGAIASMMINKEDELRTVLLEQ

SEQ ID NO: 839674 - protein, 438 aa, Homo sapiens
LGSCCRVAGGRAAALRGPGAGGPAARPRLGGDGGGRRHLGQGQPRELAGCGSRADGGFRPSRVVVVAKTTRYEFEQQRYRYAELSEEDLKQLLALKGSSYSGLLERHHIHTKNVEHIIDSLRNEGIEVRLVKRREYDEETVRWADAVIAAGGDGTMLLAASKVLDRLKPVIGVNTDPERSEGHLCLPVRYTHSFPEALQKFYRGEFRWLWRQRIRLYLEGTGINPVPVDLHEQQLSLNQHNRALNIERAHDERSEASGPQLLPVRALNEVFIGESLSSRMSYSWAVAVDNLRRSIPTLKGLASYYEISVDDGPWEKQKSSGLNLCTGTGSKAWSFNINRVATQAVEDVLNIAKRQGNLSLPLNRELVEKVTNEYNESLLYSPEEPKIIFPSAWVCVRSRCWDACMVVDGGTSFEFNDGAIASMMINKEDELRTVLLEQ

SEQ ID NO: 839675 - protein, 434 aa, Homo sapiens; identical to SEQ ID NO: 839671

SEQ ID NO: 839676 - protein, 279 aa, Homo sapiens
MLLAASKVLDRLKPVIGVNTDPERSEGHLCLPVRYTHSFPEALQKFYRGEFRWLWRQRIRLYLEGTGINPVPVDLHEQQLSLNQHNRALNIERAHDERSEASGPQLLPVRALNEVFIGESLSSRASYYEISVDDGPWEKQKSSGLNLCTGTGSKAWSFNINRVATQAVEDVLNIAKRQGNLSLPLNRELVEKVTNEYNESLLYSPEEPKILFSIREPIANRVFSSSRQRCFSSKVCVRSRCWDACMVVDGGTSFEFNDGAIASMMINKEDELRTVLLEQ

SEQ ID NO: 839677 - protein, 279 aa, Homo sapiens; identical to SEQ ID NO: 839676

SEQ ID NO: 839678 - protein, 416 aa, Homo sapiens
LGSCCRVAGGRAAALRGPGAGGPAARPRLGGDGGGRRHLGQGQPRELAGCGSRADGGFRPSRVVVVAKTTRYEFEQQRYRYAELSEEDLKQLLALKGSSYSGLLERHHIHTKNVEHIIDSLRNEGIEVRLVKRREYDEETVRWADAVIAAGGDGTMLLAASKVLDRLKPVIGVNTDPERSEGHLCLPVRYTHSFPEALQKFYRGEFRWLWRQRIRLYLEGTGINPVPVDLHEQQLSLNQHNRALNIERAHDERSEASGPQLLPVRALNEVFIGESLSSRASYYEISVDDGPWEKQKSSGLNLCTGTGSKAWSFNINRVATQAVEDVLNIVTNEYNESLLYSPEEPKILFSIREPIANRVFSSSRQRCFSSKVCVRSRCWDACMVVDGGTSFEFNDGAIASMMINKEDELRTVLLEQ

SEQ ID NO: 839679 - protein, 434 aa, Homo sapiens; identical to SEQ ID NO: 839671

SEQ ID NO: 839680 - protein, 91 aa, Homo sapiens
VCVVYLCFIHKNSVDFWPPKPICEHMLKEKRWGVEAESAGEKCIEPYSRVLKRWEEMSCKARQRVHERAWRAEMMGVWDRKQKGRGSLPGG

SEQ ID NO: 839681 - protein, 1113 aa, Homo sapiens
RLGFKNSDVNIDIQFPAIMSQPDVLLLVQECLKNSDSFIDVDADFHARVPVVVCREKQSGLLCKVSAGNENACLTTKHLTALGKLEPKLVPLVIAFRYWAKLCSIDRPEEGGLPPYVFALMAIFFLQQRKEPLLPVYLGSWIEGFSLSKLGNFNLQDIEKDVVIWEHTDSAAGDTGITKEEAPRETPIKRGQVSLILDVKHQPSVPVGQLWVELLRFYALEFNLADLVISIRVKELVSRELKDWPKKRIAIEDPYSVKRNVARTLNSQPVFEYILHCLRTTYKYFALPHKITKSSLLKPLNAITCISEHSKEVINHHPDVQTKDDKLKNSVLAQGPGATSSAANTCKVQPLTLKETAESFGSPPKEEMGNEHISVHPENSDCIQADVNSDDYKGDKVYHPETGRKNEKEKVGRKGKHLLTVDQKRGEHVVCGSTRNNESESTLDLEGFQNPTAKECEGLATLDNKADLDGESTEGTEELEDSLNHFTHSVQGQTSEMIPSDEEEEDDEEEEEEEEPRLTINQREDEDGMANEDELDNTYTGSGDEDALSEEDDELGEAAKYEDVKECGKHVERALLVELNKISLKEENVCEEKNSPVDQSDFFYEFSKLIFTKGKSPTVVCSLCKREGHLKKDCPEDFKRIQLEPLPPLTPKFLNILDQVCIQCYKDFSPTIIEDQAREHIRQNLESFIRQDFPGTKLSLFGSSKNGFGFKQSDLDVCMTINGLETAEGLDCVRTIEELARVLRKHSGLRNILPITTAKVPIVKFFHLRSGLEVDISLYNTLALHNTRLLSAYSAIDPRVKYLCYTMKVFTKIYKGEKKPEIFVDGWNIYFFDQIDELPTYWSECGKNTESVGQLWLGLLRFYTEEFDFKEHVISIRRKSLLTTFKKQWTSKYIVIEDPFDLNHNLGAGLSRKMTNFIMKAFINGRRVFGIPVKGFPKDYPSKMEYFFDPDVLTEGELAPNDRCCRICGKIGHFMKDCPMRRKVRRRRDQEDALNQRYPENKEKRSKEDKEIHNKYTEREVSTKEDKPIQCTPQKAKPMRAAADLGREKILRPPVEKWKRQDDKDLREKRCFICGREGHIKKECPQFKGSSGSLSSKYMTQGKASAKRTQQES

SEQ ID NO: 839682 - protein, 746 aa, Homo sapiens
MGNEHISVHPENSDCIQADVNSDDYKGDKVYHPETGRKNEKEKVGRKGKHLLTVDQKRGEHVVCGSTRNNESESTLDLEGFQNPTAKECEGLATLDNKADLDGESTEGTEELEDSLNHFTHSVQGQTSEMIPSDEEEEDDEEEEEEEEPRLTINQREDEDGMANEDELDNTYTGSGDEDALSEEDDELGEAAKYEDVKECGKHVERALLVELNKISLKEENVCEEKNSPVDQSDFFYEFSKLIFTKGKSPTVVCSLCKREGHLKKDCPEDFKRIQLEPLPPLTPKFLNILDQVCIQCYKDFSPTIIEDQAREHIRQNLESFIRQDFPGTKLSLFGSSKNGFGFKQSDLDVCMTINGLETAEGLDCVRTIEELARVLRKHSGLRNILPITTAKVPIVKFFHLRSGLEVDISLYNTLALHNTRLLSAYSAIDPRVKYLCYTMKVFTKIYKGEKKPEIFVDGWNIYFFDQIDELPTYWSECGKNTESVGQLWLGLLRFYTEEFDFKEHVISIRRKSLLTTFKKQWTSKYIVIEDPFDLNHNLGAGLSRKMTNFIMKAFINGRRVFGIPVKGFPKDYPSKMEYFFDPDVLTEGELAPNDRCCRICGKIGHFMKDCPMRRKVRRRRDQEDALNQRYPENKEKRSKEDKEIHNKYTEREVSTKEDKPIQCTPQKAKPMRAAADLGREKILRPPVEKWKRQDDKDLREKRCFICGREGHIKKECPQFKGSSGSLSSKYMTQGKASAKRTQQES

SEQ ID NO: 839683 - protein, 1138 aa, Homo sapiens
RLGFKNSDVNIDIQFPAIMSQPDVLLLVQECLKNSDSFIDVDADFHARVPVVVCREKQSGLLCKVSAGNENACLTTKHLTALGKLEPKLVPLVIAFRYWAKLCSIDRPEEGGLPPYVFALMAIFFLQQRKEPLLPVYLGSWIEGFSLSKLGNFNLQDIEKDVVIWEHTDSAAGDTGITKEEAPRETPIKRGQVSLILDVKHQPSVPVGQLWVELLRFYALEFNLADLVISIRVKELVSRELKDWPKKRIAIEDPYSVKRNVARTLNSQPVFEYILHCLRTTYKYFALPHKITKSSLLKPLNAITCISEHSKEVINHHPDVQTKDDKLKNSVLAQGPGATSSAANTCKVQPLTLKETAESFGSPPKEEMGNEHISVHPENSDCIQADVNSDDYKGDKVYHPETGRKNEKEKVGRKGKHLLTVDQKRGEHVVCGSTRNNESESTLDLEGFQNPTAKECEGLATLDNKADLDGESTEGTEELEDSLNHFTHSVQGQTSEMIPSDEEEEDDEEEEEEEEPRLTINQREDEDGMANEDELDNTYTGSGDEDALSEEDDELGEAAKYEDVKECGKHVERALLVELNKISLKEENVCEEKNSPVDQSDFFYEFSKLIFTKGKSPTVVCSLCKREGHLKKDCPEDFKRIQLEPLPPLTPKFLNILDQVCIQCYKDFSPTIIEDQAREHIRQNLESFIRQDFPGTKLSLFGSSKNGFGFKQSDLDVCMTINGLETAEGLDCVRTIEELARVLRKHSGLRNILPITTAKVPIVKFFHLRSGLEVDISLYNTLALHNTRLLSAYSAIDPRVKYLCYTMKVFTKIYKGEKKPEIFVDGWNIYFFDQIDELPTYWSECGKNTESVGQLWLGLLRFYTEEFDFKEHVISIRRKSLLTTFKKQWTSKYIVIEDPFDLNHNLGAGLSRKMTNFIMKAFINGRRVFGIPVKGFPKDYPSKMEYFFDPDVLTEGELAPNDRCCRICGKIGHFMKDCPMRRKVRRRRDQEDALNQRYPENKEKRSKEDKEIHNKYTEREVSTKEDKPIQCTPQKAKPMRAAADLGREKILRPPVEKWKRQDDKDLREKRCFICGREGHIKKECPQFKGSSGMSKSDCMFGSPSPVPLKPTGLFVQAVLLHEDKKKQKTTIFLSPQSG

SEQ ID NO: 839684 - protein, 1096 aa, Homo sapiens
RLGFKNSDVNIDIQFPAIMSQPDVLLLVQECLKNSDSFIDVDADFHARVPVVVCREKQSGLLCKVSAGNENACLTTKHLTALGKLEPKLVPLVIAFRYWAKLCSIDRPEEGGLPPYVFALMAIFFLQQRKEPLLPVYLGSWIEGFSLSKLGNFNLQDIEKDVVIWEHTDSAAGDTGITKEEAPRETPIKRGQVSLILDVKHQPSVPVGQLWVELLRFYALEFNLADLVISIRVKELVSRELKDWPKKRIAIEDPYSVKRNVARTLNSQPVFEYILHCLRTTYKYFALPHKITKSSLLKPLNAITCISEHSKEVINHHPDVQTKDDKLKNSVLAQGPGATSSAANTCKVQPLTLKETAESFGSPPKEEMGNEHISVHPENSDCIQADVNSDDYKGDKVYHPETGRKNEKEKVGRKGKHLLTVDQKRGEHVVCGSTRNNESESTLDLEGFQNPTAKECEGLATLDNKADLDGESTEGTEELEDSLNHFTHSVQGQTSEMIPSDEEEEDDEEEEEEEEPRLTINQREDEDGMANEDELDNTYTGSGDEDALSEEDDELGEAAKYEDVKECGKHVERALLVELNKISLKEENVCEEKNSPVDQSDFFYEFSKLIFTKGKSPTVVCSLCKREGHLKKDCPEDFKRIQLEPLPPLTPKFLNILDQVCIQCYKDFSPTIIEDQAREHIRQNLESFIRQDFPGTKLSLFGSSKNGFGFKQSDLDVCMTINGLETAEGLDCVRTIEELARVLRKHSGLRNILPITTAKVPIVKFFHLRSGLEVDISLYNTLALHNTRLLSAYSAIDPRVKYLCYTMKVFTKIYKGEKKPEIFVDGWNIYFFDQIDELPTYWSECGKNTESVGQLWLGLLRFYTEEFDFKEHVISIRRKSLLTTFKKQWTSKYIVIEDPFDLNHNLGAGLSRKMTNFIMKAFINGRRVFGIPVKGFPKDYPSKMEYFFDPDVLTEGELAPNDRCCRICGKIGHFMKDCPMRRKVRRRRDQEDALNQRYPENKEKRSKEDKEIHNKYTEREVSTKEDKPIQCTPQKAKPMRAAADLGREKILRPPVEKWKRQDDKDLREKRCFICGREGHIKKECPQFKGSSGSAFT

SEQ ID NO: 839685 - protein, 1113 aa, Homo sapiens; identical to SEQ ID NO: 839681

SEQ ID NO: 839686 - protein, 628 aa, Homo sapiens
RLGFKNSDVNIDIQFPAIMSQPDVLLLVQECLKNSDSFIDVDADFHARVPVVVCREKQSGLLCKVSAGNENACLTTKHLTALGKLEPKLVPLVIAFRYWAKLCSIDRPEEGGLPPYVFALMAIFFLQQRKEPLLPVYLGSWIEGFSLSKLGNFNLQDIEKDVVIWEHTDSAAGDTGITKEEAPRETPIKRGQVSLILDVKHQPSVPVGQLWVELLRFYALEFNLADLVISIRVKELVSRELKDWPKKRIAIEDPYSVKRNVARTLNSQPVFEYILHCLRTTYKYFALPHKITKSSLLKPLNAITCISEHSKEVINHHPDVQTKDDKLKNSVLAQGPGATSSAANTCKVQPLTLKETAESFGSPPKEEMGNEHISVHPENSDCIQADVNSDDYKGDKVYHPETGRKNEKEKVGRKGKHLLTVDQKRGEHVVCGSTRNNESESTLDLEGFQNPTAKECEGLATLDNKADLDGESTEGTEELEDSLNHFTHSVQGQTSEMIPSDEEEEDDEEEEEEEEPRLTINQREDEDGMANEDELDNTYTGSGDEDALSEEDDELGEAAKYEDVKECGKHVERALLVELNKISLKEENVCEEKNSPVDQSDFFYEFSKLIFTKGKVISTTTSHRTRRL

SEQ ID NO: 839687 - protein, 842 aa, Homo sapiens
RLGFKNSDVNIDIQFPAIMSQPDVLLLVQECLKNSDSFIDVDADFHARVPVVVCREKQSGLLCKVSAGNENACLTTKHLTALGKLEPKLVPLVIAFRYWAKLCSIDRPEEGGLPPYVFALMAIFFLQQRKEPLLPVYLGSWIEGFSLSKLGNFNLQDIEKDVVIWEHTDSAAGDTGITKEEAPRETPIKRGQVSLILDVKHQPSVPVGQLWVELLRFYALEFNLADLVISIRVKELVSRELKDWPKKRIAIEDPYSVKRNVARTLNSQPVFEYILHCLRTTYKYFALPHKITKSSLLKPLNAITCISEHSKEVINHHPDVQTKDDKLKNSVLAQGPGATSSAANTCKVQPLTLKETAESFGSPPKEEMGNEHISVHPENSDCIQADVNSDDYKGDKVYHPETGRKNEKEKVGRKGKHLLTVDQKRGEHVVCGSTRNNESESTLDLEGFQNPTAKECEGLATLDNKADLDGESTEGTEELEDSLNHFTHSVQGQTSEMIPSDEEEEDDEEEEEEEEPRLTINQREDEDGMANEDELDNTYTGSGDEDALSEEDDELGEAAKYEDVKECGKHVERALLVELNKISLKEENVCEEKNSPVDQSDFFYEFSKLIFTKGKSPTVVCSLCKREGHLKKDCPEDFKRIQLEPLPPLTPKFLNILDQVCIQCYKDFSPTIIEDQAREHIRQNLESFIRQDFPGTKLSLFGSSKNGFGFKQSDLDVCMTINGLETAEGLDCVRTIEELARVLRKHSGLRNILPITTAKVPIVKFFHLRSGLEVDISLYNTLALHNTRLLSAYSAIDPRVKYLCYTMKVFTKVSMLPYCDLSGNFIASLNTVGNINLFFNEL

SEQ ID NO: 839688 - protein, 142 aa, Homo sapiens
RLGFKNSDVNIDIQFPAIMSQPDVLLLVQECLKNSDSFIDVDADFHARVPVVVCREKQSGLLCKVSAGNENACLTTKHLTALGKLEPKLVPLVIAFRYWAKLCSIDRPEEGGLPPYVFALMAIFFLQQRKEPLLPVYLGSWV

SEQ ID NO: 839689 - protein, 1151 aa, Homo sapiens
RLGFKNSDVNIDIQFPAIMSQPDVLLLVQECLKNSDSFIDVDADFHARVPVVVCREKQSGLLCKVSAGNENACLTTKHLTALGKLEPKLVPLVIAFRYWAKLCSIDRPEEGGLPPYVFALMAIFFLQQRKEPLLPVYLGSWIEGFSLSKLGNFNLQDIEKDVVIWEHTDSAAGDTGITKEEAPRETPIKRGQVSLILDVKHQPSVPVGQLWVELLRFYALEFNLADLVISIRVKELVSRELKDWPKKRIAIEDPYSVKRNVARTLNSQPVFEYILHCLRTTYKYFALPHKITKSSLLKPLNAITCISEHSKEVINHHPDVQTKDDKLKNSVLAQGPGATSSAANTCKVQPLTLKETAESFGSPPKEEMGNEHISVHPENSDCIQADVNSDDYKGDKVYHPETGRKNEKEKVGRKGKHLLTVDQKRGEHVVCGSTRNNESESTLDLEGFQNPTAKECEGLATLDNKADLDGESTEGTEELEDSLNHFTHSVQGQTSEMIPSDEEEEDDEEEEEEEEPRLTINQREDEDGMANEDELDNTYTGSGDEDALSEEDDELGEAAKYEDVKECGKHVERALLVELNKISLKEENVCEEKNSPVDQSDFFYEFSKLIFTKGKSPTVVCSLCKREGHLKKDCPEDFKRIQLEPLPPLTPKFLNILDQVCIQCYKDFSPTIIEDQAREHIRQNLESFIRQDFPGTKLSLFGSSKNGFGFKQSDLDVCMTINGLETAEGLDCVRTIEELARVLRKHSGLRNILPITTAKVPIVKFFHLRSGLEVDISLYNTLALHNTRLLSAYSAIDPRVKYLCYTMKVFTKMCDIGDASRGSLSSYAYTLMVLYFLQQRNPPVIPVLQEIYKGEKKPEIFVDGWNIYFFDQIDELPTYWSECGKNTESVGQLWLGLLRFYTEEFDFKEHVISIRRKSLLTTFKKQWTSKYIVIEDPFDLNHNLGAGLSRKMTNFIMKAFINGRRVFGIPVKGFPKDYPSKMEYFFDPDVLTEGELAPNDRCCRICGKIGHFMKDCPMRRKVRRRRDQEDALNQRYPENKEKRSKEDKEIHNKYTEREVSTKEDKPIQCTPQKAKPMRAAADLGREKILRPPVEKWKRQDDKDLREKRCFICGREGHIKKECPQFKGSSGSLSSKYMTQGKASAKRTQQES

SEQ ID NO: 839690 - protein, 1137 aa, Homo sapiens
RLGFKNSDVNIDIQFPAIMSQPDVLLLVQECLKNSDSFIDVDADFHARVPVVVCREKQSGLLCKVSAGNENACLTTKHLTALGKLEPKLVPLVIAFRYWAKLCSIDRPEEGGLPPYVFALMAIFFLQQRKEPLLPVYLGSWIEGFSLSKLGNFNLQDIEKDVVIWEHTDSAAGDTGITKEEAPRETPIKRGQVSLILDVKHQPSVPVGQLWVELLRFYALEFNLADLVISIRVKELVSRELKDWPKKRIAIEDPYSVKRNVARTLNSQPVFEYILHCLRTTYKYFALPHKITKSSLLKPLNAITCISEHSKEVINHHPDVQTKDDKLKNSVLAQGPGATSSAANTCKVQPLTLKETAESFGSPPKEEMGNEHISVHPENSDCIQADVNSDDYKGDKVYHPETGRKNEKEKVGRKGKHLLTVDQKRGEHVVCGSTRNNESESTLDLEGFQNPTAKECEGLATLDNKADLDGESTEGTEELEDSLNHFTHSVQGQTSEMIPSDEEEEDDEEEEEEEEPRLTINQREDEDGMANEDELDNTYTGSGDEDALSEEDDELGEAAKYEDVKECGKHVERALLVELNKISLKEENVCEEKNSPVDQSDFFYEFSKLIFTKGKSPTVVCSLCKREGHLKKDCPEDFKRIQLEPLPPLTPKFLNILDQVCIQCYKDFSPTIIEDQAREHIRQNLESFIRQDFPGTKLSLFGSSKNGFGFKQSDLDVCMTINGLETAEGLDCVRTIEELARVLRKHSGLRNILPITTAKVPIVKFFHLRSGLEVDISLYNTLALHNTRLLSAYSAIDPRVKYLCYTMKVFTKIYKGEKKPEIFVDGWNIYFFDQIDELPTYWSECGKNTESVGQLWLGLLRFYTEEFDFKEHVISIRRKSLLTTFKKQWTSKYIVIEDPFDLNHNLGAGLSRKMTNFIMKAFINGRRVFGIPVKGFPKDYPSKMEYFFDPDVLTEGELAPNDRCCRICGKIGHFMKDCPMRRKVRRRRDQEDALNQRYPENKEKRSKEDKEIHNKYTEREVSTKEDKPIQCTPQKAKPMRAAADLGREKILRPPVEKWKRQDDKDLREKRCFICGREGHIKKECPQFKGSSGMSKSDCMFGSPSPVPLKPTGLFVQVNLAQTEKEACLSSVHSGAAP

SEQ ID NO: 839691 - protein, 1113 aa, Homo sapiens; identical to SEQ ID NO: 839681

SEQ ID NO: 839692 - protein, 1137 aa, Homo sapiens; identical to SEQ ID NO: 839690

SEQ ID NO: 839693 - protein, 417 aa, Homo sapiens
RLGFKNSDVNIDIQFPAIMSQPDVLLLVQECLKNSDSFIDVDADFHARVPVVVCREKQSGLLCKVSAGNENACLTTKHLTALGKLEPKLVPLVIAFRYWAKLCSIDRPEEGGLPPYVFALMAIFFLQQRKEPLLPVYLGSWIEGFSLSKLGNFNLQDIEKDVVIWEHTDSAAGDTGITKEEAPRETPIKRGQVSLILDVKHQPSVPVGQLWVELLRFYALEFNLADLVISIRVKELVSRELKDWPKKRIAIEDPYSVKRNVARTLNSQPVFEYILHCLRTTYKYFALPHKITKSSLLKPLNAITCISEHSKEVINHHPDVQTKDDKLKNSVLAQGPGATSSAANTCKVQPLTLKETAESFGSPPKEEMGNEHISVHPENSDCIQADVNSDDYKGDKVYHPETGRKNEKEKVLVKKIK

SEQ ID NO: 839694 - protein, 1979 aa, Homo sapiens [sequence omitted]

SEQ ID NO: 839695 - protein, 1979 aa, Homo sapiens [sequence omitted]

SEQ ID NO: 839696 - protein, 1979 aa, Homo sapiens [sequence omitted]

SEQ ID NO: 839697 - protein, 80 aa, Homo sapiens
MSSWLGGLGSGLGQSLGQVGGSLASLTGQISNFTKDMLMEGTEEVEAELPDSRTKEIEAIHAILRSELPLCTHLLSAFYI

SEQ ID NO: 839698 - protein, 57 aa, Homo sapiens
KDRVGAGVGAKTASQTGDEGEPGDEVSGTPLREVSKVLEGQEVSLCLGEGGPWASVP

SEQ ID NO: 839699 - protein, 212 aa, Homo sapiens
MCSVKVNSTVIPAWVVLGIPNFSPPATSPRIVSVRVLTDREMRASLLFMTVKALQVLALRVSPASPGTPLPLACFLQPWWPFIPQTRFLSCPRKGLCRCSSHSLKVPRVAGSSSPSRPPGLSSNASPWERLVLTTTASCLNTADSLSPLESKHQGSKSRVGFIHPGLSKHSKRSGEHVMSGWVTKSYDPRHGTHMGTHPMGRHEPGVRRNWV

SEQ ID NO: 839700 - protein, 32 aa, Homo sapiens
MSVPCRVADYLKLMAVPPGSLAGRNESTKPPE

SEQ ID NO: 839701 - protein, 417 aa, Homo sapiens
AGELPVRFRCTGTWGEALFIKEKGFFWSPTTGPMAAVQMDPELAKRLFFEGATVVILNMPKGTEFGIDYNSWEVGPKFRGVKMIPPGIHFLHYSSVDKANPKEVGPRMGFFLSLHQRGLTVLRWSTLREEVDLSPAPESEVEAMRANLQELDQFLGPYPYATLKKWISLTNFISEATVEKLQPENRQICAFSDVLPVLSMKHTKDRVGQNLPRCGIECKSYQEGLARLPEMKPRAGTEIRFSELPTQMFPEGATPAEITKHSMDLSYALETVLNKQFPSSPQDVLGELQFAFVCFLLGNVYEAFEHWKRLLNLLCRSEAAMMKHHTLYINLISILYHQLGEIPADFFVDIVSQDNFLTSTLQVFFSSACSIAVDATLRKKAEKFQAHLTKKFRWDFAAEPEDCAPVVVELPEGIEMG

SEQ ID NO: 839702 - protein, 417 aa, Homo sapiens; identical to SEQ ID NO: 839701

SEQ ID NO: 839703 - protein, 396 aa, Homo sapiens
AGELPVRFRCTGTWGEALFIKEKGFFWSPTTGPMAAVQMDPELAKRLFFEGATVVILNMPKGTEFGIDYNSWEVGPKFRGVKMIPPGIHFLHYSSVDKANPKEVGPRMGFFLSLHQRGLTVLRWSTLREEVDLSPAPESEVEAMRANLQELDQFLGPYPYATLKKWISLTNFISEATVEKLQPENRQICAFSDVLPVLSMKHTKDRVGQNLPRCGIECKSYQEGLARLPEMKPRAGTEIRFSELPTQMFPEGATPAEITKHSMDLSYALETVLNKQFPSSPQDVLGELQFAFVCFLLGNVYEAFEHWKRLLNLLCRSEAAMMKHHTLYINLISILYHQLGEIPADFFVDIVSQDNFLTSTLQVFFSSACSIAVDATLRTEDCAPVVVELPEGIEMG

SEQ ID NO: 839704 - protein, 335 aa, Homo sapiens
AGELPVRFRCTGTWGEALFIKEKGFFWSPTTGPMAAVQMDPELAKRLFFEGATVVILNMPKGTEFGIDYNSWEVGPKFRGVKMIPPGIHFLHYSSVDKANPKEVGPRMGFFLSLHQRGLTVLRWSTLREEVDLSPAPESEVEAMRANLQELDQFLGPYPYATLKKWISLTNFISEATVEKLQPENRQICAFSDVLPVLSMKHTKDRVGQNLPRCGIECKSYQEGLARLPEMKPRAGTEIRFSELPTQMFPEGATPAEITKHSMDLSYALETVLNKQFPSSPQDVLGELQFAFVCFLLGNVYEAFEHWKRLLNLLCRSEAAMMKHHTRKLKSSKLT

SEQ ID NO: 839705 - protein, 384 aa, Homo sapiens
MAAVQMDPELAKRLFFEGATVVILNMPKGTEFGIDYNSWEVGPKFRGVKMIPPGIHFLHYSSVDKANPKEVGPRMGFFLSLHQRGLTVLRWSTLREEVDLSPAPESEVEAMRANLQELDQFLGPYPYATLKKWISLTNFISEATVEKLQPENRQICAFSDVLPVLSMKHTKDRVGQNLPRCGIECKSYQEGLARLPEMKPRAGTEIRFSELPTQMFPEGATPAEITKHSMDLSYALETVLNKQFPSSPQDVLGELQFAFVCFLLGNVYEAFEHWKRLLNLLCRSEAAMMKHHTLYINLISILYHQLGEIPADFFVDIVSQDNFLTSTLQVFFSSACSIAVDATLRKKAEKFQAHLTKKFRWDFAAEPEDCAPVVVELPEGIEMG

SEQ ID NO: 839706 - protein, 175 aa, Homo sapiens
GLHGIVQYFLTLEQTIHIENHLGSLLELQIRRPHHLSSTRTSEGELQFAFVCFLLGNVYEAFEHWKRLLNLLCRSEAAMMKHHTLYINLISILYHQLGEIPADFFVDIVSQDNFLTSTLQVFFSSACSIAVDATLRKKAEKFQAHLTKKFRWDFAAEPEDCAPVVVELPEGIEMG

SEQ ID NO: 839707 - protein, 307 aa, Homo sapiens
AGELPVRFRCTGTWGEALFIKEKGFFWSPTTGPMAAVQMDPELAKRLFFEGATVVILNMPKGTEFGIDYNSWEVGPKFRGVKMIPPGIHFLHYSSVDKANPKEVGPRMGFFLSLHQRGLTVLRWSTLREEVDLSPAPESEVEAMRANLQELDQFLGPYPYATLKKWISLTNFISEATVEKLQPENRQICAFSDVLPVLSMKHTKDRVGQNLPRCGIECKSYQEGLARLPEMKPRAGTEIRFSELPTQMFPEGATPAEITKHSMDLSYALETVLNKQFPSSPQDVLGEKEQGSLGVGQGEDISRGVLE

SEQ ID NO: 839708 - protein, 417 aa, Homo sapiens; identical to SEQ ID NO: 839701

SEQ ID NO: 839709 - protein, 417 aa, Homo sapiens; identical to SEQ ID NO: 839701

SEQ ID NO: 839710 - protein, 384 aa, Homo sapiens; identical to SEQ ID NO: 839705

SEQ ID NO: 839711 - protein, 384 aa, Homo sapiens; identical to SEQ ID NO: 839705

SEQ ID NO: 839712 - protein, 399 aa, Homo sapiens
AGELPVRFRCTGTWGEALFIKEKGFFWSPTTGPMAAVQMDPELAKRLFFEGATVVILNMPKGTEFGIDYNSWEVGPKFRGVKMIPPGIHFLHYSSVDKANPKEVGPRMGFFLSLHQRGLTVLRWSTLREEVDLSPAPESEVEAMRANLQELDQFLGPYPYATLKKWISLTNFISEATVEKLQPENRQICAFSDVLPVLSMKHTKDRVGQNLPRCGIECKKIRFSELPTQMFPEGATPAEITKHSMDLSYALETVLNKQFPSSPQDVLGELQFAFVCFLLGNVYEAFEHWKRLLNLLCRSEAAMMKHHTLYINLISILYHQLGEIPADFFVDIVSQDNFLTSTLQVFFSSACSIAVDATLRKKAEKFQAHLTKKFRWDFAAEPEDCAPVVVELPEGIEMG

SEQ ID NO: 839713 - protein, 338 aa, Homo sapiens
MNDFDECGQSAASMYLPGCAYYVAPSDFASKPSFLSQPSSCQMTFPYSSNLAPHVQPVREVAFRDYGLERAKWPYRGGGGGGSAGGGSSGGGPGGGGGGAGGYAPYYAAAAAAAAAAAAAEEAAMQRELLPPAGRRPDVLFKAPEPVCAAPGPPHGPAGAASNFYSAVGRNGILPQGFDQFYEAAPGPPFAGPQPPPPPAPPQPEGAADKGDPRTGAGGGGGSPCTKATPGSEPKGAAEGSGGDGEGPPGEAGAEKSSSAVAPQRSRKKRCPYTKYQIRELEREFFFNVYINKEKRLQLSRMLNLTDRQVKIWFQNRRMKEKKLNRDRLQYFTGNPLF

SEQ ID NO: 839714 - protein, 338 aa, Homo sapiens; identical to SEQ ID NO: 839713

SEQ ID NO: 839715 - protein, 309 aa, Homo sapiens
MNDFDECGQSAASMYLPGCAYYVAPSDFASKPSFLSQPSSCQMTFPYSSNLAPHVQPVREVAFRDYGLERAKWPYRGGGGGGSAGGGSSGGGPGGGGGGAGGYAPYYAAAAAAAAAAAAAEEAAMQRELLPPAGRRPDVLFKAPEPVCAAPGPPHGPAGAASNFYSAVGRNGILPQGFDQFYEAAPGPPFGGGSPCTKATPGSEPKGAAEGSGGDGEGPPGEAGAEKSSSAVAPQRSRKKRCPYTKYQIRELEREFFFNVYINKEKRLQLSRMLNLTDRQVKIWFQNRRMKEKKLNRDRLQYFTGNPLF

SEQ ID NO: 839716 - protein, 1135 aa, Homo sapiens
RPPAAERGRAGRGRSRRARGAARHVAAGSRVRVRLSARGPAMAGMDSGNLKTARLWRDAALRARKLRSNLRQLTLTAAGACPGAGADALESPASPQLVLPANLGDIEALNLGNNGLEEVPEGLGSALGSLRVLVLRRNRFARLPPAVAELGHHLTELDVSHNRLTALGAEVVSALRELRKLNLSHNQLPALPAQLGALAHLEELDVSFNRLAHLPDSLSCLSRLRTLDVDHNQLTAFPRQLLQLVALEELDVSSNRLRGLPEDISALRALKILWLSGAELGTLPAGFCELASLESLMLDNNGLQALPAQFSCLQRLKMLNLSSNLFEEFPAALLPLAGLEELYLSRNQLTSVPSLISGLGRLLTLWLDNNRIRYLPDSIVELTGLEELVLQGNQIAVLPDHFGQLSRVGLWKIKDNPLIQPPYEVCMKGIPYIAAYQKELAHSQPAVQPRLKLLLMGHKAAGKTLLRHCLTEERVEGCPGGGDKEKCYPPSPPPVSKGIEVTSWTADASRGLRFIVYDLAGDESYEVIQPFFLSPGALYVLVVNLATYEPRHFPTTVGSFLHRVGARVPHAVVCIVGTHADLCGERELEEKCLDIHRQIALQEKHDAEGLSRLAKVVDEALARDFELRSASPHAAYYGVSDKNLRRRKAHFQYLLNHRLQILSPVLPVSCRDPRHLRRLRDKLLSVAEHREIFPNLHRVLPRSWQVLEELHFQPPQAQRLWLSWWDSARLGLQAGLTEDRLQSALSYLHESGKLLYFEDSPALKEHVFHNLTRLIDILNVFFQRDPSLLLHKLLLGTSGEGKAEGESSPPMARSTPSQELLRATQLHQYVEGFLLHGLLPAHVIRLLLKPHVQAQQDLQLLLELLEKMGLCYCLNKPKGKPLNGSTAWYKFPCYVQNEVPHAEAWINGTNLAGQSFVAEQLQIEYSFPFTFPPGLFARYSVQINSHVVHRSDGKFQIFAYRGKVPVVVSYRPARGVLQPDTLSIASHASLPNIWTAWQAITPLVEELNVLLQEWPGLHYTVHILCSKCLKRGSPNPHAFPGELLSQPRPEGVAEIICPKNGSERVNVALVYPPTPTVISPCSNTRLQEESGYRDEHAVTFVPGASLWSKEGIKRQQSEETQYRRAEERGVLALKD

SEQ ID NO: 839717 - protein, 1093 aa, Homo sapiens
RPPAAERGRAGRGRSRRARGAARHVAAGSRVRVRLSARGPAMAGMDSGNLKTARLWRDAALRARKLRSNLRQLTLTAAGACPGAGADALESPASPQLVLPANLGDIEALNLGNNGLEEVPEGLGSALGSLRVLVLRRNRFARLPPAVAELGHHLTELDVSHNRLTALGAEVVSALRELRKLNLSHNQLPALPAQLGALAHLEELDVSFNRLAHLPDSLSCLSRLRTLDVDHNQLTAFPRQLLQLVALEELDVSSNRLRGLPEDISALRALKILWLSGAELGTLPAGFCELASLESLMLDNNGLQALPAQFSCLQRLKMLNLSSNLFEEFPAALLPLAGLEELYLSRNQLTSVPSLISGLGRLLTLWLDNNRIRYLPDSIVELTGLEELVLQGNQIAVLPDHFGQLSRVGLWKIKDNPLIQPPYEVCMKGIPYIAAYQKELAHSQPAVQPRLKLLLMGHKAAGKTLLRHCLTEERVEGCPGGGDKEKCYPPSPPPVSKGIEVTSWTADASRGLRFIVYDLAGDESYEVIQPFFLSPGALYVLVVNLATYEPRHFPTTVGSFLHRVGARVPHAVVCIVGTHADLCGERELEEKCLDIHRQIALQEKHDAEGLSRLAKVVDEALARDFELRSASPHAAYYGVSDKNLRRRKAHFQYLLNHRLQILSPVLPVSCRDPRHLRRLRDKLLSVAEHREIFPNLHRVLPRSWQVLEELHFQPPQAQRLWLSWWDSARLGLQAGLTEDRLQSALSYLHESGKLLYFEDSPALKEHVFHNLTRLIDILNVFFQRDPSLLLHKLLLGTSGEGKAEGESSPPMARSTPSQELLRATQLHQYVEGFLLHGLLPAHVIRLLLKPHVQAQQDLQLLLELLEKMGLCYCLNKPKGKPLNGSTAWYKFPCYVQNEVPHAEAWINGTNLAGQSFVAEQLQIEYSFPFTFPPGLFARYSVQINSHVVHRSDGKFQIFAYRGKVPVVVSYRPARGVLQPDTLSIASHASLPNIWTAWQAITPLVEELNVLLQEWPGLHYTVHILCSKCLKRGSPNPHAFPGELLSQPRPEGVAEIICPKNGSERVNVALVYPPTPTVISPCSKKNVGEKHRNQ

SEQ ID NO: 839718 - protein, 1091 aa, Homo sapiens
RPPAAERGRAGRGRSRRARGAARHVAAGSRVRVRLSARGPAMAGMDSGNLKTARLWRDAALRARKLRSNLRQLTLTAAGACPGAGADALESPASPQLVLPANLGDIEALNLGNNGLEEVPEGLGSALGSLRVLVLRRNRFARLPPAVAELGHHLTELDVSHNRLTALGAEVVSALRELRKLNLSHNQLPALPAQLGALAHLEELDVSFNRLAHLPDSLSCLSRLRTLDVDHNQLTAFPRQLLQLVALEELDVSSNRLRGLPEDISALRALKILWLSGAELGTLPAGFCELASLESLMLDNNGLQALPAQFSCLQRLKMLNLSSNLFEEFPAALLPLAGLEELYLSRNQLTSVPSLISGLGRLLTLWLDNNRIRYLPDSIVELTGLEELVLQGNQIAVLPDHFGQLSRVGLWKIKDNPLIQPPYEVCMKGIPYIAAYQKELAHSQPAVQPRLKLLLMGHKAAGKTLLRHCLTEERVEGCPGGGDKEKCYPPSPPPVSKGIEVTSWTADASRGLRFIVYDLAGDESYEVIQPFFLSPGALYVLVVNLATYEPRHFPTTVGSFLHRVGARVPHAVVCIVGTHADLCGERELEEKCLDIHRQIALQEKHDAEGLSRLAKVVDEALARDFELRSASPHAAYYGVSDKNLRRRKAHFQYLLNHRLQILSPVLPVSCRDPRHLRRLRDKLLSVAEHREIFPNLHRVLPRSWQVLEELHFQPPQAQRLWLSWWDSARLGLQAGLTEDRLQSALSYLHESGKLLYFEDSPALKEHVFHNLTRLIDILNVFFQRDPSLLLHKLLLGTSGEGKAEGESSPPMARSTPSQELLRATQLHQYVEGFLLHGLLPAHVIRLLLKPHVQAQQDLQLLLELLEKMGLCYCLNKPKGKPLNGSTAWYKFPCYVQNEVPHAEAWINGTNLAGQSFVAEQLQIEYSFPFTFPPGLFARYSVQINSHVVHRSDGKFQIFAYRGKVPVVVSYRPARGVLQPDTLSIASHASLPNIWTAWQAITPLVEELNVLLQEWPGLHYTVHILCSKCLKRGSPNPHAFPGELLSQPRPEGVAEIICPKNGSERVNVALVYPPTPTVISPCSKYLHTFLEN

SEQ ID NO: 839719 - protein, 100 aa, Homo sapiens
AFTQTGRQRETYTTQAPSSAATHTKSFGGPGSTQALPQRALEASLGAIFPTVGSLRNKIKCGQVQWLTPIIPALWEAKTDGSRGQEIETILANTVKPHLY

SEQ ID NO: 839720 - protein, 957 aa, Homo sapiens
MLNWAGSGFPPAASFASGEMSGAEYGRKGGPATLWLDTALIGPFTRRFWFYVDPEKPKPQGLGRVEREGTTFPSRLRKRDCGHYFSACTERLASGVYRETGVRCAGGHMDPGSRWRNLPSGPSLKHLTDPSYGIPREQQKAALQELTRAHVESFNYAVHEGLGLAVQAIPPFEFAFKDERISFTILDAVISPPTVPKGTICKEANVYPAECRGRRSTYRGKLTADINWAVNGISKGIIKQFLGYVPIMVKSKLCNLRNLPPQALIEHHEEAEEMGGYFIINGIEKVIRMLIMPRRNFPIAMIRPKWKTRGPGYTQYGVSMHCVREEHSAVNMNLHYLENGTVMLNFIYRKELFFLPLGFALKALVSFSDYQIFQELIKGKEDDSFLRNSVSQMLRIVMEEGCLTQKQVLNYLGECFRVKLNVPDWYPNEQAAEFLFNQCICIHLKSNTEKFYMLCLMTRKLFALAKGECMEDNPDSLVNQEVLTPGQLFLMFLKEKLEGWLVSIKIAFDKKAQKTSVSMNTDNLMRIFTMGIDLTKPFEYLFATGNLRSKTGLGLLQDSGLCVVADKLNFIRYLSHFRCVHRGADFAKMRTTTVRRLLPESWGFLCPVHTPDGEPCGLMNHLTAVCEVVTQFVYTASIPALLCNLGVTPIDGAPHRSYSECYPVLLDGVMVGWVDKDLAPGIADSLRHFKVLREKRIPPWMEVVLIPMTGKPSLYPGLFLFTTPCRLVRPVQNLALGKEELIGTMEQIFMNVAIFEDEVFAGVTTHQELFPHSLLSVIANFIPFSDHNQSPRNMYQCQMGKQTMGFPLLTYQDRSDNKLYRLQTPQSPLVRPSMYDYYDMDNYPIGTNAIVAVISYTGYDMEDAMIVNKASWERGFAHGSVYKSEFIDLSEKIKQGDSSLVFGIKPGDPRVLQKLDDDGLPFIGAKLQYGDPYYSYLNLNTGESFVMYYNETGCCLT

SEQ ID NO: 839721 - protein, 1243 aa, Homo sapiens
MLNWAGSGFPPAASFASGEMSGAEYGRKGGPATLWLDTALIGPFTRRFWFYVDPEKPKPQGLGRVEREGTTFPSRLRKRDCGHYFAACTERLASGVYRETGVRCAGGHMDPGSRWRNLPSGPSLKHLTDPSYGIPREQQKAALQELTRAHVESFNYAVHEGLGLAVQAIPPFEFAFKDERISFTILDAVISPPTVPKGTICKEANVYPAECRGRRSTYRGKLTADINWAVNGISKGIIKQFLGYVPIMVKSKLCNLRNLPPQALIEHHEEAEEMGGYFIINGIEKVIRMLIMPRRNFPIAMIRPKWKTRGPGYTQYGVSMHCVREEHSAVNMNLHYLENGTVMLNFIYRKELFFLPLGFALKALVSFSDYQIFQELIKGKEDDSFLRNSVSQMLRIVMEEGCLTQKQVLNYLGECFRVKLNVPDWYPNEQAAEFLFNQCICIHLKSNTEKFYMLCLMTRKLFALAKGECMEDNPDSLVNQEVLTPGQLFLMFLKEKLEGWLVSIKIAFDKKAQKTSVSMNTDNLMRIFTMGIDLTKPFEYLFATGNLRSKTGLGLLQDSGLCVVADKLNFIRYLSHFRCVHRGADFAKMRTTTVRRLLPESWGFLCPVHTPDGEPCGLMNHLTAVCEVVTQFVYTASIPALLCNLGVTPIDGAPHRSYSECYPVLLDGVMVGWVDKDLAPGIADSLRHFKVLREKRIPPWMEVVLIPMTGKPSLYPGLFLFTTPCRLVRPVQNLALGKEELIGTMEQIFMNVAIFEDEVFAGVTTHQELFPHSLLSVIANFIPFSDHNQSPRNMYQCQMGKQTMGFPLLTYQDRSDNKLYRLQTPQSPLVRPSMYDYYDMDNYPIGTNAIVAVISYTGYDMEDAMIVNKASWERGFAHGSVYKSEFIDLSEKIKQGDSSLVFGIKPGDPRVLQKLDDDGLPFIGAKLQYGDPYYSYLNLNTGESFVMYYKSKENCVVDNIKVCSNDTGSGKFKCVCITMRVPRNPTIGDKFASRHGQKGILSRLWPAEDMPFTESGMVPDILFNPHGFPSRMTIGMLIESMAGKSAALHGLCHDATPFIFSEENSALEYFGEMLKAAGYNFYGTERLYSGISGLELEADIFIGVVYYQRLRHMVSDKFQVRTTGARDRVTNQPIGGRNVQGGIRFGEMERDALLAHGTSFLLHDRLFNCSDRSVAHVCVKCGSLLSPLLEKPPPSWSAMRNRKYNCTLCSRSDTIDTVSVPYVFRYFVAELAAMNIKVKLDVV

SEQ ID NO: 839722 - protein, 1243 aa, Homo sapiens; identical to SEQ ID NO: 839721

SEQ ID NO: 839723 - protein, 574 aa, Homo sapiens [sequence omitted]

SEQ ID NO: 839724 - protein, 543 aa, Homo sapiens [sequence omitted]

SEQ ID NO: 839725 - protein, 1187 aa, Homo sapiens
MLNWAGSGFPPAASFASGEMSGAEYGRKGGPATLWLDTALIGPFTRRFWFYVDPEKPKPQGLGRVEREGTTFPSRLRKRDCGHYFAACTERLASGVYRETGVRCAGGHMDPGSRWRNLPSGPSLKHLTDPSYGIPREQQKAALQELTRAHVESFNYAVHEGLGLAVQADINWAVNGISKGIIKQFLGYVPIMVKSKLCNLRNLPPQALIEHHEEAEEMGGYFIINGIEKVIRMLIMPRRNFPIAMIRPKWKTRGPGYTQYGVSMHCVREEHSAVNMNLHYLENGTVMLNFIYRKELFFLPLGFALKALVSFSDYQIFQELIKGKEDDSFLRNSVSQMLRIVMEEGCLTQKQVLNYLGECFRVKLNVPDWYPNEQAAEFLFNQCICIHLKSNTEKFYMLCLMTRKLFALAKGECMEDNPDSLVNQEVLTPGQLFLMFLKEKLEGWLVSIKIAFDKKAQKTSVSMNTDNLMRIFTMGIDLTKPFEYLFATGNLRSKTGLGLLQDSGLCVVADKLNFIRYLSHFRCVHRGADFAKMRTTTVRRLLPESWGFLCPVHTPDGEPCGLMNHLTAVCEVVTQFVYTASIPALLCNLGVTPIDGAPHRSYSECYPVLLDGVMVGWVDKDLAPGIADSLRHFKVLREKRIPPWMEVVLIPMTGKPSLYPGLFLFTTPCRLVRPVQNLALGKEELIGTMEQIFMNVAIFEDEVFAGVTTHQELFPHSLLSVIANFIPFSDHNQSPRNMYQCQMGKQTMGFPLLTYQDRSDNKLYRLQTPQSPLVRPSMYDYYDMDNYPIGTNAIVAVISYTGYDMEDAMIVNKASWERGFAHGSVYKSEFIDLSEKIKQGDSSLVFGIKPGDPRVLQKLDDDGLPFIGAKLQYGDPYYSYLNLNTGESFVMYYKSKENCVVDNIKVCSNDTGSGKFKCVCITMRVPRNPTIGDKFASRHGQKGILSRLWPAEDMPFTESGMVPDILFNPHGFPSRMTIGMLIESMAGKSAALHGLCHDATPFIFSEENSALEYFGEMLKAAGYNFYGTERLYSGISGLELEADIFIGVVYYQRLRHMVSDKFQVRTTGARDRVTNQPIGGRNVQGGIRFGEMERDALLAHGTSFLLHDRLFNCSDRSVAHVCVKCGSLLSPLLEKPPPSWSAMRNRKYNCTLCSRSDTIDTVSVPYVFRYFVAELAAMNIKVKLDVV

SEQ ID NO: 839726 - protein, 1187 aa, Homo sapiens; identical to SEQ ID NO: 839725

SEQ ID NO: 839727 - protein, 1274 aa, Homo sapiens
MLNWAGSGFPPAASFASGEMSGAEYGRKGGPATLWLDTALIGPFTRRFWFYVDPEKPKPQGLGRVEREGTTFPSRLRKRDCGHYFAACTERLASGVYRETGVRCAGGHMDPGSRWRNLPSGPSLKHLTDPSYGIPREQQKAALQELTRAHVESFNYAVHEGLGLAVQRRGLPYVAQPGLKLLSSSSPPLSVSQILGLQAIPPFEFAFKDERISFTILDAVISPPTVPKGTICKEANVYPAECRGRRSTYRGKLTADINWAVNGISKGIIKQFLGYVPIMVKSKLCNLRNLPPQALIEHHEEAEEMGGYFIINGIEKVIRMLIMPRRNFPIAMIRPKWKTRGPGYTQYGVSMHCVREEHSAVNMNLHYLENGTVMLNFIYRKELFFLPLGFALKALVSFSDYQIFQELIKGKEDDSFLRNSVSQMLRIVMEEGCLTQKQVLNYLGECFRVKLNVPDWYPNEQAAEFLFNQCICIHLKSNTEKFYMLCLMTRKLFALAKGECMEDNPDSLVNQEVLTPGQLFLMFLKEKLEGWLVSIKIAFDKKAQKTSVSMNTDNLMRIFTMGIDLTKPFEYLFATGNLRSKTGLGLLQDSGLCVVADKLNFIRYLSHFRCVHRGADFAKMRTTTVRRLLPESWGFLCPVHTPDGEPCGLMNHLTAVCEVVTQFVYTASIPALLCNLGVTPIDGAPHRSYSECYPVLLDGVMVGWVDKDLAPGIADSLRHFKVLREKRIPPWMEVVLIPMTGKPSLYPGLFLFTTPCRLVRPVQNLALGKEELIGTMEQIFMNVAIFEDEVFAGVTTHQELFPHSLLSVIANFIPFSDHNQSPRNMYQCQMGKQTMGFPLLTYQDRSDNKLYRLQTPQSPLVRPSMYDYYDMDNYPIGTNAIVAVISYTGYDMEDAMIVNKASWERGFAHGSVYKSEFIDLSEKIKQGDSSLVFGIKPGDPRVLQKLDDDGLPFIGAKLQYGDPYYSYLNLNTGESFVMYYKSKENCVVDNIKVCSNDTGSGKFKCVCITMRVPRNPTIGDKFASRHGQKGILSRLWPAEDMPFTESGMVPDILFNPHGFPSRMTIGMLIESMAGKSAALHGLCHDATPFIFSEENSALEYFGEMLKAAGYNFYGTERLYSGISGLELEADIFIGVVYYQRLRHMVSDKFQVRTTGARDRVTNQPIGGRNVQGGIRFGEMERDALLAHGTSFLLHDRLFNCSDRSVAHVCVKCGSLLSPLLEKPPPSWSAMRNRKYNCTLCSRSDTIDTVSVPYVFRYFVAELAAMNIKVKLDVV

SEQ ID NO: 839728 - protein, 567 aa, Homo sapiens
MVAAVDTEGDRHVLVSPWQFVPSVITIALCVGSGYARVLSSHVNHLRATRNDADNRAYLSWERGVLPEMSEIFMNVAIFEDEVFAGVTTHQELFPHSLLSVIANFIPFSDHNQSPRNMYQCQMGKQTMGFPLLTYQDRSDNKLYRLQTPQSPLVRPSMYDYYDMDNYPIGTNAIVAVISYTGYDMEDAMIVNKASWERGFAHGSVYKSEFIDLSEKIKQGDSSLVFGIKPGDPRVLQKLDDDGLPFIGAKLQYGDPYYSYLNLNTGESFVMYYKSKENCVVDNIKVCSNDTGSGKFKCVCITMRVPRNPTIGDKFASRHGQKGILSRLWPAEDMPFTESGMVPDILFNPHGFPSRMTIGMLIESMAGKSAALHGLCHDATPFIFSEENSALEYFGEMLKAAGYNFYGTERLYSGISGLELEADIFIGVVYYQRLRHMVSDKFQVRTTGARDRVTNQPIGGRNVQGGIRFGEMERDALLAHGTSFLLHDRLFNCSDRSVAHVCVKCGSLLSPLLEKPPPSWSAMRNRKYNCTLCSRSDTIDTVSVPYVFRYFVAELAAMNIKVKLDVV

SEQ ID NO: 839729 - protein, 145 aa, Homo sapiens
MVSMSFKRNRSDRFYSTRCCGCCHVRTGTIILGTWYMVVNLLMAILLTVEVTHPNSMPAVNIQYEVIGNYYSSERMADNACVLFAVSVLMFIISSMLVYGAISYQVGWLIPFFCYRLFDFVLSCLVAISSLTYLPRIKEYLGSTT

SEQ ID NO: 839730 - protein, 87 aa, Homo sapiens
MAILLTVEVTHPNSMPAVNIQYEVIGNYYSSERMADNACVLFAVSVLMFIISSMLVYGAISYQVGWLIPFFCYRLFDFVLKPIWVRA

SEQ ID NO: 839731 - protein, 145 aa, Homo sapiens; identical to SEQ ID NO: 839729

SEQ ID NO: 839732 - protein, 145 aa, Homo sapiens; identical to SEQ ID NO: 839729

SEQ ID NO: 839733 - protein, 145 aa, Homo sapiens; identical to SEQ ID NO: 839729

SEQ ID NO: 839734 - protein, 145 aa, Homo sapiens; identical to SEQ ID NO: 839729

SEQ ID NO: 839735 - protein, 145 aa, Homo sapiens; identical to SEQ ID NO: 839729

SEQ ID NO: 839736 - protein, 145 aa, Homo sapiens; identical to SEQ ID NO: 839729

SEQ ID NO: 839737 - protein, 198 aa, Homo sapiens
DDLMWCVGTVRLNNMPGLDCLELVRGCDETVMFKSSRRGLGSERPTSYNYLVDLIRCYHWRNRSDRFYSTRCCGCCHVRTGTIILGTWYMVVNLLMAILLTVEVTHPNSMPAVNIQYEVIGNYYSSERMADNACVLFAVSVLMFIISSMLVYGAISYQVGWLIPFFCYRLFDFVLSCLVAISSLTYLPRIKEYLGSTT

SEQ ID NO: 839738 - protein, 145 aa, Homo sapiens; identical to SEQ ID NO: 839729

SEQ ID NO: 839739 - protein, 129 aa, Homo sapiens
MVSMSFKRNRSDRFYSTRCCGCCHVRTGTIILGTWYMVVNLLMAILLTVEVTHPNSMPAVNNNACVLFAVSVLMFIISSMLVYGAISYQVGWLIPFFCYRLFDFVLSCLVAISSLTYLPRIKEYLGSTT

SEQ ID NO: 839740 - protein, 145 aa, Homo sapiens; identical to SEQ ID NO: 839729

SEQ ID NO: 839741 - protein, 145 aa, Homo sapiens; identical to SEQ ID NO: 839729

SEQ ID NO: 839742 - protein, 158 aa, Homo sapiens
MVSMSFKRNRSDRFYSTRCCGCCHVRTGTIILGTWYMVVNLLMAILLTVEVTHPNSMPAVNIQYEVIGNYYSSERMADNACVLFAVSVLMFIISSMLVYGAISYQVGWLIPFFCYRLFDFVLSCLVAISSLTYLPRIKEYLGSTIGLQVPVHWSWVPC

SEQ ID NO: 839743 - protein, 87 aa, Homo sapiens
MVSMSFKRNRSDRFYSTRCCGCCHVRTGTIILGTWYMVVNLLMAILLTVEVTHPNSMPAVNIQYEVIGNYYSSERMAGMCLIEKQKN

SEQ ID NO: 839744 - protein, 106 aa, Homo sapiens
MVSMSFKRNRSDRFYSTRCCGCCHVRTGTIILGTWYMVVNLLMAILLTVEVTHPNSMPAVNRFCNSSSIIFSFVIIGLEMPCFFFLIFFFLFLSPFATFFFEYLFS

SEQ ID NO: 839745 - protein, 145 aa, Homo sapiens; identical to SEQ ID NO: 839729

SEQ ID NO: 839746 - protein, 145 aa, Homo sapiens; identical to SEQ ID NO: 839729

SEQ ID NO: 839747 - protein, 145 aa, Homo sapiens; identical to SEQ ID NO: 839729

SEQ ID NO: 839748 - protein, 103 aa, Homo sapiens
MAILLTVEVTHPNSMPAVNIQYEVIGNYYSSERMADNACVLFAVSVLMFIISSMLVYGAISYQVGWLIPFFCYRLFDFVLSCLVAISSLTYLPRIKEYLGSTT

SEQ ID NO: 839749 - protein, 159 aa, Homo sapiens
LSEQILLVEEQDHRDGAQPSVVPDALEEVQSLLQAVGLVVLPDDHVVAAAGHHEDDGSHIVEALDPLAAFIALATIQYEVIGNYYSSERMADNACVLFAVSVLMFIISSMLVYGAISYQVGWLIPFFCYRLFDFVLSCLVAISSLTYLPRIKEYLGSTT

SEQ ID NO: 839750 - protein, 145 aa, Homo sapiens; identical to SEQ ID NO: 839729

SEQ ID NO: 839751 - protein, 145 aa, Homo sapiens; identical to SEQ ID NO: 839729

SEQ ID NO: 839752 - protein, 159 aa, Homo sapiens
MVSMSFKRNRSDRFYSTRCCGCCHVRTGTIILGTWYMVVNLLMAILLTVEVTHPNSMPAVNIQYEVIGNYYSSERMADNACVLFAVSVLMFIISSMLVYGAISYQVGWLIPFFCYRLFDFVLSCLVAISSLTYLPRIKEYLGSTKIPGFPLQINLGAWL

SEQ ID NO: 839753 - protein, 122 aa, Homo sapiens
MVSMSFKRNRSDRFYSTRCCGCCHVRTGTIILGTWYMVVNLLMAILLTVEVTHPNSMPAVNIQYEVIGNYYSSERMADNACVLFAVSVLMFIISSMLVYGAISLYSSGVGLIPISFWLTGLF

SEQ ID NO: 839754 - protein, 366 aa, Homo sapiens
MTEWETAAPAVGKETPDIKLFGKWSTDDVQINDISLQDYHCSERTNVIAQVTCLHKWQGRVMHGQNSFPGKSLQVGPHLWGAGPSLRPSMDGIAPGRQQTEPRKGSMDLVAGNSVQRHWPFPTGLHYTLASTRAEETPSCKGSLGGKRPIIQSKVGVPPGGRGTSHLAAIVGGGRPRGTRSEDPEPGLGWRNRCSPPTCRPVGGNPGASSLRLGVVVHPGRATLAAGFGPFSRGDTTFQGNPSCRGDENAWAAWGHEELHCLQVHNRPWPQRGVSPFGKTLSLNLPPARHETAQGNRTRLGQGRLSGRPKFPQSQDLVLCSPPGLRLGHPRVTRPLVVFGPPHRRAQTSPALRTSIMTKTQRHQTK

SEQ ID NO: 839755 - protein, 204 aa, Homo sapiens [sequence omitted]

SEQ ID NO: 839756 - protein, 204 aa, Homo sapiens [sequence omitted]

SEQ ID NO: 839757 - protein, 161 aa, Homo sapiens
MPPANQTHNAHTPHTHHLGGRAPPPRRTQLPPKPTLGRPARPPTTTRTPPPNDVPKRNRGQTRRHLPNKTPPEDHAVVTPRKGPRPPRTPHGIHSPLHRARGPRPTSHSPHITRRPPHNRNPPTTHPPDTSTLTTPTPTQHQQHHPPHPHPPPTPPHTPQP

SEQ ID NO: 839758 - protein, 94 aa, Homo sapiens
TDDVQINGAPLPKELACLGSLPPLVLLSNDISLHSVIKLFGKWSTDDVQINDISLQDYIAVKEKYAKYLPHSAGRYAARERFRKAQCPIVGAPH

SEQ ID NO: 839759 - protein, 91 aa, Homo sapiens
RTNIKARYEAGCYRMTEWETAAPAVGKETPDPDIKLFGKWSTDDVQINDISLQDYIAVKEKYAKYLPHSAGRYAARERFRKAQCPIVGAPH

SEQ ID NO: 839760 - protein, 102 aa, Homo sapiens
MMHGRNNGQRSFMDCAHRSKHAFSEDSLHLAFTGRRTLLAGSLGERPSFNSWFPRGGLPTAHLGRAGTVRRQGCGMCPPCARVNPRPSGCCTYARKDRDPLD

SEQ ID NO: 839761 - protein, 118 aa, Homo sapiens
SAQTSRLGTRLGVSGSASLTSMMMHGRNNGQRSFMDCAHRSKHAFSEDSLHLAFTGRRTLLAGSLGERPSFNSWFPRGGLPTAHLGRAGTVRRQGCGMCPPCARVNPRPSGCLCTGRS

SEQ ID NO: 839762 - protein, 47 aa, Homo sapiens
MTQPEDKKKSKHEERDTTETNTSTRQRSKCSDKKANTKETQAGNEHE

SEQ ID NO: 839763 - protein, 106 aa, Homo sapiens
MTEWETAAPAVGKETPDPDIKLFGKWSTDDVQINDISLQDYIAVKEKYAKYLPQWERLTNFHDDARPQQRAKKLHGLCASFKACLFGRFITPCFHRAKNPSCKVPG

SEQ ID NO: 839764 - protein, 91 aa, Homo sapiens
MTEWETAAPAVGKETPDPDIKLFGKWSTDDVQINDISLQDYIAVKEKYAKYLPHAKCFRKAQWGFVPRLKKRPMMRFAAPKISSRLSDEYS

SEQ ID NO: 839765 - protein, 95 aa, Homo sapiens
NNLTARYRGLGVRRSGCVLRMTEWETAAPAVGKETPDIKLFGKWSTDDVQINDISLQDYIAVKEKYAKYLPHSAGRYAARERFRKAQCPIVGAPH

SEQ ID NO: 839766 - protein, 140 aa, Homo sapiens
PTTTTTKFAAASTRGLHCSEGEVCQVPASQCRAVCRQKTLPQSSVSHCGSASLTSMMMHGRNNGQRSFMDCAHRSKHAFSEDSLHLAFTGRRTLLAGSLGERPSFNSGPRGDTSTACRLTVPAGTMRVESSRGSTRPEIK

SEQ ID NO: 839767 - protein, 109 aa, Homo sapiens
MLHGTTTLAFKFRHGVIVAADSRATAGAYIASQTVKKVIEINPYLLGTMAGAADCSSGERCARIVESMSFEIGTHLCSSCLQTACNIVYQYKAWACHGTMIAGIRKACL

SEQ ID NO: 839768 - protein, 113 aa, Homo sapiens
GYLRAPPRDGSRCSRRRNPGPSCRRSPLFHGRDYCKHRMTEWETAAPAVGKETPDIKLFGKWSTDDVQINDISLQDYIAVKEKYAKYLPHSAGRYAARKRFRKAQCPIVGAPH

SEQ ID NO: 839769 - protein, 174 aa, Homo sapiens
TDDVQINGAPLPKELACLGSLPPLVLLSNDISLPLVGLHCSEGEVCQVPASQCRAVCRQKTLPQSSVSHCGSASLTSMMMHGRNNGQRSFMDCAHRSKHAFSEDSLHLAFTGRRTLLARSLGERPSFNSWFPRGGLPTAHLGRAGTVRRQGCGMCPPCARVNPRPSGCLCTGRS

SEQ ID NO: 839770 - protein, 105 aa, Homo sapiens
MMHGRNNGQRSFMDCAHRSKHAFSEDSLHLAFTGRRTLLAGSLGERPSFNSWFPRGGLPTAHLGRAGTVRRQGCGMCPPCARVNPRPSGSLCTGAREDAQTRRVL

SEQ ID NO: 839771 - protein, 79 aa, Homo sapiens
ERERERERERERERERETGKEASWTVRIVQSMPFRKIHYTLLSQGEEPFLQGPWVNAHHSTVGSPGEDFPQRIWGAPGL

SEQ ID NO: 839772 - protein, 122 aa, Homo sapiens
MTEWETAAPAVGKETPDIKLFGKWSTDDVQINDISLQDYIAVKEKYAKYLQGNVIDQQHQRCPDIKLFGKWSTDDVQINDISLQDYIAVKEKYAKYLPHSAGRYAARERFRKAQCPIVGAPH

SEQ ID NO: 839773 - protein, 112 aa, Homo sapiens
MTTTSVMRGLLHQKEHHISHMVFLLLFLAHTPYHPASLLLHVTTLLFQYPFPHRGPLSPYIDTASGPLAIPPPGLALLSHLLSPLSSCPHPPRRLSSLPPPLPLLSPRPVLL

SEQ ID NO: 839774 - protein, 204 aa, Homo sapiens [sequence omitted]

SEQ ID NO: 839775 - protein, 204 aa, Homo sapiens [sequence omitted]

SEQ ID NO: 839776 - protein, 1488 aa, Homo sapiens
RVGSAHPARGLAQAVVRVLSRSCHHSSCCCLYRCGYRGGAEIAERDARGRCERGGLSSPRLVSERAYWEALWSGKTVPLLRQDPDWAGDCPKGFLVIMAVEGSTITSRIKNLLRSPSIKLRRSKAGNRREDLSSKVTLEKVLGITVSGGRGLACDPRSGLVAYPAGCVVVLFNPRKHKQHHILNSSRKTITALAFSPDGKYLVTGESGHMPAVRVWDVAEHSQVAELQEHKYGVACVAFSPSAKYIVSVGYQHDMIVNVWAWKKNIVVASNKVSSRVTAVSFSEDCSYFVTAGNRHIKFWYLDDSKTSKVNATVPLLGRSGLLGELRNNLFTDVACGRGKKADSTFCITSSGLLCEFSDRRLLDKWVELRVYPEVKDSNQACLPPSSFITCSSDNTIRLWNTESSGVHGSTLHRNILSSDLIKIIYVDGNTQALLDTELPGGDKADASLLDPRVGIRSVCVSPNGQHLASGDRMGTLRVHELQSLSEMLKVEAHDSEILCLEYSKPDTGLKLLASASRDRLIHVLDAGREYSLQQTLDEHSSSITAVKFAASDGQVRMISCGADKSIYFRTAQKSGDGVQFTRTHHVVRKTTLYDMDVEPSWKYTAIGCQDRNIRIFNISSGKQKKLFKGSQGEDGTLIKVQTDPSGIYIATSCSDKNLSIFDFSSGECVATMFGHSEIVTGMKFSNDCKHLISVSGDSCIFVWRLSSEMTISMRQRLAELRQRQRGGKQQGPSSPQRASGPNRHQAPSMLSPGPALSSDSDKEGEDEGTEEELPALPVLAKSTKKALASVPSPALPRSLSHWEMSRAQESVGFLDPAPAANPGPRRRGRWVQPGVELSVRSMLDLRQLETLAPSLQDPSQDSLAIIPSGPRKHGQEALETSLTSQNEKPPRPQASQPCSYPHIIRLLSQEEGVFAQDLEPAPIEDGIVYPEPSDNPTMDTSEFQVQAPARGTLGRVYPGSRSSEKHSPDSACSVDYSSSCLSSPEHPTEDSESTEPLSVDGISSDLEEPAEGDEEEEEEEGGMGPYGLQEGSPQTPDQEQFLKQHFETLASGAAPGAPVQVPERSESRSISSRFLLQVQTRPLREPSPSSSSLALMSRPAQVPQASGEQPRGNGANPPGAPPEVEPSSGNPSPQQAASVLLPRCRLNPDSSWAPKRVATASPFSGLQKAQSVHSLVPQERHEASLQAPSPGALLSREIEAQDGLGSLPPADGRPSRPHSYQNPTTSSMAKISRSISVGENLGLVAEPQAHAPIRVSPLSKLALPSRAHLVLDIPKPLPDRPTLAAFSPVTKGRAPGEAEKPGFPVGLGKAHSTTERWACLGEGTTPKPRTECQAHPGPSSPCAQQLPVSSLFQGPENLQPPPPEKTPNPMECTKPGAALSQDSEPAVSLEQCEQLVAELRGSVRQAVRLYHSVAGCKMPSAEQSRIAQLLRDTFSSVRQELEAVAGAVLSSPGSSPGAVGAEQTQALLEQYSELLLRAVERRMERKL

SEQ ID NO: 839777 - protein, 1488 aa, Homo sapiens; identical to SEQ ID NO: 839776

SEQ ID NO: 839778 - protein, 646 aa, Homo sapiens [sequence omitted]

SEQ ID NO: 839779 - protein, 312 aa, Homo sapiens
RVGSAHPARGLAQAVVRVLSRSCHHSSCCCLYRCGYRGGAEIAERDARGRCERGGLSSPRLVSERAYWEALWSGKTVPLLRQDPDWAGDCPKGFLVIMAVEGSTITSRIKNLLRSPSIKLRRSKAGNRREDLSSKVTLEKVLGITVSGGRGLACDPRSGLVAYPAGCVVVLFNPRKHKQHHILNSSRKTITALAFSPDGKYLVTGESGHMPAVRVWDVAEHSQVAELQEHKYGVACVAFSPSAKYIVSVGYQHDMIVNVWAWKKNIVVASNKVSSRVTAVSFSEDCSYFVTAGNRHIKFWYLDDSKTSKVRC

SEQ ID NO: 839780 - protein, 93 aa, Homo sapiens
QESVGFLDPAPAANPGPRRRGRWVQPGVELSVRSMLDLRQLETLAPSLQDPSQDSLAIIPSGPRKHGQEALETSLTSQVSLLSPSSLESSKGP

SEQ ID NO: 839781 - protein, 120 aa, Homo sapiens
TVWLYPSCIFVWRLSSEMTISMRQRLAELRQRQRGGKQQGPSSPQRASGPNRHQAPSMLSPGPALSSDSDKEGEDEGTEEELPALPVLAKSTKKALASVPSPALPRSLSHWEMSRVSRHC

SEQ ID NO: 839782 - protein, 1001 aa, Homo sapiens
MLKVEAHDSEILCLEYSKPDTGLKLLASASRDRLIHVLDAGREYSLQQTLDEHSSSITAVKFAASDGQVRMISCGADKSIYFRTAQKSGDGVQFTRTHHVVRKTTLYDMDVEPSWKYTAIGCQDRNIRIFNISSGKQKKLFKGSQGEDGTLIKVQTDPSGIYIATSCSDKNLSIFDFSSGECVATMFGHSEIVTGMKFSNDCKHLISVSGDSCIFVWRLSSEMTISMRQRLAELRQRQRGGKQQGPSSPQRASGPNRHQAPSMLSPGPALSSDSDKEGEDEGTEEELPALPVLAKSTKKALASVPSPALPRSLSHWEMSRAQESVGFLDPAPAANPGPRRRGRWVQPGVELSVRSMLDLRQLETLAPSLQDPSQDSLAIIPSGPRKHGQEALETSLTSQNEKPPRPQASQPCSYPHIIRLLSQEEGVFAQDLEPAPIEDGIVYPEPSDNPTMDTSEFQVQAPARGTLGRVYPGSRSSEKHSPDSACSVDYSSSCLSSPEHPTEDSESTEPLSVDGISSDLEEPAEGDEEEEEEEGGMGPYGLQEGSPQTPDQEQFLKQHFETLASGAAPGAPVQVPERSESRSISSRFLLQVQTRPLREPSPSSSSLALMSRPAQVPQASGEQPRGNGANPPGAPPEVEPSSGNPSPQQAASVLLPRCRLNPDSSWAPKRVATASPFSGLQKAQSVHSLVPQERHEASLQAPSPGALLSREIEAQDGLGSLPPADGRPSRPHSYQNPTTSSMAKISRSISVGENLGLVAEPQAHAPIRVSPLSKLALPSRAHLVLDIPKPLPDRPTLAAFSPVTKGRAPGEAEKPGFPVGLGKAHSTTERWACLGEGTTPKPRTECQAHPGPSSPCAQQLPVSSLFQGPENLQPPPPEKTPNPMECTKPGAALSQDSEPAVSLEQCEQLVAELRGSVRQAVRLYHSVAGCKMPSAEQSRIAQLLRDTFSSVRQELEAVAGAVLSSPGSSPGAVGAEQTQALLEQYSELLLRAVERRMERKL

SEQ ID NO: 839783 - protein, 1488 aa, Homo sapiens; identical to SEQ ID NO: 839776

SEQ ID NO: 839784 - protein, 123 aa, Homo sapiens
RVGSAHPARGLAQAVVRVLSRSCHHSSCCCLYRCGYRGGAEIAERDARGRCERGGLSSPRLVSERAYWEALWSGKTVPLLRQDPGLGRGLSQRVSRHNGCGRVNHYQPDQESVEISIHQTAQE

SEQ ID NO: 839785 - protein, 244 aa, Homo sapiens
MESETEPEPVTLLVKSPNQRHRDLELSGDRGWSVGHLKAHLSRVYPERPRPEDQRLIYSGKLLLDHQCLRDLLPKQEKRHVLHLVCNVKSPSKMPEINAKVAESTEEPAGSNRGQYPEDSSSDGLRQREVLRNLSSPGWENISRPEAAQQAFQGLGPGFSGYTPYGWLQLSWFQQIYARQYYMQYLAATAASGAFVPPPSAQEIPVVSAPAPAPIHNQFPAENQPANQNAAPQVVVNPGAIKLR

SEQ ID NO: 839786 - protein, 416 aa, Homo sapiens
MNDPAETTPKHTTTYTPQNKTHTPQSTKKKGGNPQENPQGGTTQKKKKRLSQTEAHKRRNNTANDGRLHNKSRENRQDTSKTKPERAHANHPRQRPRHQQLKLHSQTRKLRKSNKPEEKRRKTQHRSERGHNRRRENKETDKKRKGTEQKGTAARTTALTGSKKESKRRERLRRIATEQTSAAQQRPQQPTDEHTERSKRERRTRERPAKRDRTRAETRHTTPEREARAAGEQTSRTRRDQDSHTSRREDSRRQRQTATERSTDEESRAAERVEQRESKGRGHTKTNQKRHARDRAQRAQRREEKRNGRRAERVIESHERYSRGKRTDTVWVCEVISDGNREQCHHKGGSESDRGVKKEGESRIAEEERGGYERVDGGEELRRNRVRERGEIRSEESDEQRDKRRSLETDGRAMKG

SEQ ID NO: 839787 - protein, 183 aa, Homo sapiens
TGSTEKPGFSTHGSFACLRTKAPSRPEAAQQAFQGLGPGFSGYTPYGWLQLSWFQQIYARQYYMQYLAATAASGAFVPPPSAQEIPVVSAPAPAPIHNQFPAENQPANQNAAPQVVVNPGANQNLRMNAQGGPIVEEDDEINRDWLDWTYSAATFSVFLSILYFYSSLSRFLMVMGATVVMYL

SEQ ID NO: 839788 - protein, 391 aa, Homo sapiens
MESETEPEPVTLLVKSPNQRHRDLELSGDRGWSVGHLKAHLSRVYPERPRPEDQRLIYSGKLLLDHQCLRDLLPKQEKRHVLHLVCNVKSPSKMPEINAKVAESTEEPAGSNRGQYPEDSSSDGLRQREVLRNLSSPGWENISRPEAAQQAFQGLGPGFSGYTPYGWLQLSWFQQIYARQYYMQYLAATAASGAFVPPPSAQEIPVVSAPAPAPIHNQFPAENQPANQNAAPQVVVNPGANQNLRMNAQGGPIVEEDDEINRDWLDWTYSAATFSVFLSILYFYSSLSRFLMVMGATVVMYLHHVGWFPFRPRPVQNFPNDGPPPDVVNQDPNNNLQEGTDPETEDPNHLPPDRDVLDGEQTSPSFMSTAWLVFKTFFASLLPEGPPAIAN

SEQ ID NO: 839789 - protein, 351 aa, Homo sapiens
MGGSHRAFCPQSQARGFYKRRPKRGRGPQRRELSLQRLRAAETPPAWHLGAQRSPDTAAAAMESETEPEPVTLLVKSPNQRHRDLELSGDRGWSVGHLKAHLSRVYPERPRPEDQRLIYSGKLLLDHQCLRDLLPKQEKRHVLHLVCNVKSPSKMPEINAKVAESTEEPAGSNRGQYPEDSSSDGLRQREVLRNLSSPGWENISRPEAAQQAFQGLGPGFSGYTPYGWLQLSWFQQIYARQYYMQYLAATAASGAFVPPPSAQEIPVVSAPAPAPIHNQFPAENQPANQNAAPQVVVNPGAKSRLVGLDLFSSYIFCFSQYPLLLLLPEQIPHGHGGHRCYVPASRWVVSI

SEQ ID NO: 839790 - protein, 104 aa, Homo sapiens
MGLLRKCFPVMLGGNTHIQITCIKQFILCLGTCRGEMLTCVTLSFHDQRPEDQRLIYSGKLLLDHQCLRDLLPKQEKRHVLHLVCNVKSPSKMPEINAKVSASS

SEQ ID NO: 839791 - protein, 427 aa, Homo sapiens
MGGSHRAFCPQSQARGFYKRRPKRGRGPQRRELSLQRLRAAETPPAWHLGAQRSPDTAAAAMESETEPEPVTLLVKSPNQRHRDLELSGDRGWSVGHLKAHLSRVYPERPRPEDQRLIYSGKLLLDHQCLRDLLPKVAESTEEPAGSNRGQYPEDSSSDGLRQREVLRNLSSPGWENISRPEAAQQAFQGLGPGFSGYTPYGWLQLSWFQQIYARQYYMQYLAATAASGAFVPPPSAQEIPVVSAPAPAPIHNQFPAENQPANQNAAPQVVVNPGANQNLRMNAQGGPIVEEDDEINRDWLDWTYSAATFSVFLSILYFYSSLSRFLMVMGATVVMYLHHVGWFPFRPRPVQNFPNDGPPPDVVNQDPNNNLQEGTDPETEDPNHLPPDRDVLDGEQTSPSFMSTAWLVFKTFFASLLPEGPPAIAN

SEQ ID NO: 839792 - protein, 250 aa, Homo sapiens [sequence omitted]

SEQ ID NO: 839793 - protein, 272 aa, Homo sapiens
TGSTEKPGFSTHGSFACLRTKAPSRPEAAQQAFQGLGPGFSGYTPYGWLQLSWFQQIYARQYYMQYLAATAASGAFVPPPSAQEIPVVSAPAPAPIHNQFPAENQPANQNAAPQVVVNPGANQNLRMNAQGGPIVEEDDEINRDWLDWTYSAATFSVFLSILYFYSSLSRFLMVMGATVVMYLHHVGWFPFRPRPVQNFPNDGPPPDVVNQDPNNNLQEGTDPETEDPNHLPPDRDVLDGEQTSPSFMSTAWLVFKTFFASLLPEGPPAIAN

SEQ ID NO: 839794 - protein, 245 aa, Homo sapiens
GCGRSRVSPWSVFSGYTPYGWLQLSWFQQIYARQYYMQYLAATAASGAFVPPPSAQEIPVVSAPAPAPIHNQFPAENQPANQNAAPQVVVNPGANQNLRMNAQGGPIVEEDDEINRDWLDWTYSAATFSVFLSILYFYSSLSRFLMVMGATVVMYLHHVGWFPFRPRPVQNFPNDGPPPDVVNQDPNNNLQEGTDPETEDPNHLPPDRDVLDGEQTSPSFMSTAWLVFKTFFASLLPEGPPAIAN

SEQ ID NO: 839795 - protein, 358 aa, Homo sapiens
MGGSHRAFCPQSQARGFYKRRPKRGRGPQRRELSLQRLRAAETPPAWHLGAQRSPDTAAAAMESETEPEPVTLLVKSPNQRHRDLELSGDRGWSVGHLKAHLSRVYPERPRPEDQRLIYSGKLLLDHQCLRDLLPKQEKRHVLHLVCNVKSPSKMPEINAKVAESTEEPAGSNRGQYPEDSSSDGLRQREVLRNLSSPGWENISRPEAAQQAFQGLGPGFSGYTPYGWLQLSWFQQIYARQYYMQYILYFYSSLSRFLMVMGATVVMYLHHVGWFPFRPRPVQNFPNDGPPPDVVNQDPNNNLQEGTDPETEDPNHLPPDRDVLDGEQTSPSFMSTAWLVFKTFFASLLPEGPPAIAN

SEQ ID NO: 839796 - protein, 149 aa, Homo sapiens
MGGSHRAFCPQSQARGFYKRRPKRGRGPQRRELSLQRLRAAETPPAWHLGAQRSPDTAAAAMESETEPEPVTLLVKSPNQRHRDLELSGDRGWSVGHLKAHLSRVYPERPRPEDQRLIYSGKLLLDHQCLRDLLPKAGELLELGRQRLQ

SEQ ID NO: 839797 - protein, 413 aa, Homo sapiens
MGGSHRAFCPQSQARGFYKRRPKRGRGPQRRELSLQRLRAAETPPAWHLGAQRSPDTAAAAMESETEPEPVTLLVKSPNQRHRDLELSGDRGWSVGHLKAHLSRVYPERPRPEDQRLIYSGKLLLDHQCLRDLLPKQEKRHVLHLVCNVKSPSKMPEINAKVAESTEEPAGSNRGQYPEDSSSDGLRQREVLRNLSSPGWENISRPEAAQQAFQGLGPGFSGYTPYGWLQLSWFQQIYARQYYMQYLAATAASGAFVPPPSAQEIPVVSAPAPAPIHNQFPAENQPANQNAAPQVVVNPGANQNLRMNAQGGPIVEEDDEINRDWLDWTYSAATFSVFLSILYFYSSLSRFLMVMGATVVMYLHHVGWFPFRPRPVQNFPNDGPPPDVVNQDPNNNLQAQDGSARIWLGGISL

SEQ ID NO: 839798 - protein, 340 aa, Homo sapiens
MGGSHRAFCPQSQARGFYKRRPKRGRGPQRRELSLQRLRAAETPPAWHLGAQRSPDTAAAAMESETEPEPVTLLVKSPNQRHRDLELSGDRGWSVGHLKAHLSRVYPERPRPEDQRLIYSGKLLLDHQCLRDLLPKQEKRHVLHLVCNVKSPSKMPEINAKVAESTEEPAGSNRGQYPEDSSSDGLRQREVLRNLSSPGWENISRPEAAQQAFQGLGPGFSGYTPYGWLQLSWFQQIYARQYYMQYLAATAASGAFVPPPSAQEIPVVSAPAPAPIHNQFPAENQPANQNAAPQVVVNPGANQNLRMNAQGGPIVEEDDEIIRDAGSAPRSYDNTNIDDT

SEQ ID NO: 839799 - protein, 338 aa, Homo sapiens
MGGSHRAFCPQSQARGFYKRRPKRGRGPQRRELSLQRLRAAETPPAWHLGAQRSPDTAAAAMESETEPEPVTLLVKSPNQRHRDLELSGDRGWSVGHLKAHLSRVYPERPRPEDQRLIYSGKLLLDHQCLRDLLPKQEKRHVLHLVCNVKSPSKMPEINAKVAESTEEPAGSNRGQYPEDSSSDGLRQREVLRNLSSPGWENISRPEAAQQAFQGLGPGFSGYTPYGWLQLSWFQQIYARQYYMQYLAATAASGAFVPPPSAQEIPVVSAPAPAPIHNQFPAENQPANQNAAPQVVVNPGATKFGVMPRGHLAKGAKPQVGELPDYWGTVHNPERPMA

SEQ ID NO: 839800 - protein, 180 aa, Homo sapiens
MGGSHRAFCPQSQARGFYKRRPKRGRGPQRRELSLQRLRAAETPPAWHLGAQRSPDTAAAAMESETEPEPVTLLVKSPNQRHRDLELSGDRGWSVGHLKAHLSRVYPERPRPEDQRLIYSGKLLLDHQCLRDLLPKQEKRHVLHLVCNVKSPSKMPEINAKMQKWFCWYDLIPVGMFKLH

SEQ ID NO: 839801 - protein, 241 aa, Homo sapiens
PPELGASQVSDQAPRAACSAPKHGHRTRVPGAQPRLWVTQTRRVASARAHVLGPPSATRIRTPIGPRWESASASANGRQPQSVLSAEPARGFYKRRPKRGRGPQRRELSLQRLRAAETPPAWHLGAQRSPDTAAAAMESETEPEPVTLLVKSPNQRHRDLELSGDRGWSVGHLKAHLSRVYPERPRPEDQRLIYSGKLLLDHQCLRDLLPKQEKRHVLHLVCNVKSPSKMPEINAKVSASS

SEQ ID NO: 839802 - protein, 317 aa, Homo sapiens
TNRLRSRAVCELSLQRLRAAETPPAWHLGAQRSPDTAAAAMESETEPEPVTLLVKSPNQRHRDLELSGDRGWSVGHLKAHLSRVYPERPRPEDQRLIYSGKLLLDHQCLRDLLPKQEKRHVLHLVCNVKSPSKMPEINAKVAESTEEPAGSNRGQYPEDSSSDGLRQREVLRNLSSPGWENISRPEAAQQAFQGLGPGFSGYTPYGWLQLSWFQQIYARQYYMQYLAATAASGAFVPPPSAQEIPVVSAPAPAPIHNQFPAENQPANQNAAPQVVVNPGATKFGVMPRGHLAKGAKPQVGELPDYWGTVHNPERPMA

SEQ ID NO: 839803 - protein, 161 aa, Homo sapiens
MYRPEAAQQAFQGLGPGFSGYTPYGWLQLSWFQQIYARQYYMQYLAATAASGAFVPPPSAQEIPVVSAPAPAPIHNQFPAENQPANQNAAPQVVVNPGANQNLRMNAQGGPIVEEDDEINRDWLDWTYSAATFSVFLSILYFYSSLSRFLMVMGATVVMYL

SEQ ID NO: 839804 - protein, 452 aa, Homo sapiens
MGGSHRAFCPQSQARGFYKRRPKRGRGPQRRELSLQRLRAAETPPAWHLGAQRSPDTAAAAMESETEPEPVTLLVKSPNQRHRDLELSGDRGWSVGHLKAHLSRVYPERPRPEDQRLIYSGKLLLDHQCLRDLLPKQEKRHVLHLVCNVKSPSKMPEINAKVAESTEEPAGSNRGQYPEDSSSDGLRQREVLRNLSSPGWENISRPEAAQQAFQGLGPGFSGYTPYGWLQLSWFQQIYARQYYMQYLAATAASGAFVPPPSAQEIPVVSAPAPAPIHNQFPAENQPANQNAAPQVVVNPGANQNLRMNAQGGPIVEEDDEINRDWLDWTYSAATFSVFLSILYFYSSLSRFLMVMGATVVMYLHHVGWFPFRPRPVQNFPNDGPPPDVVNQDPNNNLQEGTDPETEDPNHLPPDRDVLDGEQTSPSFMSTAWLVFKTFFASLLPEGPPAIAN

SEQ ID NO: 839805 - protein, 241 aa, Homo sapiens; identical to SEQ ID NO: 839801

SEQ ID NO: 839806 - protein, 298 aa, Homo sapiens
MPEINAKVAESTEEPAGSNRGQYPEDSSSDGLRQREVLRNLSSPGWENISRPEAAQQAFQGLGPGFSGYTPYGWLQLSWFQQIYARQYYMQYLAATAASGAFVPPPSAQEIPVVSAPAPAPIHNQFPAENQPANQNAAPQVVVNPGANQNLRMNAQGGPIVEEDDEINRDWLDWTYSAATFSVFLSILYFYSSLSRFLMVMGATVVMYLHHVGWFPFRPRPVQNFPNDGPPPDVVNQDPNNNLQEGTDPETEDPNHLPPDRDVLDGEQTSPSFMSTAWLVFKTFFASLLPEGPPAIAN

SEQ ID NO: 839807 - protein, 411 aa, Homo sapiens
MGGSHRAFCPQSQARGFYKRRPKRGRGPQRRELSLQRLRAAETPPAWHLGAQRSPDTAAAAMESETEPEPVTLLVKSPNQRHRDLELSGDRGWSVGHLKAHLSRVYPERPRPEDQRLIYSGKLLLDHQCLRDLLPKQEKRHVLHLVCNVKSPSKMPEINAKVAESTEEPAGSNRGQYPEDSSSDGLRQREVLRNLSSPGWENISSLAATAASGAFVPPPSAQEIPVVSAPAPAPIHNQFPAENQPANQNAAPQVVVNPGANQNLRMNAQGGPIVEEDDEINRDWLDWTYSAATFSVFLSILYFYSSLSRFLMVMGATVVMYLHHVGWFPFRPRPVQNFPNDGPPPDVVNQDPNNNLQEGTDPETEDPNHLPPDRDVLDGEQTSPSFMSTAWLVFKTFFASLLPEGPPAIAN

SEQ ID NO: 839808 - protein, 256 aa, Homo sapiens
PTLEDPRTRPEAAQQAFQGLGPGFSGYTPYGWLQLSWFQQIYARQYYMQYLAATAASGAFVPPPSAQEIPVVSAPAPAPIHNQFPAENQPANQNAAPQVVVNPGANQNLRMNAQGGPIVEEDDEINRDWLDWTYSAATFSVFLSILYFYSSLSRFLMVMGATVVMYLHHVGWFPFRPRPVQNFPNDGPPPDVVNQDPNNNLQEGTDPETEDPNHLPPDRDVLDGEQTSPSFMSTAWLVFKTFFASLLPEGPPAIAN

SEQ ID NO: 839809 - protein, 209 aa, Homo sapiens
MQYLAATAASGAFVPPPSAQEIPVVSAPAPAPIHNQFPAENQPANQNAAPQVVVNPGANQNLRMNAQGGPIVEEDDEINRDWLDWTYSAATFSVFLSILYFYSSLSRFLMVMGATVVMYLHHVGWFPFRPRPVQNFPNDGPPPDVVNQDPNNNLQEGTDPETEDPNHLPPDRDVLDGEQTSPSFMSTAWLVFKTFFASLLPEGPPAIAN

SEQ ID NO: 839810 - protein, 274 aa, Homo sapiens
MGGSHRAFCPQSQARGFYKRRPKRGRGPQRRELSLQRLRAAETPPAWHLGAQRSPDTAAAAMESETEPEPVTLLVKSPNQRHRDLELSGDRGWSVGHLKAHLSRVYPERPRPEDQRLIYSGKLLLDHQCLRDLLPKQEKRHVLHLVCNVKSPSKMPEINAKVAESTEEPAGSNRGQYPEDSSSDGLRQREVLRNLSSPGWENISRPEAAQQAFQGLGPGFSGYTPYGWLQLSWFQQIYARQYYMQYLAATAASGAFVPPPSAQEIPASRWVVSI

SEQ ID NO: 839811 - protein, 294 aa, Homo sapiens
MGGSHRAFCPQSQARGFYKRRPKRGRGPQRRELSLQRLRAAETPPAWHLGAQRSPDTAAAAMESETEPEPVTLLVKSPNQRHRDLELSGDRGWSVGHLKAHLSRVYPERPRPEDQRLIYSGKLLLDHQCLRDLLPKQEKRHVLHLVCNVKSPSKMPEINAKVAESTEEPAGSNRGQYPEDSSSDGLRQREVLRNLSSPGWENISRHHVGWFPFRPRPVQNFPNDGPPPDVVNQDPNNNLQEGTDPETEDPNHLPPDRDVLDGEQTSPSFMSTAWLVFKTFFASLLPEGPPAIAN

SEQ ID NO: 839812 - protein, 99 aa, Homo sapiens
NGEPPNVMQVHNNGGPPFRPRPVQNFPNDGPPPDVVNQDPNNNLQEGTDPETEDPNHLPPDRDVLDGEQTSPSFMSTAWLVFKTFFASLLPEGPPAIAN

SEQ ID NO: 839813 - protein, 399 aa, Homo sapiens
MGGSHRAFCPQSQARGFYKRRPKRGRGPQRRELSLQRLRAAETPPAWHLGAQRSPDTAAAAMESETEPEPVTLLVKSPNQRHRDLELSGDRGWSVGHLKAHLSRVYPERPRPEDQRLIYSGKLLLDHQCLRDLLPKQEKRHVLHLVCNVKSPSKMPEINAKVAESTEEPAGSNRGQYPEDSSSDGLRQREVLRNLSSPGWENISSLAATAASGAFVPPPSAQEIPVVSAPAPAPIHNQFPAENQPANQNAAPQVVVNPGANQNLRMNAQGGPIVEEDDEINRDWLDWTYSAATFSVFLSILYFYSSLSRFLMVMGATVVMYLHHVGWFPFRPRPVQNFPNDGPPPDVVNQDPNNNLQKAPQPSQTDGVCAVAVGGFDRNGLDHLTPARLPLLDMAMMSF

SEQ ID NO: 839814 - protein, 305 aa, Homo sapiens
MGGSHRAFCPQSQARGFYKRRPKRGRGPQRRELSLQRLRAAETPPAWHLGAQRSPDTAAAAMESETEPEPVTLLVKSPNQRHRDLELSGDRGWSVGHLKAHLSRVYPERPRPEDQRLIYSGKLLLDHQCLRDLLPKQEKRHVLHLVCNVKSPSKMPEINAKVAESTEEPAGSNRGQYPEDSSSDGLRQREVLRNLSSPGWENISRPEAAQQAFQGLGPGFSGYTPYGWLQLSWFQQIYARQYYMQYLAATAASGAFVPPPSAQEIPVVSAPAPAPIHNQFPAENQPANQNAAPQVVVNPGAIKLR

SEQ ID NO: 839815 - protein, 205 aa, Homo sapiens
MGGSHRAFCPQSQARGFYKRRPKRGRGPQRRELSLQRLRAAETPPAWHLGAQRSPDTAAAAMESETEPEPVTLLVKSPNQRHRDLELSGDRGWSVGHLKAHLSRVYPERPRPEDQRLIYSGKLLLDHQCLRDLLPKQEKRHVLHLVCNVKSPSKMPEINAKVAESTEEPAGSNRGQYPEDSSSDGLRQREVLRNLSSPGWENISR

SEQ ID NO: 839816 - protein, 773 aa, Homo sapiens
MARSSSLGRECGTPRSGLGKGGPPRPQGPQARCTLGRRCTVSGKCRRPRPSWTMAPPRNVVKIAIKMRDAIPQLIQLDQAKPLAAVLKEVCDAWSLTHSERYALQFADGHRRYITENNRAEIKNGSILCLSTAPDLEAEQLLGGLQSNSPEGRREALRRLVPLASDMIFAREVISRNGLQILGTIIEDGDDLGEVLALSLRAFSELMEHGVVSWETLSIPFVRKVVCYVNMNLMDASVPPLALGLLESVTLSSPALGQLVKSEVPLDRLLVHLQVMNQQLQTKAMALLTALLQGASPVERKHMLDYLWQRNLRQFIYKNIIHSAAPMGDEMAHHLYVLQALMLGLLEPRMRTPLDPYSQEQREQLQVLRQAAFEVEGESSGAGLSADRRRSLCAREFRKLGFSNSNPAQDLERVPPGLLALDNMLYFSRNAPSAYSRFVLENSSREDKHECPFARGSIQLTVLLCELLRVGEPCSETAQDFSPMFFGQDQSFHELFCVGIQLLNKTWKEMRATQEDFDKVMQVVREQLARTLALKPTSLELFRTKVNALTYGEVLRLRQTERLHQEGTLAPPILELREKLKPELMGLIRQQRLLRLCEGTLFRKISSRRRQDKLWFCCLSPNHKLLQYGDMEEGASPPTLESLPEQLPVADMRALLTGKDCPHVREKGSGKQNKDLYELAFSISYDRGEEEAYLNFIAPSKREFYLWTDGLSALLGSPMGSEQTRLDLEQLLTMETKLRLLELENVPIPERPPPVPPPPTNFNFCYDCSIAEP

SEQ ID NO: 839817 - protein, 471 aa, Homo sapiens
MLDYLWQRNLRQFIYKNIIHSAAPMGDEMAHHLYVLQALMLGLLEPRMRTPLDPYSQEQREQLQVLRQAAFEVEGESSGAGLSADRRRSLCAREFRKLGFSNSNPAQDLERVPPGLLALDNMLYFSRNAPSAYSRFVLENSSREDKHECPFARGSIQLTVLLCELLRVGEPCSETAQDFSPMFFGQDQSFHELFCVGIQLLNKTWKEMRATQEDFDKVMQVVREQLARTLALKPTSLELFRTKVNALTYGEVLRLRQTERLHQEGTLAPPILELREKLKPELMGLIRQQRLLRLCEGTLFRKISSRRRQDKLWFCCLSPNHKLLQYGDMEEGASPPTLESLPEQLPVADMRALLTGKDCPHVREKGSGKQNKDLYELAFSISYDRGEEEAYLNFIAPSKREFYLWTDGLSALLGSPMGSEQTRLDLEQLLTMETKLRLLELENVPIPERPPPVPPPPTNFNFCYDCSIAEP

SEQ ID NO: 839818 - protein, 811 aa, Homo sapiens
MARSSSLGRECGTPRSGLGKGGPPRPQGPQARCTLGRRCTVSGKCRRPRPSWTMAPPRNVVKIAIKMRDAIPQLIQLDQAKPLAAVLKEVCDAWSLTHSERYALQFADGHRRYITENNRAEIKNGSILCLSTAPDLEAEQLLGGLQSNSPEGRREALRRLVPLASDMIFAREVISRNGLQILGTIIEDGDDLGEVLALSLRAFSELMEHGVVSWETLSIPFVRKVVCYVNMNLMDASVPPLALGLLESVTLSSPALGQLVKSEVPLDRLLVHLQVMNQQLQTKAMALLTALLQGASPVERKHMLDYLWQRNLRQFIYKNIIHSAAPMGDEMAHHLYVLQALMLGLLEPRMRTPLDPYSQEQREQLQVLRQAAFEVEGESSGAGLSADRRRSLCAREFRKLGFSNSNPAQDLERVPPGLLALDNMLYFSRNAPSAYSRFVLENSSREDKHECPFARGSIQLTVLLCELLRVGEPCSETAQDFSPMFFGQDQSFHELFCVGIQLLNKTWKEMRATQEDFDKVMQVVREQLARTLALKPTSLELFRTKVNALTYGEVLRLRQTERLHQEGTLAPPILELREKLKPELMGLIRQQRLLRLCEGTLFRKISSRRRQGLRMGMGRGQRAGRGQAEGGWLGVRTSQHSGPLPFLHADKLWFCCLSPNHKLLQYGDMEEGASPPTLESLPEQLPVADMRALLTGKDCPHVREKGSGKQNKDLYELAFSISYDRGEEEAYLNFIAPSKREFYLWTDGLSALLGSPMGSEQTRLDLEQLLTMETKLRLLELENVPIPERPPPVPPPPTNFNFCYDCSIAEP

SEQ ID NO: 839819 - protein, 229 aa, Homo sapiens
MARSSSLGRECGTPRSGLGKGGPPRPQGPQARCTLGRRCTVSGKCRRPRPSWTMAPPRNVVKIAIKMRDAIPQLIQLDQAKPLAAVLKEVCDAWSLTHSERYALQFADGHRRYITENNRAEIKNGSILCLSTAPDLEAEQLLGGLQSNSPEGRREALRRLVPLASDMIFAREVISRNGLQILGTIIEDGDDLGEVLALSLRAFSELMEHGVVSWETLSIPFVRKVGGLS

SEQ ID NO: 839820 - protein, 709 aa, Homo sapiens
IPPCPGRENDHIHLQAKPLAAVLKEVCDAWSLTHSERYALQFADGHRRYITENNRAEIKNGSILCLSTAPDLEAEQLLGGLQSNSPEGRREALRRLVPLASDMIFAREVISRNGLQILGTIIEDGDDLGEVLALSLRAFSELMEHGVVSWETLSIPFVRKVVCYVNMNLMDASVPPLALGLLESVTLSSPALGQLVKSEVPLDRLLVHLQVMNQQLQTKAMALLTALLQGASPVERKHMLDYLWQRNLRQFIYKNIIHSAAPMGDEMAHHLYVLQALMLGLLEPRMRTPLDPYSQEQREQLQVLRQAAFEVEGESSGAGLSADRRRSLCAREFRKLGFSNSNPAQDLERVPPGLLALDNMLYFSRNAPSAYSRFVLENSSREDKHECPFARGSIQLTVLLCELLRVGEPCSETAQDFSPMFFGQDQSFHELFCVGIQLLNKTWKEMRATQEDFDKVMQVVREQLARTLALKPTSLELFRTKVNALTYGEVLRLRQTERLHQEGTLAPPILELREKLKPELMGLIRQQRLLRLCEGTLFRKISSRRRQDKLWFCCLSPNHKLLQYGDMEEGASPPTLESLPEQLPVADMRALLTGKDCPHVREKGSGKQNKDLYELAFSISYDRGEEEAYLNFIAPSKREFYLWTDGLSALLGSPMGSEQTRLDLEQLLTMETKLRLLELENVPIPERPPPVPPPPTNFNFCYDCSIAEP

SEQ ID NO: 839821 - protein, 553 aa, Homo sapiens
EPRMRTPLDPYSQEQREQLQAYARLLESVTLSSPALGQLVKSEVPLDRLLVHLQVMNQQLQTKAMALLTALLQGASPVERKHMLDYLWQRNLRQFIYKNIIHSAAPMGDEMAHHLYVLQALMLGLLEPRMRTPLDPYSQEQREQLQVLRQAAFEVEGESSGAGLSADRRRSLCAREFRKLGFSNSNPAQDLERVPPGLLALDNMLYFSRNAPSAYSRFVLENSSREDKHECPFARGSIQLTVLLCELLRVGEPCSETAQDFSPMFFGQDQSFHELFCVGIQLLNKTWKEMRATQEDFDKVMQVVREQLARTLALKPTSLELFRTKVNALTYGEVLRLRQTERLHQEGTLAPPILELREKLKPELMGLIRQQRLLRLCEGTLFRKISSRRRQDKLWFCCLSPNHKLLQYGDMEEGASPPTLESLPEQLPVADMRALLTGKDCPHVREKGSGKQNKDLYELAFSISYDRGEEEAYLNFIAPSKREFYLWTDGLSALLGSPMGSEQTRLDLEQLLTMETKLRLLELENVPIPERPPPVPPPPTNFNFCYDCSIAEP

SEQ ID NO: 839822 - protein, 291 aa, Homo sapiens
MQVVREQLARTLALKPTSLELFRTKVNALTYGEVLRLRQTERLHQEGTLAPPILELREKLKPELMGLIRQQRLLRLCEGTLFRKISSRRRQGLRMGMGRGQRAGRGQAEGGWLGVRTSQHSGPLPFLHADKLWFCCLSPNHKLLQYGDMEEGASPPTLESLPEQLPVADMRALLTGKDCPHVREKGSGKQNKDLYELAFSISYDRGEEEAYLNFIAPSKREFYLWTDGLSALLGSPMGSEQTRLDLEQLLTMETKLRLLELENVPIPERPPPVPPPPTNFNFCYDCSIAEP

SEQ ID NO: 839823 - protein, 122 aa, Homo sapiens [sequence omitted]

SEQ ID NO: 839824 - protein, 128 aa, Homo sapiens
SAAARSTLKAGMAAAAAAGSGTPREEEGPAGEAAASQPQAPTSVPGARLSRLPLARVKALVKADPDVTLAGQEAIFILARAAELFVETIAKDAYCCAQQGKRKTLQRRDLDNAIEAVDEFAFLEGTLD

SEQ ID NO: 839825 - protein, 128 aa, Homo sapiens
SAAARSTLKAGMAAAAAAGSGTPREEEGPAGEAAASQPQAPTSVPGARLSRLPLARVKALVKADPDVTLAGQEAIFILARAAELFVETIAKDAYCCAQQGKRKTLQRRDLDNAIEAVDEFAFLEEMKC

SEQ ID NO: 839826 - protein, 149 aa, Homo sapiens
SAAARSTLKAGMAAAAAAGSGTPREEEVPAGEAAASQPQAPTSVPGARLSRLPLARVKALVKADPDVTLAGQEAIFILARAAELFVETIAKDAYCCAQQGKRKTLQRRDLDNAIEAVDEFAFLEVVKSPEDVMHFSGCILVVERHMYFD

SEQ ID NO: 839827 - protein, 132 aa, Homo sapiens
SAAARSTLKAGMAAAAAAGSGTPREEEGPAGEAAASQPQAPTSVPGARLSRLPLARVKALVKADPDVTLAGQEAIFILARAAELFVETIAKDAYCCAQQGKRKTLQRRDLDNAIEAVDEFAFLEALFTITKI

SEQ ID NO: 839828 - protein, 128 aa, Homo sapiens; identical to SEQ ID NO: 839824

SEQ ID NO: 839829 - protein, 128 aa, Homo sapiens; identical to SEQ ID NO: 839824

SEQ ID NO: 839830 - protein, 145 aa, Homo sapiens
SAAARSTLKAGMAAAAAAGSGTPREEEGPAGEAAASQPQAPTSVPGARLSRLPLARVKALVKADPDVTLAGQEAIFILARAAELFVETIAKDAYCCAQQGKRKTLQRRDLATGDLISDSCLAGNPHLDNAIEAVDEFAFLEGTLD

SEQ ID NO: 839831 - protein, 142 aa, Homo sapiens
SAAARSTLKAGMAAAAAAGSGTPREEEGPAGEAAASQPQAPTSVPGARLSRLPLARVKALVKADPDVTLAGQEAIFILARAAELFVETIAKDAYCCAQQGKRKTLQRRDLDNAIEAVDEFAFLEGEFPLSGQSFPPVFCMLM

SEQ ID NO: 839832 - protein, 127 aa, Homo sapiens
SAAARSTLKAGMAAAAAAGSGTPREEEGPAGEAAASQPQAPTSVPGARLSRLPLARVKALVKADPDVTLAGQEAIFILARAAELFVETIAKDAYCCAQQGKRKTLLCKVFHYFCLSSISSLDAAAAA

SEQ ID NO: 839833 - protein, 76 aa, Homo sapiens
EDKTAELRGELLTQGELLTQKRAANSGAAAELFVETIAKDAYCCAQQGKRKTLQRRDLDNAIEAVDEFAFLEGTLD

SEQ ID NO: 839834 - protein, 79 aa, Homo sapiens
TCRVQHLLGSQHLSFILSVQRSSSSCICVTEKQQGSWPLVLTLIRGALMGAGFLLTYGLTWIYYTRCGGPQQSRAERPG

SEQ ID NO: 839835 - protein, 205 aa, Homo sapiens
APRSAAGGEGFGSLHASLVGFRGVVAGCARHFRASRNGVANGLQSNMPKFYCDYCDTYLTHDSPSVRKTHCSGRKHKENVKDYYQKWMEEQAQSLIDKTTAAFQQGKIPPTPFSAPPPAGAMIPPPPSLPGPPRPGMMPAPHMGGPPMMPMMGPPPPGMMPVGPAPGMRPPMGGHMPMMPGPPMMRPPARPMMVPTRPGMTRPDR

SEQ ID NO: 839836 - protein, 169 aa, Homo sapiens
NGGRNLARSNMPKFYCDYCDTYLTHDSPSVRKTHCSGRKHKENVKDYYQKWMEEQAQSLIDKTTAAFQQGKIPPTPFSAPPPAGAMIPPPPSLPGPPRPGMMPAPHMGGPPMMPMMGPPPPGMMPVGPAPGMRPPMGGHMPMMPGPPMMRPPARPMMVPTRPGMTRPDR

SEQ ID NO: 839837 - protein, 205 aa, Homo sapiens; identical to SEQ ID NO: 839835

SEQ ID NO: 839838 - protein, 118 aa, Homo sapiens
RLGTRLGVNRPRHSPQPSGSSSPWYDASTPYGGPSHDANDGPSSSWDDASGTCSWNEAAHGRPYANDAWAPNDETSCPSHDGAHSARNDSTRQIRIEGRPYCIGFILPVLLHQEIMLL

SEQ ID NO: 839839 - protein, 135 aa, Homo sapiens
NGGRNLARSNMPKFYCDYCDTYLTHDSPSVRKTHCSGRKHKENVKDYYQKWMEEQAQSLIDKTTAAFQQGKIPPTPFSAPPPAGAMIPPPPSLPGPPRPGMMPAPHMGGPPMMPMMGPPPPGMMPVGPGKFECLS

SEQ ID NO: 839840 - protein, 175 aa, Homo sapiens
PTRPSTHASANGLQSNMPKFYCDYCDTYLTHDSPSVRKTHCSGRKHKENVKDYYQKWMEEQAQSLIDKTTAAFQQGKIPPTPFSAPPPAGAMIPPPPSLPGPPRPGMMPAPHMGGPPMMPMMGPPPPGMMPVGPAPGMRPPMGGHMPMMPGPPMMRPPARPMMVPTRPGMTRPDR

SEQ ID NO: 839841 - protein, 180 aa, Homo sapiens
MNSASVDGHLSGCRLFLFLSPLFRFYCDYCDTYLTHDSPSVRKTHCSGRKHKENVKDYYQKWMEEQAQSLIDKTTAAFQQGKIPPTPFSAPPPAGAMIPPPPSLPGPPRPGMMPAPHMGGPPMMPMMGPPPPGMMPVGPAPGMRPPMGGHMPMMPGPPMMRPPARPMMVPTRPGMTRPDR

SEQ ID NO: 839842 - protein, 118 aa, Homo sapiens
MEEQAQSLIDKTTAAFQQGKIPPTPFSAPPPAGAMIPPPPSLPGPPRPGMMPAPHMGGPPMMPMMGPPPPGMMPVGPAPGMRPPMGGHMPMMPGPPMMRPPARPMMVPTRPGMTRPDR

SEQ ID NO: 839843 - protein, 205 aa, Homo sapiens; identical to SEQ ID NO: 839835

SEQ ID NO: 839844 - protein, 205 aa, Homo sapiens; identical to SEQ ID NO: 839835

SEQ ID NO: 839845 - protein, 161 aa, Homo sapiens
MPVLSIFGKWRFESGCLPRSLWNTLSSEKPLRWDSHLSCMLCWQAGFEAEQKVSGSSRKLAISHALLEMLTPPPAGAMIPPPPSLPGPPRPGMMPAPHMGGPPMMPMMGPPPPGMMPVGPAPGMRPPMGGHMPMMPGPPMMRPPARPMMVPTRPGMTRPDR

SEQ ID NO: 839846 - protein, 178 aa, Homo sapiens
IKAKVRGWVWNRPRRLQSNMPKFYCDYCDTYLTHDSPSVRKTHCSGRKHKENVKDYYQKWMEEQAQSLIDKTTAAFQQGKIPPTPFSAPPPAGAMIPPPPSLPGPPRPGMMPAPHMGGPPMMPMMGPPPPGMMPVGPAPGMRPPMGGHMPMMPGPPMMRPPARPMMVPTRPGMTRPDR

SEQ ID NO: 839847 - protein, 178 aa, Homo sapiens; identical to SEQ ID NO: 839846

SEQ ID NO: 839848 - protein, 163 aa, Homo sapiens
ASTRLGVKSAEGDTIPLSHDSPSVRKTHCSGRKHKENVKDYYQKWMEEQAQSLIDKTTAAFQQGKIPPTPFSAPPPAGAMIPPPPSLPGPPRPGMMPAPHMGGPPMMPMMGPPPPGMMPVGPAPGMRPPMGGHMPMMPGPPMMRPPARPMMVPTRPGMTRPDR

SEQ ID NO: 839849 - protein, 175 aa, Homo sapiens
AVVSRYEAGLAAADARCPEFYCDYCDTYLTHDSPSVRKTHCSGRKHKENVKDYYQKWMEEQAQSLIDKTTAAFQQGKIPPTPFSAPPPAGAMIPPPPSLPGPPRPGMMPAPHMGGPPMMPMMGPPPPGMMPVGPAPGMRPPMGGHMPMMPGPPMMRPPARPMMVPTRPGMTRPDR

SEQ ID NO: 839850 - protein, 180 aa, Homo sapiens; identical to SEQ ID NO: 839841

SEQ ID NO: 839851 - protein, 118 aa, Homo sapiens; identical to SEQ ID NO: 839842

SEQ ID NO: 839852 - protein, 140 aa, Homo sapiens
IGWCYCLGCLPPPPPPPVLSYSILCSSSCRGDDTTSPQPSGSSSPWYDASTPYGGPSHDANDGPSSSWDDASGTCSWNEAAHGRPYANDAWAPNDETSCPSHDGAHSARNDSTRQIRIEGRPYCIGFILPVLLHQEIMLL

SEQ ID NO: 839853 - protein, 31 aa, Homo sapiens
MREAIGYQITSGLAGHCNNSGFYPLQERKPL

SEQ ID NO: 839854 - protein, 360 aa, Homo sapiens
MVTLEEFLEESNRSSPTHDTPSCRDDLLSDYFRKASDPPAIGGQPGPPAKKEGAKMPTNFVAPTVKMAAPTSEGRPLKPGQYVKPNFRLTEAEAPPSVAPRQAQPPQSLSLGRPRQAPVPPASHAPASRSASLSRAFSLASADLLRASGPEACKQESPQKLGAPEALGGRETGSHTLQSPAPPSSHSLARERTPLVGKAGSSCQGPGPRSRPLDTRRFSLAPPKEERLAPLHQSATAPAIATAGAGAAAAGSGSNSQLLHFSPAAAPAARTKPKAPPRSGEVATITPVRAGLSLSEGDGVPGQGCSEGLPAKSPGRSPDLAPHLGRALEDCSRGSVSKSSPASPEPGGDPQTVWYEYGCV

SEQ ID NO: 839855 - protein, 1780 aa, Homo sapiens
MLPGLLVEEAASHTLSPYCLCREDKTEQLVDTRHEVDQLVLELQKVKQENIQLAADARSARAYRDELDSLREKANRVERLELELTRCKEKLHDVDFYKARMEELREDNIILIETKAMLEEQLTAARARGDKVHELEKENLQLKSKLHDLELDRDTDKKRIEELLEENMVLEIAQKQSMNESAHLGWELEQLSKNADLSDASRKSFVFELNECASSRILKLEKENQSLQSTIQGLRDASLVLEESGLKCGELEKENHQLSKKIEKLQTQLEREKQSNQDLETLSEELIREKEQLQSDMETLKADKARQIKDLEQEKDHLNRAMWSLRERSQVSSEARMKDVEKENKALHQTVTEANGKLSQLEFEKRQLHRDLEQAKEKGERAEKLERELQRLQEENGRLARKVTSLETATEKVEALEHESQGLQLENRTLRKSLDTLQNVSLQLEGLERDNKQLDAENLELRRLVETMRFTSTKLAQMERENQQLEREKEELRKNVDLLKALGKKSERLELSYQSVSAENLRLQQSLESSSHKTQTLESELGELEAERQALRRDLEALRLANAQLEGAEKDRKALEQEVAQLEKDKKLLEKEAKRLWQQVELKDAVLDDSTAKLSAVEKESRALDKELARCRDAAGKLKELEKDNRDLTKQVTVHARTLTTLREDLVLEKLKSQQLSSELDKLSQELEKVGLNRELLLQEDDSGSDTKYKILEGRNESALKTTLAMKEEKIVLLEAQMEEKASLNRQLESELQMLKKECETLRQNQGEGQHLQNSFKHPAGKTAASHQGKEAWGPGHKEATMELLRVKDRAIELERNNAALQAEKQLLKEQLQHLETQNVTFSSQILTLQKQSAFLQEHNTTLQTQTAKLQVENSTLSSQSAALTAQYTLLQNHHTAKETENESLQRQQEQLTAAYEALLQDHEHLGTLHERQSAEYEALIRQHSCLKTLHRNLELEHKELGERHGDMLKRKAELEEREKVLTTEREALQQEQRTNALAMGENQRLRGELDRVNFLHHQLKGEYEELHAHTKELKTSLNNAQLELNRWQARFDELKEQHQTMDISLTKLDNHCELLSRLKGNLEEENHHLLSQIQLLSQQNQMLLEQNMENKEQYHEEQKQYIDKLNALRRHKEKLEEKIMDQYKFYDPPPKKKNHWIGAKALVKLIKPKKEGSRERLKSTVDSPPWQLESSDPASPAASQPLRSQAENPDTPALGSNCAEERDAHNGSVGKGPGDLKPKRGSPHRGSLDRTDASTDLAMRSWPSELGSRTCSTSATTTAPSNSTPIARHPGRTKGYNSDDNLCEPSLEFEVPNHRQYVSRPSSLESSRNTSSNSSPLNLKGSSEQLHGRSESFSSEDLIPSRDLATLPREASTPGRNALGRHEYPLPRNGPLPQEGAQKRGTAPPYVGVRPCSASPSSEMVTLEEFLEESNRSSPTHDTPSCRDDLLSDYFRKASDPPAIGGQPGPPAKKEGAKMPTNFVAPTVKMAAPTSEGRPLKPGQYVKPNFRLTEAEAPPSVAPRQAQPPQSLSLGRPRQAPVPPASHAPASRSASLSRAFSLASADLLRASGPEACKQESPQKLGAPEALGGRETGSHTLQSPAPPSSHSLARERTPLVGKAGSSCQGPGPRSRPLDTRRFSLAPPKEERLAPLHQSATAPAIATAGAGAAAAGSGSNSQLLHFSPAAAPAARTKPKAPPRSGEVATITPVRAGLSLSEGDGVPGQGCSEGLPAKSPGRSPDLAPHLGRALEDCSRGSVSKSSPASPEPGGDPQTVWYEYGCV

SEQ ID NO: 839856 - protein, 1546 aa, Homo sapiens
GGFCFVLNHGSLRRTDVCTGLGLLVLQIEKLQTQLEREKQSNQDLETLSEELIREKEQLQSDMETLKADKARQIKDLEQEKDHLNRAMWSLRERSQVSSEARMKDVEKENKALHQTVTEANGKLSQLEFEKRQLHRDLEQAKEKGERAEKLERELQRLQEENGRLARKVTSLETATEKVEALEHESQGLQLENRTLRKSLDTLQNVSLQLEGLERDNKQLDAENLELRRLVETMRFTSTKLAQMERENQQLEREKEELRKNVDLLKALGKKSERLELSYQSVSAENLRLQQSLESSSHKTQTLESELGELEAERQALRRDLEALRLANAQLEGAEKDRKALEQEVAQLEKDKKLLEKEAKRLWQQVELKDAVLDDSTAKLSAVEKESRALDKELARCRDAAGKLKELEKDNRDLTKQVTVHARTLTTLREDLVLEKLKSQQLSSELDKLSQELEKVGLNRELLLQEDDSGSDTKYKILEGRNESALKTTLAMKEEKIVLLEAQMEEKASLNRQLESELQMLKKECETLRQNQGEGQHLQNSFKHPAGKTAASHQGKEAWGPGHKEATMELLRVKDRAIELERNNAALQAEKQLLKEQLQHLETQNVTFSSQILTLQKQSAFLQEHNTTLQTQTAKLQVENSTLSSQSAALTAQYTLLQNHHTAKETENESLQRQQEQLTAAYEALLQDHEHLGTLHERQSAEYEALIRQHSCLKTLHRNLELEHKELGERHGDMLKRKAELEEREKVLTTEREALQQEQRTNALAMGENQRLRGELDRVNFLHHQLKGEYEELHAHTKELKTSLNNAQLELNRWQARFDELKEQHQTMDISLTKLDNHCELLSRLKGNLEEENHHLLSQIQLLSQQNQMLLEQNMENKEQYHEEQKQYIDKLNALRRHKEKLEEKIMDQYKFYDPPPKKKNHWIGAKALVKLIKPKKEGSRERLKSTVDSPPWQLESSDPASPAASQPLRSQAENPDTPALGSNCAEERDAHNGSVGKGPGDLKPKRGSPHRGSLDRTDASTDLAMRSWPSELGSRTCSTSATTTAPSNSTPIARHPGRTKGYNSDDNLCEPSLEFEVPNHRQYVSRPSSLESSRNTSSNSSPLNLKGSSEQLHGRSESFSSEDLIPSRDLATLPREASTPGRNALGRHEYPLPRNGPLPQEGAQKRGTAPPYVGVRPCSASPSSEMVTLEEFLEESNRSSPTHDTPSCRDDLLSDYFRKASDPPAIGGQPGPPAKKEGAKMPTNFVAPTVKMAAPTSEGRPLKPGQYVKPNFRLTEAEAPPSVAPRQAQPPQSLSLGRPRQAPVPPASHAPASRSASLSRAFSLASADLLRASGPEACKQESPQKLGAPEALGGRETGSHTLQSPAPPSSHSLARERTPLVGKAGSSCQGPGPRSRPLDTRRFSLAPPKEERLAPLHQSATAPAIATAGAGAAAAGSGSNSQLLHFSPAAAPAARTKPKAPPRSGEVATITPVRAGLSLSEGDGVPGQGCSEGLPAKSPGRSPDLAPHLGRALEDCSRGSVSKSSPASPEPGGDPQTVWYEYGCV

SEQ ID NO: 839857 - protein, 1402 aa, Homo sapiens
YLDLLAYLDLLAYLDLLAYLDLLAYLDLLGALRLANAQLEGAEKDRKALEQEVAQLEKDKKLLEKEAKRLWQQVELKDAVLDDSTAKLSAVEKESRALDKELARCRDAAGKLKELEKDNRDLTKQVTVHARTLTTLREDLVLEKLKSQQLSSELDKLSQELEKVGLNRELLLQEDDSGSDTKYKILEGRNESALKTTLAMKEEKIVLLEAQMEEKASLNRQLESELQMLKKECETLRQNQGEGQHLQNSFKHPAGKTAASHQGKEAWGPGHKEATMELLRVKDRAIELERNNAALQAEKQLLKEQLQHLETQNVTFSSQILTLQKQSAFLQEHNTTLQTQTAKLQVENSTLSSQSAALTAQYTLLQNHHTAKETENESLQRQQEQLTAAYEALLQDHEHLGTLHERQSAEYEALIRQHSCLKTLHRNLELEHKELGERHGDMLKRKAELEEREKVLTTEREALQQEQRTNALAMGENQRLRGELDRVNFLHHQLKGEYEELHAHTKELKTSLNNAQLELNRWQARFDELKEQHQTMDISLTKLDNHCELLSRLKGNLEEENHHLLSQIQLLSQQNQMLLEQNMENKEQYHEEQKQYIDKLNALRRHKEKLEEKIMDQYKFYDPPPKKKNHWIGAKALVKLIKPKKEGSRERLKSTVDSPPWQLESSDPASPAASQPLRSQAENPDTPALGSNCAEERDAHNGSVGKAPPRKKSPFLKSKNKDKDKSPTTHPALSKRLRFWSSSDIPSSPNEPLSFSDIGDFYIPFLYHVSVLCTLLHFRNSNKQKKPASKRPDGRERTPPPAPNFKLKVASVDSDFKIEDEYVTLPGPFLQHNTVLGGASGYTCTCPWARMSVLSPGDLKPKRGSPHRGSLDRTDASTDLAMRSWPSELGSRTCSTSATTTAPSNSTPIARHPGRTKGYNSDDNLCEPSLEFEVPNHRQYVSRPSSLESSRNTSSNSSPLNLKGSSEQLHGRSESFSSEDLIPSRDLATLPREASTPGRNALGRHEYPLPRNGPLPQEGAQKRGTAPPYVGVRPCSASPSSEMVTLEEFLEESNRSSPTHDTPSCRDDLLSDYFRKASDPPAIGGQPGPPAKKEGAKMPTNFVAPTVKMAAPTSEGRPLKPGQYVKPNFRLTEAEAPPSVAPRQAQPPQSLSLGRPRQAPVPPASHAPASRSASLSRAFSLASADLLRASGPEACKQESPQKLGAPEALGGRETGSHTLQSPAPPSSHSLARERTPLVGKAGSSCQGPGPRSRPLDTRRFSLAPPKEERLAPLHQSATAPAIATAGAGAAAAGSGSNSQLLHFSPAAAPAARTKPKAPPRSGEVATITPVRAGLSLSEGDGVPGQGCSEGLPAKSPGRSPDLAPHLGRALEDCSRGSVSKSSPASPEPGGDPQTVWYEYGCV

SEQ ID NO: 839858 - protein, 601 aa, Homo sapiens
KSSSADSTPSPTSSLSSEDKQHLAVELADTKARLRRVRQELEDKTEQLVDTRHEVDQLVLELQKVKQENIQLAADARSARAYRDELDSLREKANRVERLELELTRCKEKLHDVDFYKARMEELREDNIILIETKAMLEEQLTAARARGDKVHELEKENLQLKSKLHDLELDRDTDKKRIEELLEENMVLEIAQKQSMNESAHLGWELEQLSKNADLSDASRKSFVFELNECASSRILKLEKENQSLQSTIQGLRDASLVLEESGLKCGELEKENHQLSKKIEKLQTQLEREKQSNQDLETLSEELIREKEQLQSDMETLKADKARQIKDLEQEKDHLNRAMWSLRERSQVSSEARMKDVEKENKALHQTVTEANGKLSQLEFEKRQLHRDLEQAKEKGERAEKLERELQRLQEENGRLARKVTSLETATEKVEALEHESQGLQLENRTLRKSLDTLQNVSLQLEGLERDNKQLDAENLELRRLVETMRFTSTKLAQMERENQQLAPELTHERAAITRNGNPRIHHQHSQAHPWSGLQEACTSGTQRDSRHSPMKEMRNIQMAHDTQAKQSGSDPKEYRNVPYRSRAQSRRVEAHSRSAVHV

SEQ ID NO: 839859 - protein, 84 aa, Homo sapiens
MLGNQGPTGGVWEGWLCPKHLLLTRKNHWIGAKALVKLIKPKKEGSRERLKSTVDSPPWQLESSDPASPAASQPLRSQAENPDT

SEQ ID NO: 839860 - protein, 1799 aa, Homo sapiens
KSSSADSTPSPTSSLSSEDKQHLAVELADTKARLRRVRQELEDKTEQLVDTRHEVDQLVLELQKVKQENIQLAADARSARAYRDELDSLREKANRVERLELELTRCKEKLHDVDFYKARMEELREDNIILIETKAMLEEQLTAARARGDKVHELEKENLQLKSKLHDLELDRDTDKKRIEELLEENMVLEIAQKQSMNESAHLGWELEQLSKNADLSDASRKSFVFELNECASSRILKLEKENQSLQSTIQGLRDASLVLEESGLKCGELEKENHQLSKKIEKLQTQLEREKQSNQDLETLSEELIREKEQLQSDMETLKADKARQIKDLEQEKDHLNRAMWSLRERSQVSSEARMKDVEKENKALHQTVTEANGKLSQLEFEKRQLHRDLEQAKEKGERAEKLERELQRLQEENGRLARKVTSLETATEKVEALEHESQGLQLENRTLRKSLDTLQNVSLQLEGLERDNKQLDAENLELRRLVETMRFTSTKLAQMERENQQLEREKEELRKNVDLLKALGKKSERLELSYQSVSAENLRLQQSLESSSHKTQTLESELGELEAERQALRRDLEALRLANAQLEGAEKDRKALEQEVAQLEKDKKLLEKEAKRLWQQVELKDAVLDDSTAKLSAVEKESRALDKELARCRDAAGKLKELEKDNRDLTKQVTVHARTLTTLREDLVLEKLKSQQLSSELDKLSQELEKVGLNRELLLQEDDSGSDTKYKILEGRNESALKTTLAMKEEKIVLLEAQMEEKASLNRQLESELQMLKKECETLRQNQGEGQHLQNSFKHPAGKTAASHQGKEAWGPGHKEATMELLRVKDRAIELERNNAALQAEKQLLKEQLQHLETQNVTFSSQILTLQKQSAFLQEHNTTLQTQTAKLQVENSTLSSQSAALTAQYTLLQNHHTAKETENESLQRQQEQLTAAYEALLQDHEHLGTLHERQSAEYEALIRQHSCLKTLHRNLELEHKELGERHGDMLKRKAELEEREKVLTTEREALQQEQRTNALAMGENQRLRGELDRVNFLHHQLKGEYEELHAHTKELKTSLNNAQLELNRWQARFDELKEQHQTMDISLTKLDNHCELLSRLKGNLEEENHHLLSQIQLLSQQNQMLLEQNMENKEQYHEEQKQYIDKLNALRRHKEKLEEKIMDQYKFYDPPPKKKNHWIGAKALVKLIKPKKEGSRERLKSTVDSPPWQLESSDPASPAASQPLRSQAENPDTPALGSNCAEERDAHNGSVGKGPGDLKPKRGSPHRGSLDRTDASTDLAMRSWPSELGSRTCSTSATTTAPSNSTPIARHPGRTKGYNSDDNLCEPSLEFEVPNHRQYVSRPSSLESSRNTSSNSSPLNLKGSSEQLHGRSESFSSEDLIPSRDLATLPREASTPGRNALGRHEYPLPRNGPLPQEGAQKRGTAPPYVGVRPCSASPSSEMVTLEEFLEESNRSSPTHDTPSCRDDLLSDYFRKASDPPAIGGQPGPPAKKEGAKMPTNFVAPTVKMAAPTSEGRPLKPGQYVKPNFRLTEAEAPPSVAPRQAQPPQSLSLGRPRQAPVPPASHAPASRSASLSRAFSLASADLLRASGPEACKQESPQKLGAPEALGGRETGSHTLQSPAPPSSHSLARERTPLVGKAGSSCQGPGPRSRPLDTRRFSLAPPKEERLAPLHQSATAPAIATAGAGAAAAGSGSNSQLLHFSPAAAPAARTKPKAPPRSGEVATITPVRAGLSLSEGDGVPGQGCSEGLPAKSPGRSPDLAPHLGRALEDCSRGSVSKSSPASPEPGGDPQTVWYEYGCV

SEQ ID NO: 839861 - protein, 1947 aa, Homo sapiens
KSSSADSTPSPTSSLSSEDKQHLAVELADTKARLRRVRQELEDKTEQLVDTRHEVDQLVLELQKVKQENIQLAADARSARAYRDELDSLREKANRVERLELELTRCKEKLHDVDFYKARMEELREDNIILIETKAMLEEQLTAARARGDKVHELEKENLQLKSKLHDLELDRDTDKKRIEELLEENMVLEIAQKQSMNESAHLGWELEQLSKNADLSDASRKSFVFELNECASSRILKLEKENQSLQSTIQGLRDASLVLEESGLKCGELEKENHQLSKKIEKLQTQLEREKQSNQDLETLSEELIREKEQLQSDMETLKADKARQIKDLEQEKDHLNRAMWSLRERSQVSSEARMKDVEKENKALHQTVTEANGKLSQLEFEKRQLHRDLEQAKEKGERAEKLERELQRLQEENGRLARKVTSLETATEKVEALEHESQGLQLENRTLRKSLDTLQNVSLQLEGLERDNKQLDAENLELRRLVETMRFTSTKLAQMERENQQLEREKEELRKNVDLLKALGKKSERLELSYQSVSAENLRLQQSLESSSHKTQTLESELGELEAERQALRRDLEALRLANAQLEGAEKDRKALEQEVAQLEKDKKLLEKEAKRLWQQVELKDAVLDDSTAKLSAVEKESRALDKELARCRDAAGKLKELEKDNRDLTKQVTVHARTLTTLREDLVLEKLKSQQLSSELDKLSQELEKVGLNRELLLQEDDSGSDTKYKILEGRNESALKTTLAMKEEKIVLLEAQMEEKASLNRQLESELQMLKKECETLRQNQGEGQHLQNSFKHPAGKTAASHQGKEAWGPGHKEATMELLRVKDRAIELERNNAALQAEKQLLKEQLQHLETQNVTFSSQILTLQKQSAFLQEHNTTLQTQTAKLQVENSTLSSQSAALTAQYTLLQNHHTAKETENESLQRQQEQLTAAYEALLQDHEHLGTLHERQSAEYEALIRQHSCLKTLHRNLELEHKELGERHGDMLKRKAELEEREKVLTTEREALQQEQRTNALAMGENQRLRGELDRVNFLHHQLKGEYEELHAHTKELKTSLNNAQLELNRWQARFDELKEQHQTMDISLTKLDNHCELLSRLKGNLEEENHHLLSQIQLLSQQNQMLLEQNMENKEQYHEEQKQYIDKLNALRRHKEKLEEKIMDQYKFYDPPPKKKNHWIGAKALVKLIKPKKEGSRERLKSTVDSPPWQLESSDPASPAASQPLRSQAENPDTPALGSNCAEERDAHNGSVGKAPPRKKSPFLKSKNKDKDKSPTTHPALSKRLRFWSSSDIPSSPNEPLSFSDIGDFYIPFLYHVSVLCTLLHFRNSNKQKKPASKRPDGRERTPPPAPNFKLKVASVDSDFKIEDEYVTLPGPFLQHNTVLGGASGYTCTCPWARMSVLSPGDLKPKRGSPHRGSLDRTDASTDLAMRSWPSELGSRTCSTSATTTAPSNSTPIARHPGRTKGYNSDDNLCEPSLEFEVPNHRQYVSRPSSLESSRNTSSNSSPLNLKGSSEQLHGRSESFSSEDLIPSRDLATLPREASTPGRNALGRHEYPLPRNGPLPQEGAQKRGTAPPYVGVRPCSASPSSEMVTLEEFLEESNRSSPTHDTPSCRDDLLSDYFRKASDPPAIGGQPGPPAKKEGAKMPTNFVAPTVKMAAPTSEGRPLKPGQYVKPNFRLTEAEAPPSVAPRQAQPPQSLSLGRPRQAPVPPASHAPASRSASLSRAFSLASADLLRASGPEACKQESPQKLGAPEALGGRETGSHTLQSPAPPSSHSLARERTPLVGKAGSSCQGPGPRSRPLDTRRFSLAPPKEERLAPLHQSATAPAIATAGAGAAAAGSGSNSQLLHFSPAAAPAARTKPKAPPRSGEVATITPVRAGLSLSEGDGVPGQGCSEGLPAKSPGRSPDLAPHLGRALEDCSRGSVSKSSPASPEPGGDPQTVWYEYGCV

SEQ ID NO: 839862 - protein, 360 aa, Homo sapiens; identical to SEQ ID NO: 839854

SEQ ID NO: 839863 - protein, 335 aa, Homo sapiens
KSSSADSTPSPTSSLSSEDKQHLAVELADTKARLRRVRQELEDKTEQLVDTRHEVDQLVLELQKVKQENIQLAADARSARAYRDELDSLREKANRVERLELELTRCKEKLHDVDFYKARMEELREDNIILIETKAMLEEQLTAARARGDKVHELEKENLQLKSKLHDLELDRDTDKKRIEELLEENMVLEIAQKQSMNESAHLGWELEQLSKNADLSDASRKSFVFELNECASSRILKLEKENQSLQSTIQGLRDASLVLEESGLKCGELEKENHQLSKKIEKLQTQLEREKQSNQDLETLSEELIREKEQLQSDMETLKADKARQVGASTTNAS

SEQ ID NO: 839864 - protein, 60 aa, Homo sapiens
GFLLYHLHHHHHVQAREGKRGPATLTGDFIRLPGTHTLSLTHSLAGLPAVCVRGGDRLGA

SEQ ID NO: 839865 - protein, 510 aa, Homo sapiens
MPPASGPSVLARLLPLLGLLLGSASRAPGKSPPEPPSPQEILIKVQVYVSGELVPLARASVDVFGNRTLLAAGTTDSEGVATLPLSYRLGTWVLVTAARPGFLTNSVPWRVDKLPLYASVSLYLLPERPATLILYEDLVHILLGSPGARSQPLVQFQRRAARLPVSSTYSQLWASLTPASTQQEMRAFPAFLGTEASSSGNGSWLELMPLTAVSVHLLTGNGTEVPLSGPIHLSLPVPSETRALTVGTSIPAWRFDPKSGLWVRNGTGVIRKEGRQLYWTFVSPQLGYWVAAMASPTAGLVTITSGIQDIGTYHTIFLLTILAALALLVLILLCLLIYYCRRRCLKPRQQHRKLQLSGPSDGNKRDQATSMSQLHLICGGPLEPAPSGDPEAPPPGPLHSAFSSSRDLASSRDDFFRTKPRSASRPAAEPSGARGGESAGLKGARSAEGPGGLEPGLEEHRRGPSGAAAFLHEPPSPPPPFDHYLGHKGAAEGKTPDFLLSQSVDQLARP

SEQ ID NO: 839866 - protein, 537 aa, Homo sapiens
MPPASGPSVLARLLPLLGLLLGSASRAPGKSPPEPPSPQEILIKVQVYVSGELVPLARASVDVFGNRTLLAAGTTDSEGVATLPLSYRLGTWVLVTAARPGFLTNSVPWRVDKLPLYASVSLYLLPERPATLILYEDLVHILLGSPGCASIVAGAGNHGEEEDPLFAFGRSQTSARSQPLVQFQRRAARLPVSSTYSQLWASLTPASTQQEMRAFPAFLGTEASSSGNGSWLELMPLTAVSVHLLTGNGTEVPLSGPIHLSLPVPSETRALTVGTSIPAWRFDPKSGLWVRNGTGVIRKEGRQLYWTFVSPQLGYWVAAMASPTAGLVTITSGIQDIGTYHTIFLLTILAALALLVLILLCLLIYYCRRRCLKPRQQHRKLQLSGPSDGNKRDQATSMSQLHLICGGPLEPAPSGDPEAPPPGPLHSAFSSSRDLASSRDDFFRTKPRSASRPAAEPSGARGGESAGLKGARSAEGPGGLEPGLEEHRRGPSGAAAFLHEPPSPPPPFDHYLGHKGAAEGKTPDFLLSQSVDQLARP

SEQ ID NO: 839867 - protein, 273 aa, Homo sapiens
TTGKAPSPPPLLTDRQVNEKVENLSIQLRLMTRERNELRKRLAFATHGTAFDKRPYHRLNPDYERLKIQCVRAMSDLQSLQNQHTNALKRCEEVAKETDFYHTLHSRLLSDQTRLKDDVDMLRRENGQLLRERNLLQQSWEDMKRLHEEDQKEIGDLRAQQQQVLKHNGSSEILNKLYDTAMDKLEVVKKDYDALRKRYSEKVAIHNADLSRLEQLGEENQRLLKQTEMLTQQRDTAIQLQHQCALSLRRFEAIHHELLQSELTELEYHAVKT

SEQ ID NO: 839868 - protein, 90 aa, Homo sapiens
GLTAACTGCFSTLHSRLLSDQTRLKDDVDMLRRENGQLLRERNLLQQSWEDMKRLHEEDQKEIGDLRAQQQQVGPAPGDWPFLPSSPHSF

SEQ ID NO: 839869 - protein, 261 aa, Homo sapiens
TTGKAPSPPPLLTDRQVNEKVENLSIQLRLMTRERNELRKRLAFATHGTAFDKRPYHRLNPDYERLKIQCVRAMSDLQSLQNQHTNALKSTLHSRLLSDQTRLKDDVDMLRRENGQLLRERNLLQQSWEDMKRLHEEDQKEIGDLRAQQQQVLKHNGSSEILNKLYDTAMDKLEVVKKDYDALRKRYSEKVAIHNADLSRLEQLGEENQRLLKQTEMLTQQRDTAIQLQHQCALSLRRFEAIHHELLQSELTELEYHAVKT

SEQ ID NO: 839870 - protein, 86 aa, Homo sapiens
ACTGCFSTLHSRLLSDQTRLKDDVDMLRRENGQLLRERNLLQQSWEDMKRLHEEDQKEIGDLRAQQQQVGPAPGDWPFLPSSPHSF

SEQ ID NO: 839871 - protein, 1621 aa, Homo sapiens
MEWVLAEALLSQSRDPRALLGALCQGEASAERVETLRFLLQRLEDEEARGSGGAGALPEAAREVAAGYLVPLLRSLRGRPAGGPDPSLQPRHRRRVLRAAGAALRSCVRLAGRPQLAAALAEEALRDLLAGWRAPGAEAAVEVLAAVGPCLRPREDGPLLERVAGTAVALALGGGGDGDEAGPAEDAAALVAGRLLPVLVQCGGAALRAVWGGLAAPGASLGSGRVEEKLLVLSALAEKLLPEPGGDRARGAREAGPDARRCWRFWRTVQAGLGQADALTRKRARYLLQRAVEVSAELGADCTCGPQEGNGPSLFWWSERKKDELLKFWENYILIMETLEGNQIHVIKPVLPKLNNLFEYAVSEENGCWLFHPSWHMCIYKRMFESENKILSKEGVIHFLELYETKILPFSPEFSEFIIGPLMDALSESSLYSRSPGQPIGSCSPLGLKLQKFLVTYISLLPEEIKSSFLLKFIRKMTSRHWCAVPILFLSKALANVPRHKALGIDGLLALRDVIHCTMITHQILLRGAAQCYLLQTAMNLLDVEKVSLSDVSTFLMSLRQEESLGRGTSLWTELCDWLRVNESYFKPSPTCSSIGLHKTSLNAYVKSIVQEYVKSSAWETGENCFMPDWFEAKLVSLMVLLAVDVEGMKTQYSGKQRTENVLRIFLDPLLDVLMKFSTNAYMPLLKTDRCLQLLLKLLNTCRLKGSSAQDDEVSTVLQNFFMSTTESISEFILRRLTMNELNSVSDLDRCHLYLMVLTELINLHLKVGWKRGNPIWRVISLLKNASIQHLQEMDSGQEPTVGSQIQRVVSMAALAMVCEAIDQKPELQLDSLHAGPLESFLSSLQLNQTLQKPHAEEQSSYAHPLECSSVLEESSSSQGWGKIVAQYIHDQWVCLSFLLKKYHTLIPTTGSEILEPFLPAVQMPIRTLQSALEALTVLSSDQVLPVFHCLKVLVPKLLTSSESLCIESFDMAWKIISSLSNTQLIFWANLKAFVQFVFDNKVLTIAAKIKGQAYFKIKEIMYKIIEMSAIKTGVFNTLISYCCQSWIVSASNVSQGSLSSAKNYSELILEACIFGTVFRRDQRLVQDVQTFIENLGHDCAANIVMENTKREDHYVRICAVKFLCLLDGSNMSHKLFIEDLAIKLLDKDELVSKSKKRYYVNSLQHRVKNRVWQTLLVLFPRLDQNFLNGIIDRIFQAGFTNNQASIKYFIEWIIILILHKFPQFLPKFWDCFSYGEENLKTSICTFLAVLSHLDIITQNIPEKKLILKQALIVVLQWCFNHNFSVRLYALVALKKLWTVCKVLSVEEFDALTPVIESSLHQVESMHGAGNAKKNWQRIQEHFFFATFHPLKDYCLETIFYILPRLSGLIEDEWITIDKFTRFTDVPLAAGFQWYLSQTQLSKLKPGDWSQQDIGTNLVEADNQAEWTDVQKKIIPWNSRVSDLDLELLFQDRAARLGKSISRLIVVASLIDKPTNLGGLCRTCEVFGASVLVVGSLQCISDKQFQHLSVSAEQWLPLVEVKPPQLIDYLQQKKTEGYTIIGVEQTAKSLDLTQYCFPEKSLLLLGNEREGIPANLIQQLDVCVEIPQQGIIRSLNVHVSGALLIWEYTRQQLLSHGDTKP

SEQ ID NO: 839872 - protein, 1386 aa, Homo sapiens
MEWVLAEALLSQSRDPRALLGALCQGEASAERVETLRFLLQRLEDEEARGSGGAGALPEAAREVAAGYLVPLLRSLRGRPAGGPDPSLQPRHRRRVLRAAGAALRSCVRLAGRPQLAAALAEEALRDLLAGWRAPGAEAAVEVLAAVGPCLRPREDGPLLERVAGTAVALALGGGGDGDEAGPAEDAAALVAGRLLPVLVQCGGAALRAVWGGLAAPGASLGSGRVEEKLLVLSALAEKLLPEPGGDRARGAREAGPDARRCWRFWRTVQAGLGQADALTRKRARYLLQRAVEVSAELGADCTCGPQEGNGPSLFWWSERKKDELLKFWENYILIMETLEGNQIHVIKPVLPKLNNLFEYAVSEENGCWLFHPSWHMCIYKRMFESENKILSKEGVIHFLELYETKILPFSPEFSEFIIGPLMDALSESSLYSRSPGQPIGSCSPLGLKLQKFLVTYISLLPEEIKSSFLLKFIRKMTSRHWCAVPILFLSKALANVPRHKALGIDGLLALRDVIHCTMITHQILLRGAAQCYLLQTAMNLLDVEKVSLSDVSTFLMSLRQEESLGRGTSLWTELCDWLRVNESYFKPSPTCSSIGLHKTSLNAYVKSIVQEYVKSSAWETGENCFMPDWFEAKLVSLMVLLAVDVEGMKTQYSGKQRTENVLRIFLDPLLDVLMKFSTNAYMPLLKTDRCLQLLLKLLNTCRLKGSSAQDDEVSTVLQNFFMSTTESISEFILRRLTMNELNSVSDLDRCHLYLMVLTELINLHLKVGWKRGNPIWRVISLLKNASIQHLQEMDSGQEPTVGSQIQRVVSMAALAMVCEAIDQKPELQLDSLHAGPLESFLSSLQLNQTLQKPHAEEQSSYAHPLECSSVLEESSSSQGWGKIVAQYIHDQWVCLSFLLKKYHTLIPTTGSEILEPFLPAVQMPIRTLQSALEALTVLSSDQVLPVFHCLKVLVPKLLTSSESLCIESFDMAWKIISSLSNTQLIFWANLKAFVQFVFDNKVLTIAAKIKGQAYFKIKEIMYKIIEMSAIKTGVFNTLISYCCQSWIVSASNVSQGSLSSAKNYSELILEACIFGTVFRRDQRLVQDVQTFIENLGHDCAANIVMENTKREDHYVRICAVKFLCLLDGSNMSHKLFIEDLAIKLLDKDELVSKSKKRYYVNSLQHRVKNRVWQTLLVLFPRLDQNFLNGIIDRIFQAGFTNNQASIKYFIEWIIILILHKFPQFLPKFWDCFSYGEENLKTSICTFLAVLSHLDIITQNIPEKKLILKQALIVVLQWCFNHNFSVRLYALVALKKLWTVCKVLSVEEFDALTPVIESSLHQVESMHGAGNAKKNWQRIQEHFFFATFHPLKDYCLEVLIWLKQITKQSGPTFRRRLSRGTVVFPT

SEQ ID NO: 839873 - protein, 1677 aa, Homo sapiens
MEWVLAEALLSQSRDPRALLGALCQGEASAERVETLRFLLQRLEDEEARGSGGAGALPEAAREVAAGYLVPLLRSLRGRPAGGPDPSLQPRHRRRVLRAAGAALRSCVRLAGRPQLAAALAEEALRDLLAGWRAPGAEAAVEVLAAVGPCLRPREDGPLLERVAGTAVALALGGGGDGDEAGPAEDAAALVAGRLLPVLVQCGGAALRAVWGGLAAPGASLGSGRVEEKLLVLSALAEKLLPEPGGDRARGAREAGPDARRCWRFWRTVQAGLGQADALTRKRARYLLQRAVEVSAELGADCTCGPQEGNGPSLFWWSERKKDELLKFWENYILIMETLEGNQIHVIKPVLPKLNNLFEYAVSEENGCWLFHPSWHMCIYKRMFESENKILSKEGVIHFLELYETKILPFSPEFSEFIIGPLMDALSESSLYSRSPGQPIGSCSPLGLKLQKFLVTYISLLPEEIKSSFLLKFIRKMTSRHWCAVPILFLSKALANVPRHKALGIDGLLALRDVIHCTMITHQILLRGAAQCYLLQTAMNLLDVEKVSLSDVSTFLMSLRQEESLGRGTSLWTELCDWLRVNESYFKPSPTCSSIGLHKTSLNAYVKSIVQEYVKSSAWETGENCFMPDWFEAKLVSLMVLLAVDVEGMKTQYSGKQRTENVLRIFLDPLLDVLMKFSTNAYMPLLKTDRCLQLLLKLLNTCRLKGSSAQDDEVSTVLQNFFMSTTESISEFILRRLTMNELNSVSDLDRCHLYLMVLTELINLHLKVGWKRGNPIWRVISLLKNASIQHLQEMDSGQEPTVGSQIQRVVSMAALAMVCEAIDQKPELQLDSLHAGPLESFLSSLQLNQTLQKPHAEEQSSYAHPLECSSVLEESSSSQGWGKIVAQYIHDQWVCLSFLLKKYHTLIPTTGSEILEPFLPAVQMPIRTLQSALEALTVLSSDQVLPVFHCLKVLVPKLLTSSESLCIESFDMAWKIISSLSNTQLIFWANLKAFVQFVFDNKVLTIAAKIKGQAYFKIKEIMYKIIEMSAIKTGVFNTLISYCCQSWIVSASNVSQGSLSSAKNYSELILEACIFGTVFRRDQRLVQDVQTFIENLGHDCAANIVMENTKREDHYVRICAVKFLCLLDGSNMSHKLFIEDLAIKLLDKDELVSKSKKRYYVNSLQHRVKNRVWQTLLVLFPRLDQNFLNGIIDRIFQAGFTNNQASIKYFIEWIIILILHKFPQFLPKFWDCFSYGEENLKTSICTFLAVLSHLDIITQNIPEKKLILKQALIVVLQWCFNHNFSVRLYALVALKKLWTVCKVLSVEEFDALTPVIESSLHQVESMHGAGQNHTWKLSIKQVTWMGWGAVQDPVSVKPPRWFPCLPLFPRTCHGAEAGCSVISISRNAKKNWQRIQEHFFFATFHPLKDYCLETIFYILPRLSGLIEDEWITIDKFTRFTDVPLAAGFQWYLSQTQLSKLKPGDWSQQDIGTNLVEADNQAEWTDVQKKIIPWNSRVSDLDLELLFQDRAARLGKSISRLIVVASLIDKPTNLGGLCRTCEVFGASVLVVGSLQCISDKQFQHLSVSAEQWLPLVEVKPPQLIDYLQQKKTEGYTIIGVEQTAKSLDLTQYCFPEKSLLLLGNEREGIPANLIQQLDVCVEIPQQGIIRSLNVHVSGALLIWEYTRQQLLSHGDTKP

SEQ ID NO: 839874 - protein, 296 aa, Homo sapiens
MHGAGNAKKNWQRIQEHFFFATFHPLKDYCLETIFYILPRLSGLIEDEWITIDKFTRFTDVPLAAGFQWYLSQTQLSKLKPGDWSQQDIGTNLVEADNQAEWTDVQKKIIPWNSRVSDLDLELLFQDRAARLGKSISRLIVVASLIDKPTNLGGLCRTCEVFGASVLVVGSLQCISDKQFQHLSVSAEQWLPLVEVKPPQLIDYLQQKKTEGYTIIGVEQTAKSLDLTQYCFPEKSLLLLGNEREGIPANLIQQLDVCVEIPQQGIIRSLNVHVSGALLIWEYTRQQLLSHGDTKP

SEQ ID NO: 839875 - protein, 1621 aa, Homo sapiens; identical to SEQ ID NO: 839871

SEQ ID NO: 839876 - protein, 1621 aa, Homo sapiens; identical to SEQ ID NO: 839871

SEQ ID NO: 839877 - protein, 1362 aa, Homo sapiens
MEWVLAEALLSQSRDPRALLGALCQGEASAERVETLRFLLQRLEDEEARGSGGAGALPEAAREVAAGYLVPLLRSLRGRPAGGPDPSLQPRHRRRVLRAAGAALRSCVRLAGRPQLAAALAEEALRDLLAGWRAPGAEAAVEVLAAVGPCLRPREDGPLLERVAGTAVALALGGGGDGDEAGPAEDAAALVAGRLLPVLVQCGGAALRAVWGGLAAPGASLGSGRVEEKLLVLSALAEKLLPEPGGDRARGAREAGPDARRCWRFWRTVQAGLGQADALTRKRARYLLQRAVEVSAELGADCTCGPQEGNGPSLFWWSERKKDELLKFWENYILIMETLEGNQIHVIKPVLPKLNNLFEYAVSEENGCWLFHPSWHMCIYKRMFESENKILSKEGVIHFLELYETKILPFSPEFSEFIIGPLMDALSESSLYSRSPGQPIGSCSPLGLKLQKFLVTYISLLPEEIKSSFLLKFIRKMTSRHWCAVPILFLSKALANVPRHKALGIDGLLALRDVIHCTMITHQILLRGAAQCYLLQTAMNLLDVEKVSLSDVSTFLMSLRQEESLGRGTSLWTELCDWLRVNESYFKPSPTCSSIGLHKTSLNAYVKSIVQEYVKSSAWETGENCFMPDWFEAKLVSLMVLLAVDVEGMKTQYSGKQRTENVLRIFLDPLLDVLMKFSTNAYMPLLKTDRCLQLLLKLLNTCRLKGSSAQDDEVSTVLQNFFMSTTESISEFILRRLTMNELNSVSDLDRCHLYLMVLTELINLHLKVGWKRGNPIWRVISLLKNASIQHLQEMDSGQEPTVGSQIQRVVSMAALAMVCEAIDQKPELQLDSLHAGPLESFLSSLQLNQTLQKPHAEEQSSYAHPLECSSVLEESSSSQGWGKIVAQYIHDQWVCLSFLLKKYHTLIPTTGSEILEPFLPAVQMPIRTLQSALEALTVLSSDQVLPVFHCLKVLVPKLLTSSESLCIESFDMAWKIISSLSNTQLIFWANLKAFVQFVFDNKVLTIAAKIKGQAYFKIKEIMYKIIEMSAIKTGVFNTLISYCCQSWIVSASNVSQGSLSSAKNYSELILEACIFGTVFRRDQRLVQDVQTFIENLGHDCAANIVMENTKREDHYVRICAVKFLCLLDGSNMSHKLFIEDLAIKLLDKDELVSKSKKRYYVNSLQHRVKNRVWQTLLVLFPRLDQNFLNGIIDRIFQAGFTNNQASIKYFIEWIIILILHKFPQFLPKFWDCFSYGEENLKTSICTFLAVLSHLDIITQNIPEKKLILKQALIVVLQWCFNHNFSVRLYALVALKKLWTVCKVLSVEEFDALTPVIESSLHQVESMHGAGNAKKNWQRIQEHFFFATFHPLKDYCLEAVSGL

SEQ ID NO: 839878 - protein, 70 aa, Homo sapiens
VCYRKTNLSSIFFLRNEREGIPANLIQQLDVCVEIPQQGIIRSLNVHVSGALLIWEYTRQQLLSHGDTKP

SEQ ID NO: 839879 - protein, 1362 aa, Homo sapiens; identical to SEQ ID NO: 839877

SEQ ID NO: 839880 - protein, 542 aa, Homo sapiens
NWWANYINIIRRGKGNLVGNDSLNFPRYSTKREDHYVRICAVKFLCLLDGSNMSHKLFIEDLAIKLLDKDELVSKSKKRYYVNSLQHRVKNRVWQTLLVLFPRLDQNFLNGIIDRIFQAGFTNNQASIKYFIEWIIILILHKFPQFLPKFWDCFSYGEENLKTSICTFLAVLSHLDIITQNIPEKKLILKQALIVVLQWCFNHNFSVRLYALVALKKLWTVCKVLSVEEFDALTPVIESSLHQVESMHGAGNAKKNWQRIQEHFFFATFHPLKDYCLETIFYILPRLSGLIEDEWITIDKFTRFTDVPLAAGFQWYLSQTQLSKLKPGDWSQQDIGTNLVEADNQAEWTDVQKKIIPWNSRVSDLDLELLFQDRAARLGKSISRLIVVASLIDKPTNLGGLCRTCEVFGASVLVVGSLQCISDKQFQHLSVSAEQWLPLVEVKPPQLIDYLQQKKTEGYTIIGVEQTAKSLDLTQYCFPEKSLLLLGNEREGIPANLIQQLDVCVEIPQQGIIRSLNVHVSGALLIWEYTRQQLLSHGDTKP

SEQ ID NO: 839881 - protein, 296 aa, Homo sapiens; identical to SEQ ID NO: 839874

SEQ ID NO: 839882 - protein, 1271 aa, Homo sapiens
MEWVLAEALLSQSRDPRALLGALCQGEASAERVETLRFLLQRLEDEEARGSGGAGALPEAAREVAAGYLVPLLRSLRGRPAGGPDPSLQPRHRRRVLRAAGAALRSCVRLAGRPQLAAALAEEALRDLLAGWRAPGAEAAVEVLAAVGPCLRPREDGPLLERVAGTAVALALGGGGDGDEAGPAEDAAALVAGRLLPVLVQCGGAALRAVWGGLAAPGASLGSGRVEEKLLVLSALAEKLLPEPGGDRARGAREAGPDARRCWRFWRTVQAGLGQADALTRKRARYLLQRAVEVSAELGADCTCGPQEGNGPSLFWWSERKKDELLKFWENYILIMETLEGNQIHVIKPVLPKLNNLFEYAVSEENGCWLFHPSWHMCIYKRMFESENKILSKEGVIHFLELYETKILPFSPEFSEFIIGPLMDALSESSLYSRSPGQPIGSCSPLGLKLQKFLVTYISLLPEEIKSSFLLKFIRKMTSRHWCAVPILFLSKALANVPRHKALGIDGLLALRDVIHCTMITHQILLRGAAQCYLLQTAMNLLDVEKVSLSDVSTFLMSLRQEESLGRGTSLWTELCDWLRVNESYFKPSPTCSSIGLHKTSLNAYVKSIVQEYVKSSAWETGENCFMPDWFEAKLVSLMVLLAVDVEGMKTQYSGKQRTENVLRIFLDPLLDVLMKFSTNAYMPLLKTDRCLQLLLKLLNTCRLKGSSAQDDEVSTVLQNFFMSTTESISEFILRRLTMNELNSVSDLDRCHLYLMVLTELINLHLKVGWKRGNPIWRVISLLKNASIQHLQEMDSGQEPTVGSQIQRVVSMAALAMVCEAIDQKPELQLDSLHAGPLESFLSSLQLNQTLQKPHAEEQSSYAHPLECSSVLEESSSSQGWGKIVAQYIHDQWVCLSFLLKKYHTLIPTTGSEILEPFLPAVQMPIRTLQSALEALTVLSSDQVLPVFHCLKVLVPKLLTSSESLCIESFDMAWKIISSLSNTQLIFWANLKAFVQFVFDNKVLTIAAKIKGQAYFKIKEIMYKIIEMSAIKTGVFNTLISYCCQSWIVSASNVSQGSLSSAKNYSELILEACIFGTVFRRDQRLVQDVQTFIENLGHDCAANIVMENTKREDHYVRICAVKFLCLLDGSNMSHKLFIEDLAIKLLDKDELVSKSKKRYYVNSLQHRVKNRVWQTLLVLFPRLDQNFLNGIIDRIFQAGFTNNQASIKYFIEWIIILILHKFPQFLPKFWDCFSYGEENLKTSICTFLAVLSHLDIITQNIPEKVSLFVRI

SEQ ID NO: 839883 - protein, 42 aa, Homo sapiens
KNPVHESLSPAHTPGDGNWVPPPEGALEDLWTYTETSTAPLG

SEQ ID NO: 839884 - protein, 88 aa, Homo sapiens
MEQEMTRLHRRVSEVEAVLSQKEVELKASETQRSLLEQDLATYITECSSLKRSLEQARMEVSQEDDKALQLLHDIREQSRKLQEIKEQ

SEQ ID NO: 839885 - protein, 113 aa, Homo sapiens
PQNGGSTGSLHPESGKATGTQLYHVREATGATSSKATRVEFSKALGAHPLHQCALDMGHEVKGDYLGALRFNDCPAGFLTYMGHVDPFFLPTSPLWNGNVYAMSALSLYFGSQ

SEQ ID NO: 839886 - protein, 116 aa, Homo sapiens
MEGLRTYFLNAFDPGTDYLYLFPFSFTVTFQHCLTVRWAFESLQVPQNRPERWASHPLPTHVPAYLPDNQVRCLRVASFHILTSVWLTFGQRPPLGLAPPPSNADTVVRPQQYRRQ

SEQ ID NO: 839887 - protein, 242 aa, Homo sapiens
SPDFWDVMPNRHLSWHGGPSALPSSPQVMDSSMPLIGEHVEEDRQLMADLVVSKMSQLPMPGGTAPSPLRPWAPQIKSAKSPGQAQLGPQLGQPQPRPPPQGGPRQAQSPQPQRSGSPSQQRLSPQGQQPLSPQSGSPQQQRSPGSPQLSRASSGSSPNQASKPGATLASQPRPPVQGRSTSQQGEESKKPAPPHPHLNKSQSLTNSLSTSDTSQRGTPSEDEAKAETIRNLRKSFASLFSD

SEQ ID NO: 839888 - protein, 580 aa, Homo sapiens
MNFLRRRLSDSSFMANLPNGYMTDLQRPDSSTSSPASPAMERRHPQPLAASFSSPGSSLFSSLSSAMKQAPQATSGLMEPPGPSTPIVQRPRILLVIDDAHTDWSKYFHGKKVNGEIEIRVEQAEFSELNLAAYVTGGCMVDMQVVRNGTKVVSRSFKPDFILVRQHAYSMALGEDYRSLVIGLQYGGLPAVNSLYSVYNFCSKPWVFSQLIKIFHSLGPEKFPLVEQTFFPNHKPMVTAPHFPVVVKLGHAHAGMGKIKVENQLDFQDITSVVAMAKTYATTEAFIDSKYDIRIQKIGSNYKAYMRTSISGNWKANTGSAMLEQVAMTERYRLWVDSCSEMFGGLDICAVKAVHSKDGRDYIIEVMDSSMPLIGEHVEEDRQLMADLVVSKMSQLPMPGGTAPSPLRPWAPQIKSAKSPGQAQLGPQLGQPQPRPPPQGGPRQAQSPQPQRSGSPSQQRLSPQGQQPLSPQSGSPQQQRSPGSPQLSRASSGSSPNQASKPGATLASQPRPPVQGRSTSQQGEESKKPAPPHPHLNKSQSLTNSLSTSDTSQRGTPSEDEAKAETIRNLRKSFASLFSD

SEQ ID NO: 839889 - protein, 327 aa, Homo sapiens
MNFLRRRLSDSSFMANLPNGYMTDLQRPDSSTSSPASPAMERRHPQPLAASFSSPGSSLFSSLSSAMKQAPQATSGLMEPPGPSTPIVQRPRILLVIDDAHTDWSKYFHGKKVNGEIEIRVEQAEFSELNLAAYVTGGCMVDMQVVRNGTKVVSRSFKPDFILVRQHAYSMALGEDYRSLVIGLQYGGLPAVNSLYSVYNFCSKPWVFSQLIKIFHSLGPEKFPLVEQTFFPNHKPMVSPSFPSPGPDHPALFPSRVHALNHPTMWPLPVKGTIRIQRALKEVTYTGSWTRRKIAKRLPGDGSGKIQRKKFIKRLNKPVKDKKDSKR

SEQ ID NO: 839890 - protein, 194 aa, Homo sapiens
PGLLGCDAQPPSLLAWGSLSSPFLPTGNGQLNAADWRACGRGQTADGRPCCLQNEPAPDARRHSALPPQTLGGPRQAQSPQPQRSGSPSQQRLSPQGQQPLSPQSGSPQQQRSPGSPQLSRASSGSSPNQASKPGATLASQPRPPVQGRSTSQQGEESKKPAPPHPHLKSVASPPMTEPPEAGPESYSSYTPVP

SEQ ID NO: 839891 - protein, 210 aa, Homo sapiens
MPLIGEHVEEDRQLMADLVVSKMSQLPMPGGTAPSPLRPWAPQIKSAKSPGQAQLGPQLGQPQPRPPPQGGPRQAQSPQPQRSGSPSQQRLSPQGQQPLSPQSGSPQQQRSPGSPQLSRASSGSSPNQASKPGATLASQPRPPVQGRSTSQQGEESKKPAPPHPHLNKSQSLTNSLSTSDTSQRGTPSEDEAKAETIRNLRKSFASLFSD

SEQ ID NO: 839892 - protein, 251 aa, Homo sapiens
MNFLRRRLSDSSFMANLPNGYMTDLQRPDSSTSSPASPAMERRHPQPLAASFSSPGSSLFSSLSSAMKQAPQATSGLMEPPGPSTPIVQRPRILLVIDDAHTDWSKYFHGKKVNGEIEIRVEQAEFSELNLAAYVTGGCMVDMQVVRNGTKVVSRSFKPDFILVRQHAYSMALGEDYRSLVIGLQYGGLPAVNSLYSVYNFCSKPWVFSQLIKIFHSLGPEKFPLVEQTFFPNHKPMVSALFYSVSLHDAE

SEQ ID NO: 839893 - protein, 170 aa, Homo sapiens
MQNRTGLILCALALLMGFLMVCLGAFFISWGSIFDCQGSLIAAYLLLPLGFVILLSGIFWSNYRQVTESKGVLRHMLRQHLAHGALPVATVDRPDFYPPAYEESLEVEKQSCPAEREASGIPPPLYTETGLEFQDGNDSHPEAPPSYRESIAGLVVTAISEDAQRRGQEC

SEQ ID NO: 839894 - protein, 105 aa, Homo sapiens
MQNRTGLILCALALLMGFLMVCLGAFFISWGSIFDCQGSLIAAYLLLPLGFVILLSGIFWSNYRQVTESKGVLRHMLRQHLAHGALPVATVDSAALLKIMCKQLL

SEQ ID NO: 839895 - protein, 345 aa, Homo sapiens
MYKDCIESTGDYFLLCDAEGPWGIILESLAILGIVVTILLLLAFLFLMRKIQDCSQWNVLPTQLLFLLSVLGLFGLAFAFIIELNQQTAPVRYFLFGVLFALCFSCLLAHASNLVKLVRGCVSFSWTTILCIAIGCSLLQIIIATEYVTLIMTRGMMFVNMTPCQLNVDFVVLLVYVLFLMALTFFVSKATFCGPCENWKQHGRLIFITVLFSIIIWVVWISMLLRGNPQFQRQPQWDDPVVCIALVTNAWVFLLLYIVPELCILYRSCRQECPLQGNACPVTAYQHSFQVENQELSRARDSDGAEEDVALTSYGTPIQPQTVDPTQECFIPQAKLSPQQDAGGV

SEQ ID NO: 839896 - protein, 51 aa, Homo sapiens
MKPHIFMPAAKCLLCGAAVLHTAHTPPGTQCSPVSPHCMNGRSNDRRGLTV

SEQ ID NO: 839897 - protein, 232 aa, Homo sapiens
MQAEITFKKPMPTKVVFMSLCKSFWDCGLVALDDITIQLGSCSSSEKLPPPPGECTFEQDECTFTQEKRNRSSWHRRRGETPTSYTGPKGDHTTGVGYYMYIEASHMVYGQKARLLSRPLRGVSGKHCLTFFYHMYGGGTGLLSVYLKKEEDSEESLLWRRRGEQSISWLRALIEYSCERQHQIIFEAIRGVSIRSDIAIDDVKFQAGPCGEMEDTTQQSSGYSEDLNEIEY

SEQ ID NO: 839898 - protein, 215 aa, Homo sapiens [sequence omitted]

SEQ ID NO: 839899 - protein, 232 aa, Homo sapiens; identical to SEQ ID NO: 839897

SEQ ID NO: 839900 - protein, 306 aa, Homo sapiens
YYLLANTKFTSQPGYIGRLYGPSLPGNLQYCLRFHYAIYGFLKMSDTLAVYIFEENHVVQEKIWSVLESPRGVWMQAEITFKKPMPTKVVFMSLCKSFWDCGLVALDDITIQLGSCSSSEKLPPPPGECTFEQDECTFTQEKRNRSSWHRRRGETPTSYTGPKGDHTTGVGYYMYIEASHMVYGQKARLLSRPLRGVSGKHCLTFFYHMYGGGTGLLSVYLKKEEDSEESLLWRRRGEQSISWLRALIEYSCERQHQIIFEAIRGVSIRSDIAIDDVKFQAGPCGEMEDTTQQSSGYSEDLNEIEY

SEQ ID NO: 839901 - protein, 122 aa, Homo sapiens
MPLALSILTCPHLVLQEVFHRELRSNSMKTWGLRAAGWMAMFMGLNLMTRILYTLVDWFPVFRDLVNIGLKAFAFCVATSLTLLTVAAGWLFYRPLWALLIAGLALVPILVARTRVPAKKLE

SEQ ID NO: 839902 - protein, 182 aa, Homo sapiens
IRRGDFFYHSENPKYPEVGDLRVSFSYAGLSGDDPDLGPAHVVTVIARQRGDQLVPFSTKSGDTLLLLHHGDFSAEEVFHRELRSNSMKTWGLRAAGWMAMFMGLNLMTRILYTLVDWFPVFRDLVNIGLKAFAFCVATSLTLLTVAAGWLFYRPLWALLIAGLALVPILVARTRVPAKKLE

SEQ ID NO: 839903 - protein, 182 aa, Homo sapiens; identical to SEQ ID NO: 839902

SEQ ID NO: 839904 - protein, 65 aa, Homo sapiens
MVPAAVGRPAVVAGEAAGAAITVVGPLSPMSPRQATEPPPPLHDQAHKNPRVGQTGAEDGETKGD

SEQ ID NO: 839905 - protein, 288 aa, Homo sapiens
ACAEETPGLLTSGIRSFFPEQGPPRRKRMAAAALRRFWSRRRAEAGDAVVAKPGVWARLGSWARALLRDYAEACRDASAEARARPGRAAVYVGLLGGAAACFTLAPSEGAFEEALLEASGTLLLLAPATRNRESEAFVQRLLWLRGRGRLRYVNLGLCSLVYEAPFDAQASLYQARCRYLQPRWTDFPGRVLDVGFVGRWWVLGAWMRDCDINDDEFLHLPAHLRVVGPQQLHSETNERLFDEKYKPVVLTDDQVDQALWEEQVLQKEKKDRLALSQAHSLVQAEAPR

SEQ ID NO: 839906 - protein, 288 aa, Homo sapiens; identical to SEQ ID NO: 839905

SEQ ID NO: 839907 - protein, 284 aa, Homo sapiens
SEEQELEPWPSPKKARSGRWLRNGFKRKMEEPEEPADSGQSLVPVYIYSPEYVSMCDSLAKIPKRASMVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKKDEASGFCYLNDAVLGILRLRRKFERILYVDLDLHHGDGVEDAFSFTSKVMTVSLHKFSPGFFPGTGDVSDVGLGKGRYYSVNVPIQDGIQDEKYYQICERYEPPAPNPGL

SEQ ID NO: 839908 - protein, 184 aa, Homo sapiens
SEEQELEPWPSPKKARSGRWLRNGFKRKMEEPEEPADSGQSLVPVYIYSPEYVSMCDSLAKIPKRASMVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKKYEPPAPNPGL

SEQ ID NO: 839909 - protein, 92 aa, Homo sapiens
SEEQELEPWPSPKKARSGRWLRNGFKRKMEEPEEPADSGQSLVPVYIYSPEYVSMCDSLAKIPKRASMVHSLIEAYALHKQMRSWMRAVTSL

SEQ ID NO: 839910 - protein, 403 aa, Homo sapiens
MGFGGGGGGGGRKSVRKRRGHWAGGNLQKFRVAVSDTYSCIRRKCSHIVSESAACLFGTSNGQASMVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKKDEASGFCYLNDAVLGILRLRRKFERILYVDLDLHHGDGVEDAFSFTSKVMTVSLHKFSPGFFPGTGDVSDVGLGKGRYYSVNVPIQDGIQDEKYYQICESVLKEVYQAFNPKAVVLQLGADTIAGDPMCSFNMTPVGIGKCLKYILQWQLATLILGGGGYNLANTARCWTYLTGVILGKTLSSEIPDHEFFTAYGPDYVLEITPSCRPDRNEPHRIQQILNYIKGNLKHVV

SEQ ID NO: 839911 - protein, 314 aa, Homo sapiens
SEEQELEPWPSPKKARSGRWLRNGFKRKMEEPEEPADSGQSLVPVYIYSPEYVSMCDSLAKIPKRASMVHSLIEAYALHKQMRDEASGFCYLNDAVLGILRLRRKFERILYVDLDLHHGDGVEDAFSFTSKVMTVSLHKFSPGFFPGTGDVSDVGLGKGRYYSVNVPIQDGIQDEKYYQICESVLKEVYQAFNPKAVVLQLGADTIAGDPMCSFNMTPVGIGKCLKYILQWQLATLILGGGGYNLANTARCWTYLTGVILGKTLSSEIPDHEFFTAYGPDYVLEITPSCRPDRNEPHRIQQILNYIKGNLKHVV

SEQ ID NO: 839912 - protein, 178 aa, Homo sapiens
SEEQELEPWPSPKKARSGRWLRNGFKRKMEEPEEPADSGQSLVPVYIYSPEYVSMCDSLAKIPKRASMVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKNSSST

SEQ ID NO: 839913 - protein, 405 aa, Homo sapiens
SEEQELEPWPSPKKARSGRWLRNGFKRKMEEPEEPADSGQSLVPVYIYSPEYVSMCDSLAKIPKRASMVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKKDEASGFCYLNDAVLGILRLRRKFERILYVDLDLHHGDGVEDAFSFTSKVMTVSLHKFSPGFFPGTGDVSDVGLGKGRYYSVNVPIQDGIQDEKYYQICESVLKEVYQAFNPKAVVLQLGADTIAGDPMCSFNMTPVGIGKCLKYILQWQLATLILGGGGYNLANTARCWTYLTGVILGKTLSSEIPDHEFFTAYGPDYVLEITPSCRPDRNEPHRIQQILNYIKGNLKHVV

SEQ ID NO: 839914 - protein, 193 aa, Homo sapiens
SEEQELEPWPSPKKARSGRWLRNGFKRKMEEPEEPADSGQSLVPVYIYSPEYVSMCDSLAKIPKRASMVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKKERRVCMWHFTRHSEEIQVK

SEQ ID NO: 839915 - protein, 379 aa, Homo sapiens
SEEQELEPWPSPKKARSGRWLRNGFKRKMEEPEEPADSGQSLVPVYIYSPEYVSMCDSLAKIPKRASMVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKKDEASGFCYLNDAVLGILRLRRKFERILYVDLDLHHGDGTGDVSDVGLGKGRYYSVNVPIQDGIQDEKYYQICESVLKEVYQAFNPKAVVLQLGADTIAGDPMCSFNMTPVGIGKCLKYILQWQLATLILGGGGYNLANTARCWTYLTGVILGKTLSSEIPDHEFFTAYGPDYVLEITPSCRPDRNEPHRIQQILNYIKGNLKHVV

SEQ ID NO: 839916 - protein, 174 aa, Homo sapiens
SEEQELEPWPSPKKARSGRWLRNGFKRKMEEPEEPADSGQSLVPVYIYSPEYVSMCDSLAKIPKRASMVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKK

SEQ ID NO: 839917 - protein, 123 aa, Homo sapiens
MSRLMVSIITSMGIRGVGVPCGKKWARAFLILERRPIITAPAHKGMAMARFIDSWVVGVNEQGRSPRRAILRLRGGVEWPQEHKCLRIHLLLKGAEAFSGTYADLAQHLSEKPREGLLKTIIL

SEQ ID NO: 839918 - protein, 35 aa, Homo sapiens
MESVPFTSPLSPPWLTSASTLQPAPMLPQMLQHNG

SEQ ID NO: 839919 - protein, 272 aa, Homo sapiens
MSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSVQTFADKSKQEALKNDLVEALKRKQQC

SEQ ID NO: 839920 - protein, 336 aa, Homo sapiens
LAAWGAGPGRAGAGKEGGGGPARGEGGADPDVHSWAPGEVEAPGPAAGGRATDAGTGTAAAAATMSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSVQTFADKSKQEALKNDLVEALKRKQQC

SEQ ID NO: 839921 - protein, 336 aa, Homo sapiens; identical to SEQ ID NO: 839920

SEQ ID NO: 839922 - protein, 260 aa, Homo sapiens
MRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSVQTFADKSKQEALKNDLVEALKRKQQC

SEQ ID NO: 839923 - protein, 292 aa, Homo sapiens
GWYWSRIGRIGTGTAAAAATMSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSVQTFADKSKQEALKNDLVEALKRKQQC

SEQ ID NO: 839924 - protein, 260 aa, Homo sapiens; identical to SEQ ID NO: 839922

SEQ ID NO: 839925 - protein, 302 aa, Homo sapiens
MGLPQTGPDRRPSIAGWAFLPFPPQYIDATMSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSVQTFADKSKQEALKNDLVEALKRKQQC

SEQ ID NO: 839926 - protein, 413 aa, Homo sapiens
ALHQGWGGPGAVPSQLPLLGRPPRSQRGKGGHRCAQKAARCSAGPSRGCRRGCCACEAFCRAGRGPRRPGLSGSRGARMGGPQDKDERTIALVRPWPWGATRPWIQQYGLDTMHPSRRSLPFPLNCQLARVGTADYGSPSDQSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSVQTFADKSKQEALKNDLVEALKRKQQC

SEQ ID NO: 839927 - protein, 185 aa, Homo sapiens
MPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSVQTFADKSKQEALKNDLVEALKRKQQC

SEQ ID NO: 839928 - protein, 336 aa, Homo sapiens; identical to SEQ ID NO: 839920

SEQ ID NO: 839929 - protein, 336 aa, Homo sapiens; identical to SEQ ID NO: 839920

SEQ ID NO: 839930 - protein, 188 aa, Homo sapiens
CFFLCVKPGATRRSLTWKNLAEYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSVQTFADKSKQEALKNDLVEALKRKQQC

SEQ ID NO: 839931 - protein, 179 aa, Homo sapiens
VSVTSVVEQHALTVSRLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSVQTFADKSKQEALKNDLVEALKRKQQC

SEQ ID NO: 839932 - protein, 167 aa, Homo sapiens
MSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLWSDPHKEGWRWIKEDQRLLGFHPRGRSAGEIQRSHRPLQVDLHGDAVAADQQIWLWHHEPRRQPYQTDGEG

SEQ ID NO: 839933 - protein, 336 aa, Homo sapiens; identical to SEQ ID NO: 839920

SEQ ID NO: 839934 - protein, 336 aa, Homo sapiens; identical to SEQ ID NO: 839920

SEQ ID NO: 839935 - protein, 168 aa, Homo sapiens
MPSARLRKLEVEANNAFDQYRDLYFEGGVSSVYLWDLDHGFGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSVQTFADKSKQEALKNDLVEALKRKQQC

SEQ ID NO: 839936 - protein, 336 aa, Homo sapiens; identical to SEQ ID NO: 839920

SEQ ID NO: 839937 - protein, 336 aa, Homo sapiens; identical to SEQ ID NO: 839920

SEQ ID NO: 839938 - protein, 92 aa, Homo sapiens
DTVSLIAYEYTDQKIDMEKDETVSDCSPHIANIGRLVEDMENKIRSTLNEIYFGKTKDIVNGLRSVQTFADKSKQEALKNDLVEALKRKQQC

SEQ ID NO: 839939 - protein, 336 aa, Homo sapiens; identical to SEQ ID NO: 839920

SEQ ID NO: 839940 - protein, 317 aa, Homo sapiens
LAAWGAGPGRAGAGKEGGGGPARGEGGADPDVHSWAPGEVEAPGPAAGGRATDAGTGTAAAAATMSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLSCLRWDPLDD

SEQ ID NO: 839941 - protein, 158 aa, Homo sapiens
MSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLHPPPAPSLLLPHLALSSLHISIETVWFLFTRAPRLPPCPPIYRHKIHCLPASLPSHLFGTLV

SEQ ID NO: 839942 - protein, 112 aa, Homo sapiens
MSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLCF

SEQ ID NO: 839943 - protein, 112 aa, Homo sapiens; identical to SEQ ID NO: 839942

SEQ ID NO: 839944 - protein, 336 aa, Homo sapiens; identical to SEQ ID NO: 839920

SEQ ID NO: 839945 - protein, 336 aa, Homo sapiens; identical to SEQ ID NO: 839920

SEQ ID NO: 839946 - protein, 336 aa, Homo sapiens; identical to SEQ ID NO: 839920

SEQ ID NO: 839947 - protein, 336 aa, Homo sapiens; identical to SEQ ID NO: 839920

SEQ ID NO: 839948 - protein, 298 aa, Homo sapiens
AAAPGEPGGRRRAPPTPTPRLAAAATMSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSVQTFADKSKQEALKNDLVEALKRKQQC

SEQ ID NO: 839949 - protein, 272 aa, Homo sapiens; identical to SEQ ID NO: 839919

SEQ ID NO: 839950 - protein, 185 aa, Homo sapiens; identical to SEQ ID NO: 839927

SEQ ID NO: 839951 - protein, 336 aa, Homo sapiens; identical to SEQ ID NO: 839920

SEQ ID NO: 839952 - protein, 123 aa, Homo sapiens
ALHQGWGGPGAVPSQLPLLGRPPRSQRGKGGHRCAQKAARCSAGPSRGCRRGCCACEAFCRAGRGPRRPGLSGSRGARMGGPQDKDERTIALVRPWPWGATRPWIQHMAWTRCTQAGAASPSL

SEQ ID NO: 839953 - protein, 184 aa, Homo sapiens
PRGSRIEISTVEATMPLTSIEMYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSVQTFADKSKQEALKNDLVEALKRKQQC

SEQ ID NO: 839954 - protein, 179 aa, Homo sapiens
VHKIFLFYIFYTNVPKRYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSVQTFADKSKQEALKNDLVEALKRKQQC

SEQ ID NO: 839955 - protein, 255 aa, Homo sapiens
MSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSVQTFADKSKQEALKNDLVEALKRKQQC

SEQ ID NO: 839956 - protein, 341 aa, Homo sapiens
LAAWGAGPGRAGAGKEGGGGPARGEGGADPDVHSWAPGEVEAPGPAAGGRATDAGTGTAAAAATMSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSIDAIPDNQKFKQLQRELSQVLTQRQIYIQPDN

SEQ ID NO: 839957 - protein, 95 aa, Homo sapiens
SVPGGYRGTMNLEAALTRQMEKDETVSDCSPHIANIGRLVEDMENKIRSTLNEIYFGKTKDIVNGLRSVQTFADKSKQEALKNDLVEALKRKQQC

SEQ ID NO: 839958 - protein, 336 aa, Homo sapiens; identical to SEQ ID NO: 839920

SEQ ID NO: 839959 - protein, 277 aa, Homo sapiens
MSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSIDAIPDNQKFKQLQRELSQVLTQRQIYIQPDN

SEQ ID NO: 839960 - protein, 334 aa, Homo sapiens
LAAWGAGPGRAGAGKEGGGGPARGEGGADPDVHSWAPGEVEAPGPAAGGRATDAGTGTAAAAATMSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRISRPTEAAGWGLGGVPPTVPLFRPGAFLSISMECKRRFLFYFVFL

SEQ ID NO: 839961 - protein, 233 aa, Homo sapiens
MSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQMEKDETVSDCSPHIANIGRLVEDMENKIRSTLNEIYFGKTKDIVNGLRSVQTFADKSKQEALKNDLVEALKRKQQC

SEQ ID NO: 839962 - protein, 119 aa, Homo sapiens
FIKFFCFTFFTPMYQKGGREGRLADLTVVCEREKKNWKSYSVCVWELLGVGGRGDRGQLWEQRWPSVPSCADSPVPRRPRGGGWGGCRRPFRSSGQVLFCQFLWNAKGGFCFILFFCKA

SEQ ID NO: 839963 - protein, 106 aa, Homo sapiens
GGLHRCSCHFQTTHFKLELGLRPWWLGVGRADCVDRVFNSRFQVLLNCWILMNRNQDYVWLELQPHDHQPHRMTESCQAPATLELRILPWGHCAAASLQGAACFMA

SEQ ID NO: 839964 - protein, 32 aa, Homo sapiens
FGEFELQNAVFQSNFYTPDYFTSKMDIGYFLG

SEQ ID NO: 839965 - protein, 215 aa, Homo sapiens
RFSLFPHVQPIVFKEKLTMKTGLLMEEKLECSLWCCLSDPSIPGRCCVLERHIVPWMQQLHQQWKWLICGLCRLYNLPKHPNVEMPDQPLPMGQNGTTEEVTSKEEEEEEMDEDIEDLDHCEMKEEPTSEKKLEDEGTEKENWAILEKIRKTERQGHLNVLQCLGQCKLQIDLRKSSGTYTDHRVIRQVDPDSPLHSDLQILKEKEEIGDILLMF

SEQ ID NO: 839966 - protein, 210 aa, Homo sapiens
RFSLFPHVQPIVFKEKLTMKTGLLMEEKLECSLWCCLSDPSIPGRCCVLERHIVPWMQQLHQQWKWLICGLCRLYNLPKHPNVEMPDQPLPMGQNGTTEEVTSKEKKKEKEAEPEEQGEDSSRDPRLRRLQNRISEDVEERLPRHRKIGEPEVVGESDSKVEGDAWRMEREDSSEEEGEEIDDEEIERRRGMMRQRAQERKIEEMEVMEV

SEQ ID NO: 839967 - protein, 372 aa, Homo sapiens
MNGDEKAEPSPQSWSSLWKHDKDMEEDRASSSSGTIVQEAYGKISTSDNSMAQILTPDSLNTEQGPECSLRPNQTEEGTTPPIEADTLDSSDAQGGLEPRVEKTRPEPTEVLHACKTQVAELELWLQQANVAVEPETLNADMQQVLEQQLVGCQAMLTEIEHKVAFLLETCKDQGLGDNGATQHEAEALSLKLKTVKCNLEKVQMMLQEKHSEDQHPTILKKSSEPEHQEALQPVNLSELESIVTERPQFSRQKDFQQQQVLELKPMEQKDFIKFIEFNAKKMWPQYCQHDNDTTQESSASNQASSPENDVPDSILSPQGQNGDKWQYLHHELSSKIKLPLPQLVEPQVSTNMGILPSVTIWMPPTLPQKKK

SEQ ID NO: 839968 - protein, 369 aa, Homo sapiens
MNGDEKAEPSPQSWSSLWKHDKDMEEDRASSSSGTIVQEAYGKISTSDNSMAQILTPDSLNTEQGPECSLRPNQTEEGTTPPIEADTLDSSDAQGGLEPRVEKTRPEPTEVLHACKTQVAELELWLQQANVAVEPETLNADMQQVLEQQLVGCQAMLTEIEHKVAFLLETCKDQGLGDNGATQHEAEALSLKLKTVKCNLEKVQMMLQEKHSEDQHPTILKKSSEPEHQEALQPVNLSELESIVTERPQFSRQKDFQQQQVLELKPMEQKDFIKFIEFNAKKMWPQYCQHDNDTTQESSASNQASSPENDVPDSILSPQGQNGDKWQYLHHELSSKIKLPLPQLVEPQVSLYLHGANSLFIFENPTSIH

SEQ ID NO: 839969 - protein, 322 aa, Homo sapiens
MAQILTPDSLNTEQGPECSLRPNQTEEGTTPPIEADTLDSSDAQGGLEPRVEKTRPEPTEVLHACKTQVAELELWLQQANVAVEPETLNADMQQVLEQQLVGCQAMLTEIEHKVAFLLETCKDQGLGDNGATQHEAEALSLKLKTVKCNLEKVQMMLQEKHSEDQHPTILKKSSEPEHQEALQPVNLSELESIVTERPQFSRQKDFQQQQVLELKPMEQKDFIKFIEFNAKKMWPQYCQHDNDTTQESSASNQASSPENDVPDSILSPQGQNGDKWQYLHHELSSKIKLPLPQLVEPQVSTNMGILPSVTIWMPPTLPQKKK

SEQ ID NO: 839970 - protein, 779 aa, Homo sapiens
MDCAPKALLARALYDNCPDCSDELAFSRGDILTILEQHVPESEGWWKCLLHGRQGLAPANRLQILTEVAADRPCPPFLRGLEEAPASSEETYQVPTLPRPPTPGPVYEQMRSWAEGPQPPTAQVYEFPDPPTSARIICEKTLSFPKQAILTLPRPVRASLPTLPSQVYDVPTQHRGPVVLKEPEKQQLYDIPASPKKAGLHPPDSQASGQGVPLISVTTLRRGGYSTLPNPQKSEWIYDTPVSPGKASVRNTPLTSFAEESRPHALPSSSSTFYNPPSGRSRSLTPQLNNNVPMQKKLSLPEIPSYGFLVPRGTFPLDEDVSNKVPSSFSDSPSGQQNTKPNIDIPKATSSVSQAGKELEKAKEVSENSAGHNSSWFSRRTTSPSPEPDRLSGSSSDSRASIVSSCSTTSTDDSSSSSSEESAKELSLDLDVAKETVMALQHKVVSSVAGLMLFVSRKWRFRDYLEANIDAIHRSTDHIEESVREFLDFARGVHGTACNLTDSNLQNRIRDQMQTISNSYRILLETKESLDNRNWPLEVLVTDSVQNSPDDLERFVMVARMLPEDIKRFASIVIANGRLLFKRNCEKEETVQLTPNAEFKCEKYIQPPQRETESHQKSTPSTKQREDEHSSELLKKNRANICGQNPGPLIPQPSSQQTPERKPRLSEHCRLYFGALFKAISAFHGSLSSSQPAEIITQSKLVIMVGQKLVDTLCMETQERDVRNEILRGSSHLCSLLKDVALATKNAVLTYPSPAALGHLQAEAEKLEQHTRQFRGTLG

SEQ ID NO: 839971 - protein, 349 aa, Homo sapiens
MKGTGIMDCAPKALLARALYDNCPDCSDELAFSRGDILTILEQHVPESEGWWKCLLHGRQGLAPANRLQILTEVAADRPCPPFLRGLEEAPASSEETYQVPTLPRPPTPGPVYEQMRSWAEGPQPPTAQVYEFPDPPTSARIICEKTLSFPKQAILTLPRPVRASLPTLPSQVYDVPTQHRGPVVLKEPEKQQLYDIPASPKKAGLHPPDSQASNPGPLIPQPSSQQTPERKPRLSEHCRLYFGALFKAISAFHGSLSSSQPAEIITQSKLVIMVGQKLVDTLCMETQERDVRNEILRGSSHLCSLLKDVALATKNAVLTYPSPAALGHLQAEAEKLEQHTRQFRGTLG

SEQ ID NO: 839972 - protein, 252 aa, Homo sapiens
MSQAAKASASATVAVNPGPDTKGKGAPPAGTSPSPGTTLAPTTVPITSAKAAELPPGNYRLVVFELENFQGRRAEFSGECSNLADRGFDRVRSIIVSAGPWVAFEQSNFRGEMFILEKGEYPRWNTWSSSYRSDRLMSFRPIKMDAQEHKISLFEGANFKGNTIEIQGDDAPSLWVYGFSDRVGSVKVSSGTWVGYQYPGYRGYQYLLEPGDFRHWNEWGAFQPQMQSLRRLRDKQWHLEGSFPVLATEPPK

SEQ ID NO: 839973 - protein, 252 aa, Homo sapiens; identical to SEQ ID NO: 839972

SEQ ID NO: 839974 - protein, 252 aa, Homo sapiens; identical to SEQ ID NO: 839972

SEQ ID NO: 839975 - protein, 200 aa, Homo sapiens
MSQAAKASASATVAVNPGPDTKGKGAPPAGTSPSPGTTLAPTTVPITSAKAAELPPGNYRLVVFELENFQGRRAEFSGECSNLADRGFDRVRSIIVSAGPWVAFEQSNFRGEMFILEKGEYPRWNTWSSSYRSDRLMSFRPIKMDAQEHKISLFEGANFKGNTIEIQSPPSESTPHSATLPQPFFMFNYFPHFSQANKIP

SEQ ID NO: 839976 - protein, 120 aa, Homo sapiens
HAELTLLTTTLHDAQEHKISLFEGANFKGNTIEIQGDDAPSLWVYGFSDRVGSVKVSSGTWVGYQYPGYRGYQYLLEPGDFRHWNEWGAFQPQMQSLRRLRDKQWHLEGSFPVLATEPPK

SEQ ID NO: 839977 - protein, 156 aa, Homo sapiens
AAERQGIPEFLLGGRLLVVFELENFQGRRAEFSGECSNLADRGFDRVRSIIVSAGPWVAFEQSNFRGEMFILEKGEYPRWNTWSSSYRSDRLMSFRPIKMDAQEHKISLFEGANFKGNTIEIQSPPSESTPHSATLPQPFFMFNYFPHFSQANKIP

SEQ ID NO: 839978 - protein, 33 aa, Homo sapiens
TIETLYMAFKGKLDFLLAATLDFRLAGPRAQFI

SEQ ID NO: 839979 - protein, 113 aa, Homo sapiens
FRGYTCSYYLGILCEAEVWTSNVPVATTVNTVPSTQFFSPCPLPPALPPCFWSSQCLLFPSLCPCVPKTYLPLTSESMQYLVFLFCVSSVRIIASSYIHVTAKDLISFFLMAV

SEQ ID NO: 839980 - protein, 71 aa, Homo sapiens
MQEMSSVHWLPSFPPPSPPASLTYYVLLQRSVVCGGSKSPPLSSALIFHSHNACVIFSGSIQVVEDHSIMD

SEQ ID NO: 839981 - protein, 547 aa, Homo sapiens
GGLTTTVIGTRLGVDRPTLSWSAGPSLAAPAAMSSEMEPLLLAWSYFRRRKFQLCADLCTQMLEKSPYDQEPDPELPVHQAAWILKARALTEMVYIDEIDVDQEGIAEMMLDENAIAQVPRPGTSLKLPGTNQTGGPSQAVRPITQAGRPITGFLRPSTQSGRPGTMEQAIRTPRTAYTARPITSSSGRFVRLGTASMLTSPDGPFINLSRLNLTKYSQKPKLAKALFEYIFHHENDVKTALDLAALSTEHSQYKDWWWKVQIGKCYYRLGMYREAEKQFKSALKQQEMVDTFLYLAKVYVSLDQPVTALNLFKQGLDKFPGEVTLLCGIARIYEEMNNMSSAAEYYKEVLKQDNTHVEAIACIGSNHFYSDQPEIALRFYRRLLQMGIYNGQLFNNLGLCCFYAQQYDMTLTSFERALSLAENEEEAADVWYNLGHVAVGIGDTNLAHQCFRLALVNNNNHAEAYNNLAVLEMRKGHVEQARALLQTASSLAPHMYEPHFNFATISDKIGDLQRSYVAAQKSEAAFPDHVDTQHLIKQLRQHFAML

SEQ ID NO: 839982 - protein, 507 aa, Homo sapiens
GGLTTTVIGTRLGVDRPTLSWSAGPSLAAPAAMSSEMEPLLLAWSYFRRRKFQLCADLCTQMLEKSPYDQAAWILKARALTEMVYIDEIDVDQEGIAEMMLDENAIAQVPRPGTSLKLPGTNQTGGPSQAVRPITQAGRPITGFLRPSTQSGRPGTMEQAIRTPRTAYTARPITSSSGRFVRLGTALFEYIFHHENDVKTALDLAALSTEHSQYKDWWWKVQIGKCYYRLGMYREAEKQFKSALKQQEMVDTFLYLAKVYVSLDQPVTALNLFKQGLDKFPGEVTLLCGIARIYEEMNNMSSAAEYYKEVLKQDNTHVEAIACIGSNHFYSDQPEIALRFYRRLLQMGIYNGQLFNNLGLCCFYAQQYDMTLTSFERALSLAENEEEAADVWYNLGHVAVGIGDTNLAHQCFRLALVNNNNHAEAYNNLAVLEMRKGHVEQARALLQTASSLAPHMYEPHFNFATISDKIGDLQRSYVAAQKSEAAFPDHVDTQHLIKQLRQHFAML

SEQ ID NO: 839983 - protein, 519 aa, Homo sapiens
GGLTTTVIGTRLGVDRPTLSWSAGPSLAAPAAMSSEMEPLLLAWSYFRRRKFQLCADLCTQMLEKSPYDQAAWILKARALTEMVYIDEIDVDQEGIAEMMLDDNQTGGPSQAVRPITQAGRPITGFLRPSTQSGRPGTMEQAIRTPRTAYTARPITSSSGRFVRLGTASMLTSPDGPFINLSRLNLTKYSQKPKLAKALFEYIFHHENDVKTALDLAALSTEHSQYKDWWWKVQIGKCYYRLGMYREAEKQFKSALKQQEMVDTFLYLAKVYVSLDQPVTALNLFKQGLDKFPGEVTLLCGIARIYEEMNNMSSAAEYYKEVLKQDNTHVEAIACIGSNHFYSDQPEIALRFYRRLLQMGIYNGQLFNNLGLCCFYAQQYDMTLTSFERALSLAENEEEAADVWYNLGHVAVGIGDTNLAHQCFRLALVNNNNHAEAYNNLAVLEMRKGHVEQARALLQTASSLAPHMYEPHFNFATISDKIGDLQRSYVAAQKSEAAFPDHVDTQHLIKQLRQHFAML

SEQ ID NO: 839984 - protein, 350 aa, Homo sapiens [sequence omitted]

SEQ ID NO: 839985 - protein, 280 aa, Homo sapiens
GGLTTTVIGTRLGVDRPTLSWSAGPSLAAPAAMSSEMEPLLLAWSYFRRRKFQLCADLCTQMLEKSPYDQAAWILKARALTEMVYIDEIDVDQEGIAEMMLDENAIAQVPRPGTSLKLPGTNQTGGPSQAVRPITQAGRPITGFLRPSTQSGRPGTMEQAIRTPRTAYTARPITSSSGRFVRLGTASMLTSPDGPFINLSRLNLTKYSQKPKLAKALFEYIFHHENDVKTALDLAALSTEHSQYKDWWWKVQIGKCYYRLGMIGTKTRYSRERGRRTLAG

SEQ ID NO: 839986 - protein, 537 aa, Homo sapiens
GGLTTTVIGTRLGVDRPTLSWSAGPSLAAPAAMSSEMEPLLLAWSYFRRRKFQLCADLCTQMLEKSPYDQAAWILKARALTEMVYIDEIDVDQEGIAEMMLDENAIAQVPRPGTSLKLPGTNQTGGPSQAVRPITQAGRPITGFLRPSTQSGRPGTMEQAIRTPRTAYTARPITSSSGRFVRLGTASMLTSPDGPFINLSRLNLTKYSQKPKLAKALFEYIFHHENDVKTALDLAALSTEHSQYKDWWWKVQIGKCYYRLGMYREAEKQFKSALKQQEMVDTFLYLAKVYVSLDQPVTALNLFKQGLDKFPGEVTLLCGIARIYEEMNNMSSAAEYYKEVLKQDNTHVEAIACIGSNHFYSDQPEIALRFYRRLLQMGIYNGQLFNNLGLCCFYAQQYDMTLTSFERALSLAENEEEAADVWYNLGHVAVGIGDTNLAHQCFRLALVNNNNHAEAYNNLAVLEMRKGHVEQARALLQTASSLAPHMYEPHFNFATISDKIGDLQRSYVAAQKSEAAFPDHVDTQHLIKQLRQHFAML

SEQ ID NO: 839987 - protein, 509 aa, Homo sapiens
GGLTTTVIGTRLGVDRPTLSWSAGPSLAAPAAMSSEMEPLLLAWSYFRRRKFQLCADLCTQMLEKSPYDQAAWILKARALTEMVYIDEIDVDQEGIAEMMLDENAIAQVPRPGTSLKLPGTNQTGGPSQAVRPITQAGRPITGFLRPSTQSGRPGTMEQAIRTPRTAYTARPITSSSGRFVRLGTASMLTSPDGPFINLSRLNLTKYSQKPKLAKALFEYIFHHENDVKTALDLAALSTEHSQYKDWWWKVQIGKCYYRLGMYREAEKQFKSALKQQEMVDTFLYLAKVYVSLDQPVTALNLFKQGLDKFPGEVTLLCGIARIYEEMNNMSSAAEYYKEVLKQDNTHVEAIACIGSNHFYSDQPEIALRFYRRLLQMGIYNGQLFNNLGLCCFYAQQYDMTLTSFERALSLAENEEEAADVWYNLGHVAVGIGDTNLAHQCFRLALVNNNNHAEAYNNLAVLEMRKGHVEQIGDLQRSYVAAQKSEAAFPDHVDTQHLIKQLRQHFAML

SEQ ID NO: 839988 - protein, 171 aa, Homo sapiens
TRINYKKWLHQNKEHLEISHVLLCNVTQRVSFWFVVTDPSKNHTLPAVEVQSAIRMNKNRINNAFFLNDQTLEFLKIPSTLAPPMDPSVPIWIIIFGVIFCIIIVAIALLILSGIWQRRRKNKEPSEVDDAEDKCENMITIENGIPSDPLDMKGGHINDAFMTEDERLTPL

SEQ ID NO: 839989 - protein, 170 aa, Homo sapiens
MVAFSMRKVPNREATEISHVLLCNVTQRVSFWFVVTDPSKNHTLPAVEVQSAIRMNKNRINNAFFLNDQTLEFLKIPSTLAPPMDPSVPIWIIIFGVIFCIIIVAIALLILSGIWQRRRKNKEPSEVDDAEDKCENMITIENGIPSDPLDMKGGHINDAFMTEDERLTPL

SEQ ID NO: 839990 - protein, 204 aa, Homo sapiens
MLWLLFFLVTAIHAELCQPGAENAFKVRLSIRTALGDKAYAWDTNEEYLFKAMVAFSMRKVPNREATEISHVLLCNVTQRVSFWFVVTDPSKNHTLPAVEVQSAIRMNKNRINNAFFLNDQTLEFLKIPSTLAPPMDPSVPIWIIIFGVIFCIIIVAIALLILSGIWQRRRKNKEPSEVDDAEDKCENMITIAFMTEDERLTPL

SEQ ID NO: 839991 - protein, 222 aa, Homo sapiens
MLWLLFFLVTAIHAELCQPGAENAFKVRLSIRTALGDKAYAWDTNEEYLFKAMVAFSMRKVPNREATEISHVLLCNVTQRVSFWFVVTDPSKNHTLPAVEVQSAIRMNKNRINNAFFLNDQTLEFLKIPSTLAPPMDPSVPIWIIIFGVIFCIIIVAIALLILSGIWQRRRKNKEPSEVDDAEDKCENMITIENGIPSDPLDMKGGHINDAFMTEDERLTPL

SEQ ID NO: 839992 - protein, 169 aa, Homo sapiens
REKQAGRHNTQQKPLISHVLLCNVTQRVSFWFVVTDPSKNHTLPAVEVQSAIRMNKNRINNAFFLNDQTLEFLKIPSTLAPPMDPSVPIWIIIFGVIFCIIIVAIALLILSGIWQRRRKNKEPSEVDDAEDKCENMITIENGIPSDPLDMKGGHINDAFMTEDERLTPL

SEQ ID NO: 839993 - protein, 160 aa, Homo sapiens
MKRTLRISHVLLCNVTQRVSFWFVVTDPSKNHTLPAVEVQSAIRMNKNRINNAFFLNDQTLEFLKIPSTLAPPMDPSVPIWIIIFGVIFCIIIVAIALLILSGIWQRRRKNKEPSEVDDAEDKCENMITIENGIPSDPLDMKGGHINDAFMTEDERLTPL

SEQ ID NO: 839994 - protein, 176 aa, Homo sapiens
VWFLKSCSDSLLNAAITLHTSRISHVLLCNVTQRVSFWFVVTDPSKNHTLPAVEVQSAIRMNKNRINNAFFLNDQTLEFLKIPSTLAPPMDPSVPIWIIIFGVIFCIIIVAIALLILSGIWQRRRKNKEPSEVDDAEDKCENMITIENGIPSDPLDMKGGHINDAFMTEDERLTPL

SEQ ID NO: 839995 - protein, 848 aa, Homo sapiens
MWLRLGPPSLSLSPKPTVGRSLCLTLWFLSLALRASTQAPAPTVNTHFGKLRGARVPLPSEILGPVDQYLGVPYAAPPIGEKRFLPPEPPPSWSGIRNATHFPPVCPQNIHTAVPEVMLPVWFTANLDIVATYIQEPNEDCLYLNVYVPTEDVKRISKECARKPNKKICRKGGSGAKKQGEDLADNDGDEDEDIRDSGAKPVMVYIHGGSYMEGTGNMIDGSILASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSNFVDNLYGYPEGKDTLRETIKFMYTDWADRDNPETRRKTLVALFTDHQWVEPSVVTADLHARYGSPTYFYAFYHHCQSLMKPAWSDAAHGDEVPYVFGVPMVGPTDLFPCNFSKNDVMLSAVVMTYWTNFAKTGDPNKPVPQDTKFIHTKANRFEEVAWSKYNPRDQLYLHIGLKPRVRDHYRATKVAFWKHLVPHLYNLHDMFHYTSTTTKVPPPDTTHSSHITRRPNGKTWSTKRPAISPAYSNENAQGSWNGDQDAGPLLVENPRDYSTELSVTIAVGASLLFLNVLAFAALYYRKDKRRQEPLRQPSPQRGAGAPELGAAPEEELAALQLGPTHHECEAGPPHDTLRLTALPDYTLTLRRSPDDIPLMTPNTITMIPNSLVGLQTLHPYNTFAAGFNSTGLPHSHSTTRV

SEQ ID NO: 839996 - protein, 828 aa, Homo sapiens
MWLRLGPPSLSLSPKPTVGRSLCLTLWFLSLALRASTQAPAPTVNTHFGKLRGARVPLPSEILGPVDQYLGVPYAAPPIGEKRFLPPEPPPSWSGIRNATHFPPVCPQNIHTAVPEVMLPVWFTANLDIVATYIQEPNEDCLYLNVYVPTEDGSGAKKQGEDLADNDGDEDEDIRDSGAKPVMVYIHGGSYMEGTGNMIDGSILASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSNFVDNLYGYPEGKDTLRETIKFMYTDWADRDNPETRRKTLVALFTDHQWVEPSVVTADLHARYGSPTYFYAFYHHCQSLMKPAWSDAAHGDEVPYVFGVPMVGPTDLFPCNFSKNDVMLSAVVMTYWTNFAKTGDPNKPVPQDTKFIHTKANRFEEVAWSKYNPRDQLYLHIGLKPRVRDHYRATKVAFWKHLVPHLYNLHDMFHYTSTTTKVPPPDTTHSSHITRRPNGKTWSTKRPAISPAYSNENAQGSWNGDQDAGPLLVENPRDYSTELSVTIAVGASLLFLNVLAFAALYYRKDKRRQEPLRQPSPQRGAGAPELGAAPEEELAALQLGPTHHECEAGPPHDTLRLTALPDYTLTLRRSPDDIPLMTPNTITMIPNSLVGLQTLHPYNTFAAGFNSTGLPHSHSTTRV

SEQ ID NO: 839997 - protein, 848 aa, Homo sapiens; identical to SEQ ID NO: 839995

SEQ ID NO: 839998 - protein, 808 aa, Homo sapiens
MWLRLGPPSLSLSPKPTVGRSLCLTLWFLSLALRASTQAPAPTVNTHFGKLRGARVPLPSEILGPVDQYLGVPYAAPPIGEKRFLPPEPPPSWSGIRNATHFPPVCPQNIHTAVPEVMLPVWFTANLDIVATYIQEPNEDCLYLNVYVPTEDDIRDSGAKPVMVYIHGGSYMEGTGNMIDGSILASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSNFVDNLYGYPEGKDTLRETIKFMYTDWADRDNPETRRKTLVALFTDHQWVEPSVVTADLHARYGSPTYFYAFYHHCQSLMKPAWSDAAHGDEVPYVFGVPMVGPTDLFPCNFSKNDVMLSAVVMTYWTNFAKTGDPNKPVPQDTKFIHTKANRFEEVAWSKYNPRDQLYLHIGLKPRVRDHYRATKVAFWKHLVPHLYNLHDMFHYTSTTTKVPPPDTTHSSHITRRPNGKTWSTKRPAISPAYSNENAQGSWNGDQDAGPLLVENPRDYSTELSVTIAVGASLLFLNVLAFAALYYRKDKRRQEPLRQPSPQRGAGAPELGAAPEEELAALQLGPTHHECEAGPPHDTLRLTALPDYTLTLRRSPDDIPLMTPNTITMIPNSLVGLQTLHPYNTFAAGFNSTGLPHSHSTTRV

SEQ ID NO: 839999 - protein, 161 aa, Homo sapiens
RFEKASVEYQEHLCAMIGVHCCISSFDKSVLTLANAGCNSASPKHCLNGESRKTVLSKPTDSSPEVINYLGNKACECYISIADWAAVQEWQNAIHDLKKSTSSTSFNLKADFNYIKSLSSFESGKFVKCTEQLELLPGENINLLAGGSKEKIDMKKLLRNM

SEQ ID NO: 840000 - protein, 161 aa, Homo sapiens; identical to SEQ ID NO: 839999

SEQ ID NO: 840001 - protein, 56 aa, Homo sapiens
ALISKKLNDYRKVSHSSGPKADSSPKGSRGLGGLKSEFLKQSAARGLRTQDLPAGS

SEQ ID NO: 840002 - protein, 101 aa, Homo sapiens
PGTQGERRGGGQGGQGQKVKTRRSLKNRALGSIKEPTTEAPREGANWETGRGSWERVESVLAAALMLREEGKEPGDKQSVGAVREKEASLSVSQVVVRWLM

SEQ ID NO: 840003 - protein, 79 aa, Homo sapiens
EESDFISRVLAFFAASDGIVNENLVERFSQEVQITEARCFYDFQIAMENTHSEMYSLLIDTYIKDAKEREFLFNTIETP

SEQ ID NO: 840004 - protein, 120 aa, Homo sapiens
INVKRSRSYLYPLGPGPIYSSQWDIAPYWLVIRVYTVPWKVVTPPYLVSSTLSWHLSYAFNSPFLLFVQASIFWVVQNVTGPVIPWSRAIVMPPSPCNERALGSDVMLRGNLCQWVKHSV

SEQ ID NO: 840005 - protein, 213 aa, Homo sapiens
MEKCSVGGLELTEQTPALLGNMAMATSLMDIGDSFGHPACPLVSRSRNSPVEDDDDDDDVVFIESIQPPSISAPAIADQRNFIFASSKNEKPQGNYSVIPPSSRDLASQKGNISETIVIDDEEDIETNGGAEKKSSCFIEWGLPGTKNKTNDLDFSTSSLSRSKVNAGMGNSGITTELTLKYIITNVTTLETGISSVNAGQDVNIIITYKTSL

SEQ ID NO: 840006 - protein, 646 aa, Homo sapiens
MATSLMDIGDSFGHPACPLVSRSRNSPVEDDDDDDDVVFIESIQPPSISAPAIADQRNFIFASSKNEKPQGNYSVIPPSSRDLASQKGNISETIVIDDEEDIETNGGAEKKSSCFIEWGLPGTKNKTNDLDFSTSSLSRSKTKTGVRPFNPGRMNVAGDLFQNGEFATHHSPDSWISQSASFPSNQKQPGVDSLSPVALLRKQNFQPTAQQQLTKPAKITCANCKKPLQKGQTAYQRKGSAHLFCSTTCLSSFSHKRTQNTRSIICKKDASTKKANVILPVESSKSFQEFYSTSCLSPCENNWNLKKGVFNKSRCTICSKLAEIRHEVSVNNVTHKLCSNHCFNKYRLANGLIMNCCEHCGEYMPSKSTGNNILVIGGQQKRFCCQSCINEYKQMMETKSKKLTASENRKRNAFREENEKQLYGSSNTLLKKIEGIPEKKEKTSQLQLSVECGTDTLLIQENVNLPPSSTSTIADTFQEQLEEKNFEDSIVPVVLSADPGTWPRILNIKQRDTLVENVPPQVRNFNFPKDNTGRKFSETYYTRILPNGEKTTRSWLLYSTSKDSVFCLYCKLFGEGKNQLKNENGCKDWQHLSHILSKHEESEMHINNSVKYSKLKSDLKKNKAIDAAERRLYENEKNDGVLLLYT

SEQ ID NO: 840007 - protein, 213 aa, Homo sapiens; identical to SEQ ID NO: 840005

SEQ ID NO: 840008 - protein, 232 aa, Homo sapiens
MATSLMDIGDSFGHPACPLVSRSRNSPVEDDDDDDDVVFIESIQPPSISAPAIADQRNFIFASSKNEKPQGNYSVIPPSSRDLASQKGNISETIVIDDEEDIETNGGAEKKSSCFIEWGLPGTKNKTNDLDFSTSSLSRSKILGSPSQLHFPVIRNSQGWILYHQWPYFVSRISSLQPNNNLLNQLKSLVQIAKSLYRRDRQLINEKDQLTSFALPPAFLPSLINVLKTHEA

SEQ ID NO: 840009 - protein, 252 aa, Homo sapiens [sequence omitted]

SEQ ID NO: 840010 - protein, 185 aa, Homo sapiens
MATSLMDIGDSFGHPACPLVSRSRNSPVEDDDDDDDVVFIESIQPPSISAPAIADQRNFIFASSKNEKPQGNYSVIPPSSRDLASQKGNISETIVIDDEEDIETNGGAEKKSSCFIEWGLPGTKNKTNDLDFSTSSLSRSKTKTGVRPFNPGRMNVAGDLFQNGEFATHHSPEMHLQRRLMSFFQ

SEQ ID NO: 840011 - protein, 359 aa, Homo sapiens
MATSLMDIGDSFGHPACPLVSRSRNSPVEDDDDDDDVVFIESIQPPSISAPAIADQRNFIFASSKNEKPQGNYSVIPPSSRDLASQKGNISETIVIDDEEDIETNGGAEKKSSCFIEWGLPGTKNKTNDLDFSTSSLSRSKTKTGVRPFNPGRMNVAGDLFQNGEFATHHSPDSWISQSASFPSNQKQPGVDSLSPVALLRKQNFQPTAQQQLTKPAKITCANCKKPLQKGQTAYQRKGSAHLFCSTTCLSSFSHKRTQNTRSIICKKDASTKKANVILPVESSKSFQEFYSTSCLSPCENNWNLKKGVFNKSRCTICSKLAEVWIFIPKLLFRLTVIILTFKCYYVLFHLHNARVLDV

SEQ ID NO: 840012 - protein, 646 aa, Homo sapiens; identical to SEQ ID NO: 840006

SEQ ID NO: 840013 - protein, 213 aa, Homo sapiens; identical to SEQ ID NO: 840005

SEQ ID NO: 840014 - protein, 115 aa, Homo sapiens
GHGSGFPRKRRPRGAGLSGRGGRGRSKLKSGIGAVVLPGVSTADISSNKDDEENSMHTTVVLFSSSDKFTLNQDMCVVCGSFGQGAEGRLLACSQCGQCYHPYCVSIKVNILKLS

SEQ ID NO: 840015 - protein, 52 aa, Homo sapiens
MGDWEGGASEDGESGKRSPPETRGSGRGEPGFLMALGPGQGKGAAASGWSSM

SEQ ID NO: 840016 - protein, 198 aa, Homo sapiens
MSNVRVSNGSPSLERMDARQAEHPKPSACRNLFGPVDHEELTRDLEKHCRDMEEASQRKWNFDFQNHKPLEGKYEWQEVEKGSLPEFYYRPPRPPKGACKVPAQESQDVSGSRPAAPLIGAPANSEDTHLVDPKTDPSDSQTGLAEQCAGIRKRPATDDSSTQNKRANRTEENVSDGSPNAGSVEQTPKKPGLRRRQT

SEQ ID NO: 840017 - protein, 198 aa, Homo sapiens; identical to SEQ ID NO: 840016

SEQ ID NO: 840018 - protein, 851 aa, Homo sapiens
VFISVPDPRAQAQLRPPGMDVVDPDIFNRDPRDHYDLLQRLGGGTYGEVFKARDKVSGDLVALKMVKMEPDDDVSTLQKEILILKTCRHANIVAYHGSYLWLQKLWICMEFCGAGSLQDIYQVTGSLSELQISYVCREVLQGLAYLHSQKKIHRDIKGANILINDAGEVRLADFGISAQIGATLARRLSFIGTPYWMAPEVAAVALKGGYNELCDIWSLGITAIELAELQPPLFDVHPLRVLFLMTKSGYQPPRLKEKGKWSAAFHNFIKVTLTKSPKKRPSATKMLSHQLVSQPGLNRGLILDLLDKLKNPGKGPSIGDIEDEEPELPPAIPRRIRSTHRSSSLGIPDADCCRRHMEFRKLRGMETRPPANTARLQPPRDLRSSSPRKQLSESSDDDYDDVDIPTPAEDTPPPLPPKPKFRSPSDEGPGSMGDDGQLSPGVLVRCASGPPPNSPRPGPPPSTSSPHLTAHSEPSLWNPPSRELDKPPLLPPKKEKMKRKGCALLVKLFNGCPLRIHSTAAWTHPSTKDQHLLLGAEEGIFILNRNDQEATLEMLFPSRTTWVYSINNVLMSLSGKTPHLYSHSILGLLERKETRAGNPIAHISPHRLLARKNMVSTKIQDTKGCRACCVAEGASSGGPFLCGALETSVVLLQWYQPMNKFLLVRQVLFPLPTPLSVFALLTGPGSELPAVCIGVSPGRPGKSVLFHTVRFGALSCWLGEMSTEHRGPVQVTQVEEDMVMVLMDGSVKLVTPEGSPVRGLRTPEIPMTEAVEAVAMVGGQLQAFWKHGVQVWALGSDQLLQELRDPTLTFRLLGSPRLECSGTISPHCNLLLPGSSNSPASASRVAGITGL

SEQ ID NO: 840019 - protein, 304 aa, Homo sapiens
MDVVDPDIFNRDPRDHYDLLQRLGGGTYGEVFKARDKVSGDLVALKMVKMEPDDDVSTLQKEILILKTCRHANIVAYHGSYLWLQKLWICMEFCGAGSLQDIYQVTGSLSELQISYVCREVLQGLAYLHSQKKIHRDIKGANILINDAGEVRLADFGISAQIGATLARRLSFIGTPYWMAPEVAAVALKGGYNELCDIWSLGITAIELAELQPPLFDVHPLRVLFLMTKSGYQPPRLKEKGKWSAAFHNFIKVTLTKSPKKRPSATKMLSHHWYPGLIEADLDLKSGKDLIGNERADYPVSRDN

SEQ ID NO: 840020 - protein, 811 aa, Homo sapiens
MDVVDPDIFNRDPRDHYDLLQRLGGGTYGEVFKARDKVSGDLVALKMVKMEPDDDVSTLQKEILILKTCRHANIVAYHGSYLWLQKLWICMEFCGAGSLQDIYQVTGSLSELQISYVCREVLQGLAYLHSQKKIHRDIKGANILINDAGEVRLADFGISAQIGATLARRLSFIGTPYWMAPEVAAVALKGGYNELCDIWSLGITAIELAELQPPLFDVHPLRVLFLMTKSGYQPPRLKEKGKWSAAFHNFIKVTLTKSPKKRPSATKMLSHQLVSQPGLNRGLILDLLDKLKNPGKGPSIGDIEDEEPEEWRPDPQPTPLAYSLLETSGAAAPGQGPQGGWGGELECGQGPQGSYLSPFRKQLSESSDDDYDDVDIPTPAEDTPPPLPPKPKFRSPSDEGPGSMGDDGQLSPGVLVRCASGPPPNSPRPGPPPSTSSPHLTAHSEPSLWNPPSRELDKPPLLPPKKEKMKRKGCALLVKLFNGCPLRIHSTAAWTHPSTKDQHLLLGAEEGIFILNRNDQEATLEMLFPSRTTWVYSINNVLMSLSGKTPHLYSHSILGLLERKETRAGNPIAHISPHRLLARKNMVSTKIQDTKGCRACCVAEGASSGGPFLCGALETSVVLLQWYQPMNKFLLVRQVLFPLPTPLSVFALLTGPGSELPAVCIGVSPGRPGKSVLFHTVRFGALSCWLGEMSTEHRGPVQVTQVEEDMVMVLMDGSVKLVTPEGSPVRGLRTPEIPMTEAVEAVAMVGGQLQAFWKHGVQVWALGSDQLLQELRDPTLTFRLLGSPRPVVVETRPVDDPTAPSNLYIQE

SEQ ID NO: 840021 - protein, 845 aa, Homo sapiens
RFPGSHPMPGLAGVTFAVTGSLSELQISYVCREVLQVRRGLGILGMGGEGGPTPAPKHSLSPCPPFSPGLAYLHSQKKIHRDIKVVWGCRGAVGGWGPGDGSGISGAQGSGEFELAEWASTGLGRVSAASHIPSHSQGANILINDAGEVRLADFGISAQIGATLARRLSFIGTPYWMAPEVAAVALKGGYNELCDIWSLGITAIELAELQPPLFDVHPLRVLFLMTKSGYQPPRLKEKGKWSAAFHNFIKVTLTKSPKKRPSATKMLSHQLVSQPGLNRGLILDLLDKLKNPGKGPSIGDIEDEEPELPPAIPRRIRSTHRSSSLGIPDADCCRRHMEFRKLRGMETRPPANTARLQPPRDLRSSSPRSGTPGRMGRGLECGQGPQGSYLSPFRKQLSESSDDDYDDVDIPTPAEDTPPPLPPKPKFRSPSDEGPGSMGDDGQLSPGVLVRCASGPPPNSPRPGPPPSTSSPHLTAHSEPSLWNPPSRELDKPPLLPPKKEKMKRKGCALLVKLFNGCPLRIHSTAAWTHPSTKDQHLLLGAEEGIFILNRNDQEATLEMLFPSRTTWVYSINNVLMSLSGKTPHLYSHSILGLLERKETRAGNPIAHISPHRLLARKNMVSTKIQDTKGCRACCVAEGASSGGPFLCGALETSVVLLQWYQPMNKFLLVRQVLFPLPTPLSVFALLTGPGSELPAVCIGVSPGRPGKSVLFHTVRFGALSCWLGEMSTEHRGPVQVTQVEEDMVMVLMDGSVKLVTPEGSPVRGLRTPEIPMTEAVEAVAMVGGQLQAFWKHGVQVWALGSDQLLQELRDPTLTFRLLGSPRPVVVETRPVDDPTAPSNLYIQE

SEQ ID NO: 840022 - protein, 798 aa, Homo sapiens
MDVVDPDIFNRDPRDHYDLLQRLGGGTYGEVFKARDKVSGDLVALKMVKMEPDDDVSTLQKEILILKTCRHANIVAYHGSYLWLQKLWICMEFCGAGSLQDIYQVTGSLSELQISYVCREVLQGLAYLHSQKKIHRDIKGANILINDAGEVRLADFGISAQIGATLARRLSFIGTPYWMAPEVAAVALKGGYNELCDIWSLGITAIELAELQPPLFDVHPLRVLFLMTKSGYQPPRLKEKGKWSAAFHNFIKVTLTKSPKKRPSATKMLSHQLVSQPGLNRGLILDLLDKLKNPGKGPSIGDIEDEEPELPPAIPRRIRSTHRSSSLGIPDADCCRRHMEFRKLRGMETRPPANTARLQPPRDLRSSSPRSGTPGRMGRGLECGQGPQGSYLSPFRKQLSESSDDDYDDVDIPTPAEDTPPPLPPKPKFRSPSDEGPGSMGDDGQLSPGVLVRCASGPPPNSPRPGPPPSTSSPHLTAHSEPSLWNPPSRELDKPPLLPPKKEKMKRKGCALLVKLFNGCPLRIHSTAAWTHPSTKDQHLLLGAEEGIFILNRNDQEATLEMLFPSRTTWVYSINNVLMSLSGKTPHLYSHSILGLLERKETRAGNPIAHISPHRLLARKNMVSTKIQDTKGCRACCVAEGASSGGPFLCGALETSVVLLQWYQPMNKFLLVRQVLFPLPTPLSVFALLTGPGSELPAVCIGVSPGRPGKSVLFHTVRFGALSCWLGEMSTEHRGPVQVTQVEEDMVMVLMDGSVKLVTPEGSPVRGLRTPEIPMTEAVEAVGLCRDGRAQDQGWKLK

SEQ ID NO: 840023 - protein, 847 aa, Homo sapiens
MDVVDPDIFNRDPRDHYDLLQRLGGGTYGEVFKARDKVSGDLVALKMVKMEPDDDVSTLQKEILILKTCRHANIVAYHGSYLWLQKLWICMEFCGAGSLQDIYQVTGSLSELQISYVCREVLQGLAYLHSQKKIHRDIKGANILINDAGEVRLADFGISAQIGATLARRLSFIGTPYWMAPEVAAVALKGGYNELCDIWSLGITAIELAELQPPLFDVHPLRVLFLMTKSGYQPPRLKEKGKWSAAFHNFIKVTLTKSPKKRPSATKMLSHQLVSQPGLNRGLILDLLDKLKNPGKGPSIGDIEDEEPELPPAIPRRIRSTHRSSSLGIPDADCCRRHMEFRKLRGMETRPPANTARLQPPRDLRSSSPRSGTPGRMGRGLECGQGPQGSYLSPFRKQLSESSDDDYDDVDIPTPAEDTPPPLPPKPKFRSPSDEGPGSMGDDGQLSPGVLVRCASGPPPNSPRPGPPPSTSSPHLTAHSEPSLWNPPSRELDKPPLLPPKKEKMKRKGCALLVKLFNGCPLRIHSTAAWTHPSTKDQHLLLGAEEGIFILNRNDQEATLEMLFPSRTTWVYSINNVLMSLSGKTPHLYSHSILGLLERKETRAGNPIAHISPHRLLARKNMVSTKIQDTKGCRACCVAEGASSGGPFLCGALETSVVLLQWYQPMNKFLLVRQVLFPLPTPLSVFALLTGPGSELPAVCIGVSPGRPGKSVLFHTVRFGALSCWLGEMSTEHRGPVQVTQVEEDMVMVLMDGSVKLVTPEGSPVRGLRTPEIPMTEAVEAVAMVGGQLQAFWKHGVQVWALGSDQLLQELRDPTLTFRLLGSPRPVVVETRPVDDPTAPSNLYIQE

SEQ ID NO: 840024 - protein, 827 aa, Homo sapiens
MDVVDPDIFNRDPRDHYDLLQRLGGGTYGEVFKARDKVSGDLVALKMVKMEPDDDVSTLQKEILILKTCRHANIVAYHGSYLWLQKLWICMEFCGAGSLQDIYQVTGSLSELQISYVCREVLQGLAYLHSQKKIHRDIKGANILINDAGEVRLADFGISAQIGATLARRLSFIGTPYWMAPEVAAVALKGGYNELCDIWSLGITAIELAELQPPLFDVHPLRVLFLMTKSGYQPPRLKEKGKWSAAFHNFIKVTLTKSPKKRPSATKMLSHQLVSQPGLNRGLILDLLDKLKNPGKGPSIGDIEDEEPELPPAIPRRIRSTHRSSSLGIPDADCCRRHMEFRKLRGMETRPPANTARLQPPRDLRSSSPRSGTPGRMGRGLECGQGPQGSYLSPFRKQLSESSDDDYDDVDIPTPAEDTPPPLPPKPKFRSPSDEGPGSMGDDGQLSPGVLVRCASGPPPNSPRPGPPPSTSSPHLTAHSEPSLWNPPSRELDKPPLLPPKKEKMKRKGCALLVKLFNGCPLRIHSTAAWTHPSTKDQHLLLGAEEGIFILNRNDQEATLEMLFPSRTTWVYSINNVLMSLSGKTPHLYSHSILGLLERKETRAGNPIAHISPHRLLARKNMVSTKIQDTKGCRACCVAEGASSGGPFLCGALETSVVLLQWYQPMNKFLLVRQVLFPLPTPLSVFALLTGPGSELPAVCIGVSPGRPGKSVLFHTVRFGALSCWLGEMSTEHRGPVQVTQVEEDMVMVLMDGSVKLVTPEGSPVRGLRTPEIPMTEAVEAVAMVGGQLQAFWKHGVQVWALGSDQLLQELRDPTLTFRLLGSPRFK

SEQ ID NO: 840025 - protein, 133 aa, Homo sapiens
VFISVPDPRAQAQLRPPGMDVVDPDIFNRDPRDHYDLLQRLGGGTYGEVFKARDKVSGDLVALKMVKMEPDDDVSTLQKEILILKTCRHANIVAYHGSYLWLQKLWICMEFCGAGSLQDIYQGYRKDNGTQAP

SEQ ID NO: 840026 - protein, 311 aa, Homo sapiens
SRCPLPAVRSRLLAAPAPAWSLWPGSGSVSDRTARLAGRSLGRLWEQPPLFSCAGPGMVLSLTGLIAFSFLQATLALNPEDPNVCSHWESYAVTVQESYAHPFDQIYYTRCTDILNWFKCTRHRISYKTAYRRGLRTMYRRRSQCCPGYYESGDFCIPLCTEECVHGRCVSPDTCHCEPGWGGPDCSSGCDSDHWGPHCSNRCQCQNGALCNPITGACVCAAGFRGWRCEELCAPGTHGKGCQLPCQCRHGASCDPRAGECLCAPGYTGVYCEELCPPGSHGAHCELRCPCQNGGTCHHITGECACPPGWT

SEQ ID NO: 840027 - protein, 158 aa, Homo sapiens
MVPSALCTEECVHGRCVSPDTCHCEPGWGGPDCSSGCDSDHWGPHCSNRCQCQNGALCNPITGACVCAAGFRGWRCEELCAPGTHGKGCQLPCQCRHGASCDPRAGECLCAPGYTGVYCEELCPPGSHGAHCELRCPCQNGGTCHHITGECACPPGWT

SEQ ID NO: 840028 - protein, 382 aa, Homo sapiens
MGSQTMAVALPRDLRQDANLAKRRHAELCRQKRVFNARNRIIGGDTEAWDVQVHDQKIKEATEKARHETFAAEMRQNDKIMCILENRKKRDRKNLCRAINDFQQSFQKPETRREFDLSDPLALKKDLPARQSDNDVRNTISGMQKFMGEDLNFHERKKFQEEQNREWSLQQQREWKNARAEQKCAEALYTETRLQFDETAKHLQKLESTTRKAVCASVKDFNKSQAIESVERKKQEKKQEQEDNLAEITNLLRGDLLSENPQQAASSFGPHRVVPDRWKGMTQEQLEQIRLVQKQQIQEKLRLQEEKRQRDLDWDRRRIQGARATLLFERQQWRRQRDLRRALDSSNLSLAKEQHLQKKYMNEVYTNQPTGDYFTQFNTGSR

SEQ ID NO: 840029 - protein, 105 aa, Homo sapiens
RKEGKGRRREEKREERKEERKKGSREGGRREEGREGRKERRREGKKRDGGRINGAFFSSTRQFSYGLRCNSGMSGTRKTRSFHEPKEFTCSTEAMNGQQDIPWNR

SEQ ID NO: 840030 - protein, 86 aa, Homo sapiens
RPWNLLHPTPRANPQRPSGSRGATGRAHGSKPMNQGRWKGRRLGKCLRTESSAETADCRFLAQWGCLRYRDVRVLIRDAMPRPAAT

SEQ ID NO: 840031 - protein, 72 aa, Homo sapiens
QNMGSKIFCCCRKTSEGSSTTVGFHNPRMFEQHHPRSFNLNTNSLHSAVPKRHPRLPYDNRMMLKACILRRP

SEQ ID NO: 840032 - protein, 99 aa, Homo sapiens
PKHGVQDLLLLPQDQRGVFHHCWLPQSKNVRTASSTVLHAVREVQDEALGGVVLGPVARGGGGGGGGGGGGGGGGGGGGGGGGGATTRMMLKACILRRP

SEQ ID NO: 840033 - protein, 128 aa, Homo sapiens
SSIARNWHHLSSKPETTSSLSALFLTCCTQFWPSSANSGSRTALKSLPVSSSRLPDPTPVPIVLRLDLGIACSTGVPLSRPASNKPFSKVSHRDLPSKLHADQAQWLTPVIPALWEAELGGSSEVRSS

SEQ ID NO: 840034 - protein, 81 aa, Homo sapiens
HVDRVYGQYRARGPYSGTLTCCRSRELLGDSCEACGLLLRPAGTPPPRCCQWDVRFTSTSRSLSPRHVRAHHGKMCLATGS

SEQ ID NO: 840035 - protein, 161 aa, Homo sapiens
MSSYQQKQTFTPPPQLQQQQVKQPSQPPPQEIFVPTTKEPCHSKVPQPGNTKIPEPGCTKVPEPGCTKVPEPGCTKVPEPGCTKVPEPGCTKVPEPGYTKVPEPGSIKVPDQGFIKFPEPGAIKVPEQGYTKVPVPGYTKVPEPCPSTVTPGPAQQKTKQK

SEQ ID NO: 840036 - protein, 169 aa, Homo sapiens
MSSYQQKQTFTPPPQLQQQQVKQPSQPPPQEIFVPTTKEPCHSKVPQPGNTKIPEPGCTKVPEPGCTKVPEPGCTKVPEPGCTKVPEPGCTKVPEPGCTKVPEPGYTKVPEPGSIKVPDQGFIKFPEPGAIKVPEQGYTKVPVPGYTKVPEPCPSTVTPGPAQQKTKQK

SEQ ID NO: 840037 - protein, 161 aa, Homo sapiens; identical to SEQ ID NO: 840035

SEQ ID NO: 840038 - protein, 161 aa, Homo sapiens; identical to SEQ ID NO: 840035

SEQ ID NO: 840039 - protein, 135 aa, Homo sapiens
FTRSQRLNSSTFSAQQMIPEQLKTRKATKTFCLIQELRGFFKECVQHPLKHEFLPAEADLYPTTSASTAAGETTQPASTSGNICSHNQGAMPLKGSTTWKHKVNHTYAHHSLTADKPKIKKTIVKAAGVSTHEDL

SEQ ID NO: 840040 - protein, 161 aa, Homo sapiens; identical to SEQ ID NO: 840035

SEQ ID NO: 840041 - protein, 161 aa, Homo sapiens; identical to SEQ ID NO: 840035

SEQ ID NO: 840042 - protein, 123 aa, Homo sapiens
IGVVNSGISFDCASCSHGRDATIRKVPFTGLRDTPRAMSFNGHSRPSSAEDQAEVIWCTDKPLRSQPPDAGHPLPICFCVLIVCRPCNQYILTPSHSLSLICILKIRTIKLLFTHTLKNPVSP

SEQ ID NO: 840043 - protein, 115 aa, Homo sapiens
MQVMNLNVPMRPGILVQRQSKEVLATPLENRRDMEAEEENQINEKQEPENAGETGQEEDDGLQKIHTSVTRTPSVVESQKRPLKGVTFSREVIVVDLGNEYPTPRSYTREHKERK

SEQ ID NO: 840044 - protein, 112 aa, Homo sapiens
MNLNVPMRPGILVQRQSKEVLATPLENRRDMEAEEENQINEKQEPENAGETGQEEDDGLQKIHTSVTRTPSVVESQKRPLKGVTFSREVIVVDLGNEYPTPRSYTREHKERK

SEQ ID NO: 840045 - protein, 112 aa, Homo sapiens; identical to SEQ ID NO: 840044

SEQ ID NO: 840046 - protein, 115 aa, Homo sapiens; identical to SEQ ID NO: 840043

SEQ ID NO: 840047 - protein, 288 aa, Homo sapiens
MAAVLQRVERLSNRVVRVLGCNPGPMTLQGTNTYLVGTGPRRILIDTGEPAIPEYISCLKQALTEFNTAIQEIVVTHWHRDHSGGIGDICKSINNDTTYCIKKLPRNPQREEIIGNGEQQYVYLKDGDVIKTEGATLRVLYTPGHTDDHMALLLEEENAIFSGDCILGEGTTVFEDLYDYMNSLKELLKIKADIIYPGHGPVIHNAEAKIQQYISHRNIREQQILTLFRENFEKSFTVMELVKIIYKNTPENLHEMAKHNLLLHLKKLEKEGKIFSNTDPDKKWKAHL

SEQ ID NO: 840048 - protein, 287 aa, Homo sapiens [sequence omitted]

SEQ ID NO: 840049 - protein, 256 aa, Homo sapiens [sequence omitted]

SEQ ID NO: 840050 - protein, 200 aa, Homo sapiens
MAAVLQRVERLSNRVVRVLGCNPGPMTLQGTNTYLVGTGPRRILIDTGEPAIPEYISCLKQALTEFNTAIQEIVVTHWHRDHSGGIGDICKSINNDTTYCIKKLPRNPQREEIIGNGEQQYVYLKDGDVIKTEGATLRVLYTPGHTDDHMALLLEEENAIFSGDCILGEGTTVFEDLYDYMNSLKELLKIKADIIYPEYS

SEQ ID NO: 840051 - protein, 288 aa, Homo sapiens; identical to SEQ ID NO: 840047

SEQ ID NO: 840052 - protein, 112 aa, Homo sapiens
MAAVLQRVERLSNRVVRVLGCNPGPMTLQGTNTYLVGTGPRRILIDTGEPAIPEYISCLKQALTEFNTAIQEIVVTHWHRDHSGGIGDICKSINNDTTYCIKYVYLDGDVID

SEQ ID NO: 840053 - protein, 200 aa, Homo sapiens; identical to SEQ ID NO: 840050

SEQ ID NO: 840054 - protein, 138 aa, Homo sapiens
MAAVLQRVERLSNRVVRVLGCNPGPMTLQGTNTYLVGTGPRRILIDTGEPAIPEYISCLKQALTEFNTAIQEIVVTHWHRDHSGGIGDICKSINNDTTYCIKKLPRNPQREEIIGNGEQQYVYLKDGDVIKTEGATLR

SEQ ID NO: 840055 - protein, 71 aa, Homo sapiens
DLEDPEDSSVGLYDMQARGFGSDQSENVDRGAGSIREAGGAFGKREQAEEERYFRHRESVPHRESVPHRES

SEQ ID NO: 840056 - protein, 110 aa, Homo sapiens
MAVTALAARTWLGVWGVRTMQARGFGSDQSENVDRGAGSIREAGGAFGKREQAEEERYFRSGEAHRVPSPALDLPMAFQSLNCQSPHPFLPGALGAPSPNRTPGPQSSIP

SEQ ID NO: 840057 - protein, 110 aa, Homo sapiens; identical to SEQ ID NO: 840056

SEQ ID NO: 840058 - protein, 106 aa, Homo sapiens
MAVTALAARTWLGVWGVRTMQARGFGSDQSENVDRGAGSIREAGGAFGKREQAEEERYFRAQSREQLAALKKHHEEEIVHHKKEIERLQKEIERHKQKIKMLKHDD

SEQ ID NO: 840059 - protein, 165 aa, Homo sapiens
MAVTALAARTWLGVWGVRTMQARGFGSDQSENVDRGAGSIREAGGAFGKREQAEEERYFRPGSPNGLPILKLPIAPPVPTWCLGRPIPQQNSRAPIQYTLTLDVPTVATYRALPVTCTTVSGPQTVSTGGSPKQPTAQLLLYHYHLPRGVLLRSCETPPDSSHSV

SEQ ID NO: 840060 - protein, 140 aa, Homo sapiens
MAVTALAARTWLGVWGVRTMQARGFGSDQVRCGSVRCSSPAGGSHLCFRTFTSVPVSLQSENVDRGAGSIREAGGAFGKREQAEEERYFRSGEAHRVPSPALDLPMAFQSLNCQSPHPFLPGALGAPSPNRTPGPQSSIP

SEQ ID NO: 840061 - protein, 85 aa, Homo sapiens
MVSSSFERGQRGSHASMGGRDDSPGAGGYKHGRLSSPRGQRWTRSRSTNSVSGLSSWCAFEVGTPFGAEAIEMGCLTPGPQSSIP

SEQ ID NO: 840062 - protein, 110 aa, Homo sapiens; identical to SEQ ID NO: 840056

SEQ ID NO: 840063 - protein, 110 aa, Homo sapiens; identical to SEQ ID NO: 840056

SEQ ID NO: 840064 - protein, 106 aa, Homo sapiens; identical to SEQ ID NO: 840058

SEQ ID NO: 840065 - protein, 105 aa, Homo sapiens
DLEDPEDSSVGLYDMQARGFGSDQSENVDRGAGSIREAGGAFGKREQAEEERYFRSGEAHRVPSPALDLPMAFQSLNCQSPHPFLPGALGAPSPNRTPGPQSSIP

SEQ ID NO: 840066 - protein, 80 aa, Homo sapiens
DLDSLSVSGVDAAYADGHRAREVHACEPLPLLISPTLLTAALTTSELPRNPSERDSGFYIPVRLTGSQVQPWISQWPSNP

SEQ ID NO: 840067 - protein, 96 aa, Homo sapiens
MSTGARAPSGKPVGPSERESRLKRNDISDITGYALRSLWGEGLKLNPEPPCPCRAQSREQLAALKKHHEEEIVHHKKEIERLQKEIERADAVERAD

SEQ ID NO: 840068 - protein, 677 aa, Homo sapiens
MDFPGHFEQIFQQLNYQRLHGQLCDCVIVVGNRHFKAHRSVLAACSTHFRALFSVAEGDQTMNMIQLDSEVVTAEAFAALIDMMYTSTLMLGESNVMDVLLAASHLHLNSVVKACKHYLTTRTLPMSPPSERVQEQSARMQRSFMLQQLGLSIVSSALNSSQNGEEQPAPMSSSMRSNLDQRTPFPMRRLHKRKQSAEERARQRLRPSIDESAISDVTPENGPSGVHSREEFFSPDSLKIVDNPKADGMTDNQEDSAIMFDQSFGTQEDAQVPSQSDNSAGNMAQLSMASRATQVETSFDQEAAPEKSSFQCENPEVGLGEKEHMRVVVKSEPLSSPEPQDEVSDVTSQAEGSESVEVEGVVVSAEKIDLSPESSDRSFSDPQSSTDRVGDIHILEVTNNLEHKSTFSISNFLNKSRGNNFTANQNNDDNIPNTTSDCRLESEAPYLLSPEAGPAGGPSSAPGSHVENPFSEPADSHFVRPMQEVMGLPCVQTSGYQGGEQFGMDFSRSGLGLHSSFSRVMIGSPRGGASNFPYYRRIAPKMPVVTSVRSSQIPENSTSSQLMMNGATSSFENGHPSQPGPPQLTRASADVLSKCKKALSEHNVLVVEGARKYACKICCKTFLTLTDCKKHIRVHTGEKPYACLKCGKRFSQSSHLYKHSKTTCLRWQSSNLPSTLL

SEQ ID NO: 840069 - protein, 104 aa, Homo sapiens
ARRPYQSICTLTRASADVLSKCKKALSEHNVLVVEGARKYACKICCKTFLTLTDCKKHIRVHTGEKPYACLKCGKRFSQSSHLYKHSKTTCLRWQSSNLPSTLL

SEQ ID NO: 840070 - protein, 677 aa, Homo sapiens; identical to SEQ ID NO: 840068

SEQ ID NO: 840071 - protein, 677 aa, Homo sapiens; identical to SEQ ID NO: 840068

SEQ ID NO: 840072 - protein, 47 aa, Homo sapiens
PVADIDSWLSAKGLNHPWSILEWSDTTGQWMSLCPAWSVSLPGPLLL

SEQ ID NO: 840073 - protein, 102 aa, Homo sapiens
AACPLKTLPLCASALRVGVGGGVADRRQSFLGAKAKGGNKSHVWLKARLKPWGQRQGVFSDVERWVLLLISEERTRNPDMLGRVRWLTPVIPALWEAKAGGS

SEQ ID NO: 840074 - protein, 144 aa, Homo sapiens
RLLLGPGAGLRGGVVLKVSPSPCRGGRRVPVRAEGARGRGPRNKVPGASSGAAVGAARLTAPLLAKAMASKLLRAVILGPPGSGKGTVCQRIAQNFGLQHLSSGHFLRENIKASTEVGEMAKQYIEKSLLVPDHVITRLMMSEL

SEQ ID NO: 840075 - protein, 219 aa, Homo sapiens
GSLTDHGLLGNGLGAAPGWRWPAGAGDFLPPGQTDPCFLFFKIQKASPNICPEECETYFPGLSFTLFYFCVDKQWGKCRASSQADKKTTIPVRPPTRRRHKWPRPRHFSSFCEVGSWVGSMRVVMARLLSEGEQGIPTACAAFAQQPGGRPRRGLAGVGEGGPQCSWVNYRCTLEFLVSLLGTDLARGRGNSASGPTAPADSKQLSCKTFIAVLSLSKE

SEQ ID NO: 840076 - protein, 113 aa, Homo sapiens
YRLGTRLVGSWVGSMRVVMARLLSEGEQGIPTACAAFAQQPGGRPRRGLAGVGEGGPQCSWVNYRCTLEFLVSLLGTDLARGRGNSASGPTAPADSKQLSCKTFIAVLSLSKE

SEQ ID NO: 840077 - protein, 291 aa, Homo sapiens
GSLTDHGLLGNGLGAAPGWRWPAGAGDFLPPGQTDPCFLFFKIQKASPNICPEECETYFPGLSFTLFYFCVDKQWGKCRASSQADKKTTIPVRPPTRRRHKWPRPRHFSSFCEVGSWVGSMRVVMARLLSEGEQGIPTACAAFAQQPGGRPRRGLAGVGEGGPQCSWVNYRCTLEFLVSLLGTDLARGRGNSASGPTAPADSKQLSCKTFIAVLSLSKEAGFCHVVQAGLYSWAQAVLLPQSPKVLELQGMNSGSPARDNAPSQRFCTNLSEGLRFGISPSWREALYGCHA

SEQ ID NO: 840078 - protein, 219 aa, Homo sapiens; identical to SEQ ID NO: 840075

SEQ ID NO: 840079 - protein, 205 aa, Homo sapiens
GSLTDHGLLGNGLGAAPGWRWPAGAGDFLPPGQTDPCFLFFKIQKASPNICPEECETYFPGLSFTLFYFCVDKQWGKCRASSQADKKTTIPVRPPTRRRHKWPRPRHFSSFCEVGSWVGSMRVVMARLLSEGEQGIPTACAAFAQQPGGRPRRGLAGVGEGGPQCSWVNYRCTLEFLVSLLGTDLARGRGNSASGPTAPADSKQL

SEQ ID NO: 840080 - protein, 246 aa, Homo sapiens
GSLTDHGLLGNGLGAAPGWRWPAGAGDFLPPGQTDPCFLFFKIQKASPNICPEECETYFPGLSFTLFYFCVDKQWGKCRASSQADKKTTIPVRPPTRRRHKWPRPRHFSSFCEVGSWVGSMRVVMARLLSEGEQGIPTACAAFAQQPGGRPRRGLAGVGEGGPQCSWVNYRCTLEFLVSLLGTDLARGRGNSASGPTAPADSKQLMNSGSPARDNAPSQRFCTNLSEGLRFGISPSWREALYGCHA

SEQ ID NO: 840081 - protein, 219 aa, Homo sapiens; identical to SEQ ID NO: 840075

SEQ ID NO: 840082 - protein, 219 aa, Homo sapiens; identical to SEQ ID NO: 840075

SEQ ID NO: 840083 - protein, 219 aa, Homo sapiens; identical to SEQ ID NO: 840075

SEQ ID NO: 840084 - protein, 291 aa, Homo sapiens; identical to SEQ ID NO: 840077

SEQ ID NO: 840085 - protein, 219 aa, Homo sapiens; identical to SEQ ID NO: 840075

SEQ ID NO: 840086 - protein, 219 aa, Homo sapiens; identical to SEQ ID NO: 840075

SEQ ID NO: 840087 - protein, 205 aa, Homo sapiens; identical to SEQ ID NO: 840079

SEQ ID NO: 840088 - protein, 113 aa, Homo sapiens; identical to SEQ ID NO: 840076

SEQ ID NO: 840089 - protein, 253 aa, Homo sapiens
GSLTDHGLLGNGLGAAPGWRWPAGAGDFLPPGQTDPCFLFFKIQKASPNICPEECETYFPGLSFTLFYFCVDKQWGKCRASSQADKKTTIPVRPPTRRRHKWPRPRHFSSFCEVGSWVGSMRVVMARLLSEGEQGIPTACAAFAQQPGGRPRRGLAGVGEGGPQCSWVNYRCTLEFLVSLLGTDLARGRGNSASGPTAPADSKQLSCKTFIAVLSLSKGRNARISLQHPPSGLKWSFHLSFLGLQARATTTPG

SEQ ID NO: 840090 - protein, 219 aa, Homo sapiens; identical to SEQ ID NO: 840075

SEQ ID NO: 840091 - protein, 219 aa, Homo sapiens; identical to SEQ ID NO: 840075

SEQ ID NO: 840092 - protein, 219 aa, Homo sapiens; identical to SEQ ID NO: 840075

SEQ ID NO: 840093 - protein, 291 aa, Homo sapiens; identical to SEQ ID NO: 840077

SEQ ID NO: 840094 - protein, 219 aa, Homo sapiens; identical to SEQ ID NO: 840075

SEQ ID NO: 840095 - protein, 220 aa, Homo sapiens
GSLTDHGLLGNGLGAAPGWRWPAGAGDFLPPGQTDPCFLFFKIQKASPNICPEECETYFPGLSFTLFYFCVDKQWGKCRASSQADKKTTIPVRPPTRRRHKWPRPRHFSSFCEVGSWVGSMRVVMARLLSEGEQGIPTACAAFAQQPGGRPRRGLAGVGEGGPQCSWVNYRCTLEFLVSLLGTDLARGRGNSASGPTAPADSKQLVVGHSKASGDISTPP

SEQ ID NO: 840096 - protein, 367 aa, Homo sapiens
MYPESTTGSPARLSLRQTGSPGMIYSTRYGSPKRQLQFYRNLGKSGLRVSCLGLGTWVTFGGQITDEMAEQLMTLAYDNGINLFDTAEVYAAGKAEVVLGNIIKKKGWRRSSLVITTKIFWGGKAETERGLSRKHIIEGLKASLERLQLEYVDVVFANRPDPNTPMEETVRAMTHVINQGMAMYWGTSRWSSMEIMEAYSVARQFNLTPPICEQAEYHMFQREKVEVQLPELFHKIGVGAMTWSPLACGIVSGKYDSGIPPYSRASLKGYQWLKDKILSEEGRRQQAKLKELQAIAERLGCTLPQLAIAWCLRNEGVSSVLLGASNADQLMENIGAIQVLPKLSSSIIHEIDSILGNKPYSKKDYRS

SEQ ID NO: 840097 - protein, 367 aa, Homo sapiens; identical to SEQ ID NO: 840096

SEQ ID NO: 840098 - protein, 353 aa, Homo sapiens
MYPESTTGSPARLSLRQTGSPGMIYRNLGKSGLRVSCLGLGTWVTFGGQITDEMAEQLMTLAYDNGINLFDTAEVYAAGKAEVVLGNIIKKKGWRRSSLVITTKIFWGGKAETERGLSRKHIIEGLKASLERLQLEYVDVVFANRPDPNTPMEETVRAMTHVINQGMAMYWGTSRWSSMEIMEAYSVARQFNLTPPICEQAEYHMFQREKVEVQLPELFHKIGVGAMTWSPLACGIVSGKYDSGIPPYSRASLKGYQWLKDKILSEEGRRQQAKLKELQAIAERLGCTLPQLAIAWCLRNEGVSSVLLGASNADQLMENIGAIQVLPKLSSSIIHEIDSILGNKPYSKKDYRS

SEQ ID NO: 840099 - protein, 194 aa, Homo sapiens
MAAPAASRLLTGKGPRGPFLPSQEAYSVARQFNLTPPICEQAEYHMFQREKVEVQLPELFHKIGVGAMTWSPLACGIVSGKYDSGIPPYSRASLKGYQWLKDKILSEEGRRQQAKLKELQAIAERLGCTLPQLAIAWCLRNEGVSSVLLGASNADQLMENIGAIQVLPKLSSSIIHEIDSILGNKPYSKKDYRS

SEQ ID NO: 840100 - protein, 173 aa, Homo sapiens
MYPESTTGSPARLSLRQTGSPGMIYSTRYGSPKRQLQFYRNLGKSGLRVSCLGLGTWVTFGGQITDEMAEQLMTLAYDNGINLFDTAEVYAAGKAEVVLGNIIKKKGWRQRGERAGQARVTPPCSLGRRARDASKSAGAGCHLQAQACVPSSTQALQTTRGRAPLKPPPPLAS

SEQ ID NO: 840101 - protein, 202 aa, Homo sapiens
MYPESTTGSPARLSLRQTGSPGMIYRNLGKSGLRVSCLGLGTWVTFGGQITDEMAEQLMTLAYDNGINLFDTAEVYAAGKAEVVLGNIIKKKGWRRSSLVITTKIFWGGKAETERGLSRKHIIEGLKASLERLQLEYVDVVFANRPDPNTPMEETVRAMTHVSHSALCSDPRSQGVTGASSHLLSLSSHVNNVLFLSPSLFF

SEQ ID NO: 840102 - protein, 197 aa, Homo sapiens
MYPESTTGSPARLSLRQTGSPGMIYRNLGKSGLRVSCLGLGTWVTFGGQITDEMAEQLMTLAYDNGINLFDTAEVYAAGKAEVVLGNIIKKKGWRIFAASQPLRSSLFPSVRGCVWDRSGRAILRVSGPKSVNHPPSSGRDVSHSSGKWSPPAQTGERSPGVMEPKGRRSGAIHPSLPGAYGPFPGQGPHPPWDQLG

SEQ ID NO: 840103 - protein, 367 aa, Homo sapiens; identical to SEQ ID NO: 840096

SEQ ID NO: 840104 - protein, 367 aa, Homo sapiens; identical to SEQ ID NO: 840096

SEQ ID NO: 840105 - protein, 353 aa, Homo sapiens; identical to SEQ ID NO: 840098

SEQ ID NO: 840106 - protein, 223 aa, Homo sapiens [sequence omitted]

SEQ ID NO: 840107 - protein, 353 aa, Homo sapiens; identical to SEQ ID NO: 840098

SEQ ID NO: 840108 - protein, 164 aa, Homo sapiens
MYPESTTGSPARLSLRQTGSPGMIYRNLGKSGLRVSCLGLGTWVTFGGQITDEMAEQLMTLAYDNGINLFDTAEVYAAGKAEVVLGNIIKKKGWRIFAASQPLRSSLFPSVRGNIRSSYKVGPPSSLPSKCHSESQCQGEPPPPPPWIPDTPSSCPIKFVFWQL

SEQ ID NO: 840109 - protein, 166 aa, Homo sapiens
IPEEDDFGDVLWDIHDEQEQMETFQQASNSAHELGFEKYYQRLNDLVAAPAPIPPLLVSGGPGSGKSLLLSKWIQLQQKNSPNTLILSHFVGRPMSTSSESSLIIKRLTLKLMQHSWSVSALTLDPAKLLEEFPRWLEKLSARHQGSIIIVIDSIDQVQVVAYTSS

SEQ ID NO: 840110 - protein, 270 aa, Homo sapiens
IPEEDDFGDVLWDIHDEQEQMETFQQASNSAHELGFEKYYQRLNDLVAAPAPIPPLLVSGGPGSGKSLLLSKWIQLQQKNSPNTLILSHFVGRPMSTSSESSLIIKRLTLKLMQHSWSVSALTLDPAKLLEEFPRWLEKLSARHQGSIIIVIDSIDQVQQVEKHMKWLIDPLPVNVRVIVSVNVETCPPAWRLWPTLHLDPLSPKDAKSIIIAECHSVDIKLSKEQEKKLERHCRSATTCNALYVTLFGKMIARAGRAGNLDKILHQCFQ

SEQ ID NO: 840111 - protein, 166 aa, Homo sapiens; identical to SEQ ID NO: 840109

SEQ ID NO: 840112 - protein, 166 aa, Homo sapiens; identical to SEQ ID NO: 840109

SEQ ID NO: 840113 - protein, 72 aa, Homo sapiens
RRCEGRCSQEQTEVGMNQYTPTSGPQGRMRGAVGVGRRPLCVMLTVSAESPASAGAVPVGSSVTCLTASFAQ

SEQ ID NO: 840114 - protein, 72 aa, Homo sapiens; identical to SEQ ID NO: 840113

SEQ ID NO: 840115 - protein, 72 aa, Homo sapiens; identical to SEQ ID NO: 840113

SEQ ID NO: 840116 - protein, 134 aa, Homo sapiens
SRVGSEEQRKAVGDVATVPRDHPAMETRELSLRGRGLASKKDREWTGRGPLSSGPKEDSSRRRESERQGPCAGLLLRLQAGSLPEAVQKHSSAGPTRFLSHVKFRSSVKTHSSPAGVLRDARSLWGQFGKLTFM

SEQ ID NO: 840117 - protein, 130 aa, Homo sapiens
MSGRGKQGGKARAKAKSRSSRAGLQFPVGRVHRLLRKGNYAERVGAGAPVYLAAVLEYLTAEILELAGNAARDNKKTRIIPRHLQLAIRNDEELNKLLGRVTIAQGGVLPNIQAVLLPKKTESHHKAKGK

SEQ ID NO: 840118 - protein, 130 aa, Homo sapiens; identical to SEQ ID NO: 840117

SEQ ID NO: 840119 - protein, 130 aa, Homo sapiens; identical to SEQ ID NO: 840117

SEQ ID NO: 840120 - protein, 130 aa, Homo sapiens; identical to SEQ ID NO: 840117

SEQ ID NO: 840121 - protein, 130 aa, Homo sapiens; identical to SEQ ID NO: 840117

SEQ ID NO: 840122 - protein, 130 aa, Homo sapiens; identical to SEQ ID NO: 840117

SEQ ID NO: 840123 - protein, 130 aa, Homo sapiens; identical to SEQ ID NO: 840117

SEQ ID NO: 840124 - protein, 130 aa, Homo sapiens; identical to SEQ ID NO: 840117

SEQ ID NO: 840125 - protein, 130 aa, Homo sapiens; identical to SEQ ID NO: 840117

SEQ ID NO: 840126 - protein, 130 aa, Homo sapiens; identical to SEQ ID NO: 840117

SEQ ID NO: 840127 - protein, 130 aa, Homo sapiens; identical to SEQ ID NO: 840117

SEQ ID NO: 840128 - protein, 503 aa, Homo sapiens
EKPYECKECGEAFRTSRQLTVHHRFHYGEKPYECKECGKAFSVYGRLSRHQSIHTGEKPFECNKCGKSFRLKAGLKVHQSIHTGEKPHECKECGKAFRQFSHLVGHKRIHTGEKPYECKECGKGFTCRYQLTMHQRIYSGEKHYECKENGEAFSSGHQLTAPHTFESVEKPYKCEECGKAFSVHGRLTRHQGIHSGKKPYECNKCGKSFRLNSSLKIHQNIHTGEKPYKCKECGKAFSQRAHLAHHNRIHTGYKPFECKECGKSFRCASYLVIHERIHTGEKPYVCQECGKGFSYSHKLTIHRRVHTGEKPYECKECGKAFSVSGQLTQHLSIHSGKKPFECNKCGKSFRFISVLKAHQNIHSAEKPYECKECGKAFRHATSLIYHDRTHAGEKSYECKECGETFSHASHLIIHERIHTSDKPYECKRCGKAFHCASYLVRHESVHADGNPYMCEECGKAFNSSHELSIHHRVHTGEKPFKCNKCRRSFRLRSILEVHQRIHI

SEQ ID NO: 840129 - protein, 232 aa, Homo sapiens
MGPPSSSGFYVSRAVALLLAGLVAALLLALAVLAALYGHCERVPPSELPGLQGLGSRVFPSPQAEADADPETQQCTRASGDDHPEQLGPPGPWDQLRLPPWLVPLHYDLELWPQLRPDELPAGSLPFTGRVNITVRCTVATSRLLLHSLFQDCERAEVRGPLSPGTGNATVGRVPVDDVWFALDTEYMVLELSEPLKPGSSYELQLSFSGLVKEDLREGLFLNVYTDQGERR

SEQ ID NO: 840130 - protein, 211 aa, Homo sapiens
MQSAMFLAVQHDCRPMDKSAGSGHKSEEKREKMKRTLLKDWKTRLSYFLQNSSTPGKPKTGKKSKQQAFIKPSPEEAQLWSEAFDELLASKYGLAAFRAFLKSEFCEENIEFWLACEDFKKTKSPQKLSSKARKIYTDFIEKEAPKEINIDFQTKTLIAQNIQEATSGCFTTAQKRVYSLMENNSYPRFLESEFYQDLCKKPQITTEPHAT

SEQ ID NO: 840131 - protein, 75 aa, Homo sapiens
GKQPGLQRENDNAKCYVLGCSTRLQTHGQERRQWPQERGEARKDETDPVSMAFFPLPPPPAPHCKLQTRYFRARL

SEQ ID NO: 840132 - protein, 237 aa, Homo sapiens
MQSAMFLAVQHDCRPMDKSAGSGHKSEEKREKMKRTLILRLKRVPSIHTLHDEFSSAYTATGSLKDWKTRLSYFLQNSSTPGKPKTGKKSKQQAFIKPSPEEAQLWSEAFDELLASKYGLAAFRAFLKSEFCEENIEFWLACEDFKKTKSPQKLSSKARKIYTDFIEKEAPKEINIDFQTKTLIAQNIQEATSGCFTTAQKRVYSLMENNSYPRFLESEFYQDLCKKPQITTEPHAT

SEQ ID NO: 840133 - protein, 165 aa, Homo sapiens [sequence omitted]

SEQ ID NO: 840134 - protein, 82 aa, Homo sapiens
ANSRGSSGRTIMQSAMFLAVQHDCRPMDKSAGSGHKSEEKREKMKRTLLKDWKTRLSYFLQNSSTPGKPKTGKKSKQQAFIK

SEQ ID NO: 840135 - protein, 238 aa, Homo sapiens
YCLKFAEYNSDLHQFFEFLYNHGIGTLSSPLYIAWAGHLEAQGELQHASAVLQRGIQNQAEPREFLQQQYRLFQTRLTETHLPAQARTSEPLHNVQVLNQMITSKSNPGNNMACISKNQGSELSGVISSACDKESNMERRVITISKSEYSVHSSLASKVDVEQVVMYCKEKLIRGESEFSFENLIAQNIQEATSGCFTTAQKRVYSLMENNSYPRFLESEFYQDLCKKPQITTEPHAT

SEQ ID NO: 840136 - protein, 194 aa, Homo sapiens
MQSAMFLAVQHDCRPMDKSAGSGHKSEEKREKMKRTLLKDWKTRLSYFLQNSSTPGKPKTGKKSKQQAFIKPSPEEAQLWSEAFDELLASKYGLAAFRAFLKSEFCEENIEFWLACEDFKKTKSPQKLSSKARKIYTDFIEKEAPKEINIDFQTKTLIAQNIQEATSGCFTTAQKRVYSLMGARCAILLPSGFH

SEQ ID NO: 840137 - protein, 75 aa, Homo sapiens; identical to SEQ ID NO: 840131

SEQ ID NO: 840138 - protein, 211 aa, Homo sapiens; identical to SEQ ID NO: 840130

SEQ ID NO: 840139 - protein, 211 aa, Homo sapiens; identical to SEQ ID NO: 840130

SEQ ID NO: 840140 - protein, 211 aa, Homo sapiens; identical to SEQ ID NO: 840130

SEQ ID NO: 840141 - protein, 211 aa, Homo sapiens; identical to SEQ ID NO: 840130

SEQ ID NO: 840142 - protein, 106 aa, Homo sapiens
MFGYRKCGVEVLAATLFLDLPRLTFELSCSQSSSIYQMGETLGQLYKLLFAFFGSATAPIAVTIGEKTKLFHKFHGEESISHWKARNGQDSVFAITNKTLVMKNNL

SEQ ID NO: 840143 - protein, 169 aa, Homo sapiens
MQCLLPYQSKEPSCLPPLPLNLPLPPCLCPLLQLNAAMTRKEKTKEGQRAAQFSAGADAGSGGGLSRQKDTKRPMLLVIHDVVLELLTSSDCHANPRKYPTCQKSEVLGVSIYVSICPSTRPRDKNKTKKRCQVLEAVLVSKPSGSCHQGSFEIVPHVKGNLAFTSSNH

SEQ ID NO: 840144 - protein, 1179 aa, Homo sapiens
RPPPRPGRRALVLARARESAELPLPAGWEEARDYDGRVFYIDHNTRQTSWIDPRDRITKPLTFADCVGDELPLGWETVYDKQIGVYYMDHINKLTQIEDPREQWRREQERMLKEYLIVAQEALNAKKEIYQIKQQRFELAQEEYQQLHKMCEDDSRSYASSFSGYSTNTKYDPHQIKAEIASRRDRLSRLKRELTQMKQELQYKEKGVETLQEIDRKMSSTHTSYKLDEAQAIMSELRTIKKAICTGEKERRDLMHSLAKLTDSFKNSCSVTDSLVDFPHHVGVPGDAGVPQQFCDAGSQTDIIGEFVFDDKTRLVDRVRLNWQYEEARKRVANIQQQLARLDNESWPSTAEADRDRLQLIKEKEALLQELQLIIAQRRSAGDVARLEEERERLEEELRRARATSAQGATERILLQEKRNCLLMQLEEATRLTSYLQSQLKSLCASTLTVSSGSSRGSLASSRGSLASSRGSLSSVSFTDIYGLPQYEKPDAEGSQLLRFDLIPFDSLGRDAPFSEPPGPSGFHKQRRSLDTPQSLASLSSRSSLSSLSPPSSPLDTPFLPASRDSPLAQLADSCEGPGLGALDRLRAHASAMGDEDLPGMAALQPHGVPGDGEGPHERGPPPASAPVGGTVTLREDSAKRLERRARRISACLSDYSLASDSGVFEPLTKRNEDAEEPAYGDTASNGDPQIHVGLLRDSGSECLLVHVLQLKNPAGLAVKEDCKVHIRVYLPPLDSGTPNTYCSKALEFQVPLVFNEVFRIPVHSSALTLKSLQLYVCSVTPQLQEELLGIAQINLADYDSLSEMQLRWHSVQVFTSSEPSRTREAGCAGESSARDPAHTISISGKTDAVTVLLARTTAQLQAVERELAEERAKLEYTEEEVLEMERKEEQAEAISERSWQADSVDSGCSNCTQTSPPYPEPCCMGIDSILGHPFAAQAGPYSPEKFQPSPLKVDKETNTEDLFLEEAASLVKERPSRRARGSPFVRSGTIVRSQTFSPGARSQYVCRLYRSDSDSSTLPRKSPFVRNTLERRTLRYKQSCRSSLAELMARTSLDLELDLQASRTRQRQLNEELCALRELRQRLEDAQLRGQTDLPPWVLRDERLRGLLREAERQTRQTKLDYRHEQAAEKMLKKASKEIYQLRGQSHKEPIQVQTFREKIAFFTRPRINIPPLPADDV

SEQ ID NO: 840145 - protein, 138 aa, Homo sapiens
AAGGRAAGGGPLWPAPACTSLLPAPGSEGSLPDTEVVPEIPHHWALGVPSPSVGCEGGVCVASACIWRLRVLEEGSRALPTLLGEHSGSPVARPDCSHPLASVSWEEFLGGSVGEVGLTPSCHHSLTVVGSSGLQGWQ

SEQ ID NO: 840146 - protein, 115 aa, Homo sapiens
RFPHVTRCPAPGNWAPGISSPGADRWPSFPFSAAASPIPVPGVCGPLPRPWFCRCPQPRGGEMSCHLGSQTCAPALGCGFPVWRVQAGFHPKPDVRRALEGFPTLLELEKSVPKL

SEQ ID NO: 840147 - protein, 1179 aa, Homo sapiens; identical to SEQ ID NO: 840144

SEQ ID NO: 840148 - protein, 1179 aa, Homo sapiens; identical to SEQ ID NO: 840144

SEQ ID NO: 840149 - protein, 1179 aa, Homo sapiens; identical to SEQ ID NO: 840144

SEQ ID NO: 840150 - protein, 210 aa, Homo sapiens
TLEQSVGEWLESIGLQQYESKLLLNGFDDVHFLGSNVMEEQDLRDIGISDPQHRRKLLQAARSLPKVKALGYDGNSPPSVPSWLDSLGLQDYVHSFLSSGYSSIDTVKNLWELELVNVLKVQLLGHRKRIIASLADRPYEEPPQKPPRFSQLRCQDLLSQTSSPLSQNDSCTGRSADLLLPPGDTGRRRHDSLHDPAAPSRAERFRIQVG

SEQ ID NO: 840151 - protein, 613 aa, Homo sapiens
MAATAVAAAVAGTESAQGPPGPAASLELWLNKATDPSMSEQDWSAIQNFCEQVNTDPNGPTHAPWLLAHKIQSPQEKEALYALTVLEMCMNHCEEKFHSEVAKFRFLNELIKVLSPKYLWSWATGKVKGRVIDILFTWTVWFPEDIKIRDAYHMLNKQGIIKQDPKLPVDKILPPPSPWPKSSIFDADEEKSKLLTRLLKSNHPEDLQAANRLIKNLVKEEQEKSEKVSKRVSAVEEVRSHVKVLQEMLSMYRRPGQAPPDQEALQVVYERCEKLRPTLFRLASDTTDDDDALAEILQANDLLTQGVLLYKQVMEGRVTFGNRVTSSLGDIPVSRVFQNPAGCMKTCPLIDLEVDNGPAQMGTVVPSLLHQDLAALGISDAPVTGMVSGQNCCEEKRNPSSSTLPGGGVQNPSADRNLLDLLSPQPAPCPLNYVSQKSVPKEVPPGTKSSPGWSWEAGPLAPSPSSQNTPLAQVFVPLESVKPSSLPPLIVYDRNGFRILLHFSQTGAPGHPEVQVLLLTMMSTAPQPVWDIMFQVAVPKSMRVKLQPASSSKLPAFSPLMPPAVISQMLLLDNPHKEPIRLRYKLTFNQGGQPFSEVGEVKDFPDLAVLGAA

SEQ ID NO: 840152 - protein, 613 aa, Homo sapiens; identical to SEQ ID NO: 840151

SEQ ID NO: 840153 - protein, 613 aa, Homo sapiens; identical to SEQ ID NO: 840151

SEQ ID NO: 840154 - protein, 613 aa, Homo sapiens; identical to SEQ ID NO: 840151

SEQ ID NO: 840155 - protein, 613 aa, Homo sapiens; identical to SEQ ID NO: 840151

SEQ ID NO: 840156 - protein, 613 aa, Homo sapiens; identical to SEQ ID NO: 840151

SEQ ID NO: 840157 - protein, 613 aa, Homo sapiens; identical to SEQ ID NO: 840151

SEQ ID NO: 840158 - protein, 54 aa, Homo sapiens
MRFGQGRHPNYIISSVWKTVVVSMWMLKVADADLLLSGLAVVHYAPSSGSIAVL

SEQ ID NO: 840159 - protein, 112 aa, Homo sapiens
PGGEYRLLDSSILTQGRRSHRFYIFHGEVIFLWICGRDPRAWLKNDVGRWPSKRAPKAGISSTKPATLVGFCLRLHQHGSWPPPVWPPVGTKVPMPFSLKQTGGSGQSSGSP

SEQ ID NO: 840160 - protein, 69 aa, Homo sapiens
GWEAVEAIPNSPNPLQREGRNVGGDSRWGSRMQPAHHSQEERRGHRVKGLFLRSKGSSPSSQADAHSAA

SEQ ID NO: 840161 - protein, 2596 aa, Homo sapiens
MDQTCELPRRNCLLPFSNPVNLDAPEDKDSPFGNGQSNFSEPLNGCTMQLSTVSGTSQNAYGQDSPSCYIPLRRLQDLASMINVEYLNGSADGSESFQDPEKSDSRAQTPIVCTSLSPGGPTALAMKQEPSCNNSPELQVKVTKTIKNGFLHFENFTCVDDADVDSEMDPEQPVTEDESIEEIFEETQTNATCNYETKSENGVKVAMGSEQDSTPESRHGAVKSPFLPLAPQTETQKNKQRNEVDGSNEKAALLPAPFSLGDTNITIEEQLNSINLSFQDDPDSSTSTLGNMLELPGTSSSSTSQELPFVPQKILSKWEASVGLAEQYDVPKGSKNRKCIPGSIKLDSEEDMPFEDCTNDPESEHDLLLNGCLKSLAFDSEHSADEKEKPCAKSRARKSSDNPKRTSVKKGHIQFEAHKDERRGKIPENLGLNFISGDISDTQASNELSRIANSLTGSNTAPGSFLFSSCGKNTAKKEFETSNGDSLLGLPEGALISKCSREKNKPQRSLVCGSKVKLCYIGAGDEEKRSDSISICTTSDDGSSDLDPIEHSSESDNSVLEIPDAFDRTENMLSMQKNEKIKYSRFAATNTRVKAKQKPLISNSHTDHLMGCTKSAEPGTETSQVNLSDLKASTLVHKPQSDFTNDALSPKFNLSSSISSENSLIKGGAANQALLHSKSKQPKFRSIKCKHKENPVMAEPPVINEECSLKCCSSDTKGSPLASISKSGKVDGLKLLNNMHEKTRDSSDIETAVVKHVLSELKELSYRSLGEDVSDSGTSKPSKPLLFSSASSQNHIPIEPDYKFSTLLMMLKDMHDSKTKEQRLMTAQNLVSYRSPGRGDCSTNSPVGVSKVLVSGGSTHNSEKKGDGTQNSANPSPSGGDSALSGELSASLPGLLSDKRDLPASGKSRSDCVTRRNCGRSKPSSKLRDAFSAQMVKNTVNRKALKTERKRKLNQLPSVTLDAVLQGDRERGGSLRGGAEDPSKEDPLQIMGHLTSEDGDHFSDVHFDSKVKQSDPGKISEKGLSFENGKGPELDSVMNSENDELNGVNQVVPKKRWQRLNQRRTKPRKRMNRFKEKENSECAFRVLLPSDPVQEGRDEFPEHRTPSASILEEPLTEQNHADCLDSAGPRLNVCDKSSASIGDMEKEPGIPSLTPQAELPEPAVRSEKKRLRKPSKWLLEYTEEYDQIFAPKKKQKKVQEQVHKVSSRCEEESLLARGRSSAQNKQVDENSLISTKEEPPVLEREAPFLEGPLAQSELGGGHAELPQLTLSVPVAPEVSPRPALESEELLVKTPGNYESKRQRKPTKKLLESNDLDPGFMPKKGDLGLSKKCYEAGHLENGITESCATSYSKDFGGGTTKIFDKPRKRKRQRHAAAKMQCKKVKNDDSSKEIPGSEGELMPHRTATSPKETVEEGVEHDPGMPASKKMQGERGGGAALKENVCQNCEKLGELLLCEAQCCGAFHLECLGLTEMPRGKFICNECRTGIHTCFVCKQSGEDVKRCLLPLCGKFYHEECVQKYPPTVMQNKGFRCSLHICITCHAANPANVSASKGRLMRCVRCPVAYHANDFCLAAGSKILASNSIICPNHFTPRRGCRNHEHVNVSWCFVCSEGGSLLCCDSCPAAFHRECLNIDIPEGNWYCNDCKAGKKPHYREIVWVKVGRYRWWPAEICHPRAVPSNIDKMRHDVGEFPVLFFGSNDYLWTHQARVFPYMEGDVSSKDKMGKGVDGTYKKALQEAAARFEELKAQKELRQLQEDRKNDKKPPPYKHIKVNRPIGRVQIFTADLSEIPRCNCKATDENPCGIDSECINRMLLYECHPTVCPAGGRCQNQCFSKRQYPEVEIFRTLQRGWGLRTQEDIRKGEFVNEYVGELIDEEECMARIKHAHENDITHFYMLTIDKDRIIDAGPKGNYSRFMNHSCQPNCETLKWTVNGDTRVGLFAVCDIPAGTELTFNYNLDCLGNEKTVCRCGASNCSGFLGVRPKNQPIATEEKSKKFKKKQQGKRRTQGEITKEREDECFSCGDAGQLVSCKKPGCPKVYHADCLNLTKRPAGKWECPWHQCDICGKEAASFCEMCPSSFCKQHREGMLFISKLDGRLSCTEHDPCGPNPLEPGEIREYVPPPVPLPPGPSTHLAEQSTGMAAQAPKMSDKPPADTNQMLSLSKKALAGTCQRPLLPERPLERTDSRPQPLDKVRDLAGSGAQSQSLVSSQRPLDRPPAVAGPRPQLSDKPSPVTSPSSSPSVRSQPLESPLGTADPRLDKSIGAASPRPQSLEKTSVPTGLRLPPPDRLLITSSPKPQTSDRPTDKPHASLSQRLPPPEKVLSAVVQTLVAKEKALRPVDQNTQSKNRAALVMDLIDLTPRQKERAASPHQVTPQADEKMPVLESSSWPASKGLGHMPRAVEKGCVSDPLQTSGKAAAPSEDPWQAVKSLTQARLSSQPSAKAFLYEPTTQASGRASAGAEQTQGFFTKSPALVENKGKTKWVGRPTNYLHLAAKSWQSFRSLGKAPPSSPNEEKKLVTTEQSPWALGKASSRAGLWPIVAGQTLAQSCWSAGSTQTLAQTCWSLGRGQDPKPEQNTLPALNQAPSSHKCAESEQK

SEQ ID NO: 840162 - protein, 1301 aa, Homo sapiens
MDQTCELPRRNCLLPFSNPVNLDAPEDKDSPFGNGQSNFSEPLNGCTMQLSTVSGTSQNAYGQDSPSCYIPLRRLQDLASMINVEYLNGSADGSESFQDPEKSDSRAQTPIVCTSLSPGGPTALAMKQEPSCNNSPELQVKVTKTIKNGFLHFENFTCVDDADVDSEMDPEQPVTEDESIEEIFEETQTNATCNYETKSENGVKVAMGSEQDSTPESRHGAVKSPFLPLAPQTETQKNKQRNEVDGSNEKAALLPAPFSLGDTNITIEEQLNSINLSFQDDPDSSTSTLGNMLELPGTSSSSTSQELPFCQPKKKSTPLKYEVGDLIWAKFKRRPWWPCRICSDPLINTHSKMKVSNRRPYRQYYVEAFGDPSERAWVAGKAIVMFEGRHQFEELPVLRRRGKQKEKGYRHKVPQKILSKWEASVGLAEQYDVPKGSKNRKCIPGSIKLDSEEDMPFEDCTNDPESEHDLLLNGCLKSLAFDSEHSADEKEKPCAKSRARKSSDNPKRTSVKKGHIQFEAHKDERRGKIPENLGLNFISGDISDTQASNELSRIANSLTGSNTAPGSFLFSSCGKNTAKKEFETSNGDSLLGLPEGALISKCSREKNKPQRSLVCGSKVKLCYIGAGDEEKRSDSISICTTSDDGSSDLDPIEHSSESDNSVLEIPDAFDRTENMLSMQKNEKIKYSRFAATNTRVKAKQKPLISNSHTDHLMGCTKSAEPGTETSQVNLSDLKASTLVHKPQSDFTNDALSPKFNLSSSISSENSLIKGGAANQALLHSKSKQPKFRSIKCKHKENPVMAEPPVINEECSLKCCSSDTKGSPLASISKSGKVDGLKLLNNMHEKTRDSSDIETAVVKHVLSELKELSYRSLGEDVSDSGTSKPSKPLLFSSASSQNHIPIEPDYKFSTLLMMLKDMHDSKTKEQRLMTAQNLVSYRSPGRGDCSTNSPVGVSKVLVSGGSTHNSEKKGDGTQNSANPSPSGGDSALSGELSASLPGLLSDKRDLPASGKSRSDCVTRRNCGRSKPSSKLRDAFSAQMVKNTVNRKALKTERKRKLNQLPSVTLDAVLQGDRERGGSLRGGAEDPSKEDPLQIMGHLTSEDGDHFSDVHFDSKVKQSDPGKISEKGLSFENGKGPELDSVMNSENDELNGVNQVVPKKRWQRLNQRRTKPRKRMNRFKEKENSECAFRVLLPSDPVQEGRDEFPEHRTPSASILEEPLTEQNHADCLDSAGPRLNVCDKSSASIGDMEKEPGIPSLTPQAELPEPGGVLLCHPGWSAVARSRLTATSASQVQVILLSHPPE

SEQ ID NO: 840163 - protein, 1172 aa, Homo sapiens
MPLKTRTALSDDPDSSTSTLGNMLELPGTSSSSTSQELPFCQPKKKSTPLKYEVGDLIWAKFKRRPWWPCRICSDPLINTHSKMKVSNRRPYRQYYVEAFGDPSERAWVAGKAIVMFEGRHQFEELPVLRRRGKQKEKGYRHKVPQKILSKWEASVGLAEQYDVPKGSKNRKCIPGSIKLDSEEDMPFEDCTNDPESEHDLLLNGCLKSLAFDSEHSADEKEKPCAKSRARKSSDNPKRTSVKKGHIQFEAHKDERRGKIPENLGLNFISGDISDTQASNELSRIANSLTGSNTAPGSFLFSSCGKNTAKKEFETSNGDSLLGLPEGALISKCSREKNKPQRSLVCGSKVKLCYIGAGDEEKRSDSISICTTSDDGSSDLDPIEHSSESDNSVLEIPDAFDRTENMLSMQKNEKIKYSRFAATNTRVKAKQKPLISNSHTDHLMGCTKSAEPGTETSQVNLSDLKASTLVHKPQSDFTNDALSPKFNLSSSISSENSLIKGGAANQALLHSKSKQPKFRSIKCKHKENPVMAEPPVINEECSLKCCSSDTKGSPLASISKSGKVDGLKLLNNMHEKTRDSSDIETAVVKHVLSELKELSYRSLGEDVSDSGTSKPSKPLLFSSASSQNHIPIEPDYKFSTLLMMLKDMHDSKTKEQRLMTAQNLVSYRSPGRGDCSTNSPVGVSKVLVSGGSTHNSEKKGDGTQNSANPSPSGGDSALSGELSASLPGLLSDKRDLPASGKSRSDCVTRRNCGRSKPSSKLRDAFSAQMVKNTVNRKALKTERKRKLNQLPSVTLDAVLQGDRERGGSLRGGAEDPSKEDPLQIMGHLTSEDGDHFSDVHFDSKVKQSDPGKISEKGLSFENGKGPELDSVMNSENDELNGVNQVVPKKRWQRLNQRRTKPRKRMNRFKEKENSECAFRVLLPSDPVQEGRDEFPEHRTPSASILEEPLTEQNHADCLDSAGPRLNVCDKSSASIGDMEKEPGIPSLTPQAELPEPAVRSEKKRLRKPSKWLLEYTEEYDQIFAPKKKQKKVQEQVHKVSSRCEEESLLARGRSSAQNKQVDENSLISTKEEPPVLEREAPFLEGPLAQSELGGGHAELPQLTLSVPVAPEVSPRPALESEELLVKTPGNYESKRQRKPTKKLLESNDLDPGFMPKKGDLGLSKKVCYFCKF

SEQ ID NO: 840164 - protein, 1573 aa, Homo sapiens
MDQTCELPRRNCLLPFSNPVNLDAPEDKDSPFGNGQSNFSEPLNGCTMQLSTVSGTSQNAYGQDSPSCYIPLRRLQDLASMINVEYLNGSADGSESFQDPEKSDSRAQTPIVCTSLSPGGPTALAMKQEPSCNNSPELQVKVTKTIKNGFLHFENFTCVDDADVDSEMDPEQPVTEDESIEEIFEETQTNATCNYETKSENGVKVAMGSEQDSTPESRHGAVKSPFLPLAPQTETQKNKQRNEVDGSNEKAALLPAPFSLGDTNITIEEQLNSINLSFQDDPDSSTSTLGNMLELPGTSSSSTSQELPFCQPKKKSTPLKYEVGDLIWAKFKRRPWWPCRICSDPLINTHSKMKVSNRRPYRQYYVEAFGDPSERAWVAGKAIVMFEGRHQFEELPVLRRRGKQKEKGYRHKVPQKILSKWEASVGLAEQYDVPKGSKNRKCIPGSIKLDSEEDMPFEDCTNDPESEHDLLLNGCLKSLAFDSEHSADEKEKPCAKSRARKSSDNPKRTSVKKGHIQFEAHKDERRGKIPENLGLNFISGDISDTQASNELSRIANSLTGSNTAPGSFLFSSCGKNTAKKEFETSNGDSLLGLPEGALISKCSREKNKPQRSLVCGSKVKLCYIGAGDEEKRSDSISICTTSDDGSSDLDPIEHSSESDNSVLEIPDAFDRTENMLSMQKNEKIKYSRFAATNTRVKAKQKPLISNSHTDHLMGCTKSAEPGTETSQVNLSDLKASTLVHKPQSDFTNDALSPKFNLSSSISSENSLIKGGAANQALLHSKSKQPKFRSIKCKHKENPVMAEPPVINEECSLKCCSSDTKGSPLASISKSGKVDGLKLLNNMHEKTRDSSDIETAVVKHVLSELKELSYRSLGEDVSDSGTSKPSKPLLFSSASSQNHIPIEPDYKFSTLLMMLKDMHDSKTKEQRLMTAQNLVSYRSPGRGDCSTNSPVGVSKVLVSGGSTHNSEKKGDGTQNSANPSPSGGDSALSGELSASLPGLLSDKRDLPASGKSRSDCVTRRNCGRSKPSSKLRDAFSAQMVKNTVNRKALKTERKRKLNQLPSVTLDAVLQGDRERGGSLRGGAEDPSKEDPLQIMGHLTSEDGDHFSDVHFDSKVKQSDPGKISEKGLSFENGKGPELDSVMNSENDELNGVNQVVPKKRWQRLNQRRTKPRKRMNRFKEKENSECAFRVLLPSDPVQEGRDEFPEHRTPSASILEEPLTEQNHADCLDSAGPRLNVCDKSSASIGDMEKEPGIPSLTPQAELPEPAVRSEKKRLRKPSKWLLEYTEEYDQIFAPKKKQKKVQEQVHKVSSRCEEESLLARGRSSAQNKQVDENSLISTKEEPPVLEREAPFLEGPLAQSELGGGHAELPQLTLSVPVAPEVSPRPALESEELLVKTPGNYESKRQRKPTKKLLESNDLDPGFMPKKGDLGLSKKCYEAGHLENGITESCATSYSKDFGGGTTKIFDKPRKRKRQRHAAAKMQCKKVKNDDSSKEIPGSEGELMPHRTATSPKETVEEGVEHDPGMPASKKMQGERGGGAALKENVCQNCEKLGELLLCEAQCCGAFLLLLVQL

SEQ ID NO: 840165 - protein, 1112 aa, Homo sapiens
SAHCNPRLLSSSDSHASASQVAWITVSNRRPYRQYYVEAFGDPSERAWVAGKAIVMFEGRHQFEELPVLRRRGKQKEKGYRHKVPQKILSKWEASVGLAEQYDVPKGSKNRKCIPGSIKLDSEEDMPFEDCTNDPESEHDLLLNGCLKSLAFDSEHSADEKEKPCAKSRARKSSDNPKRTSVKKGHIQFEAHKDERRGKIPENLGLNFISGDISDTQASNELSRIANSLTGSNTAPGSFLFSSCGKNTAKKEFETSNGDSLLGLPEGALISKCSREKNKPQRSLVCGSKVKLCYIGAGDEEKRSDSISICTTSDDGSSDLDPIEHSSESDNSVLEIPDAFDRTENMLSMQKNEKIKYSRFAATNTRVKAKQKPLISNSHTDHLMGCTKSAEPGTETSQVNLSDLKASTLVHKPQSDFTNDALSPKFNLSSSISSENSLIKGGAANQALLHSKSKQPKFRSIKCKHKENPVMAEPPVINEECSLKCCSSDTKGSPLASISKSGKVDGLKLLNNMHEKTRDSSDIETAVVKHVLSELKELSYRSLGEDVSDSGTSKPSKPLLFSSASSQNHIPIEPDYKFSTLLMMLKDMHDSKTKEQRLMTAQNLVSYRSPGRGDCSTNSPVGVSKVLVSGGSTHNSEKKGDGTQNSANPSPSGGDSALSGELSASLPGLLSDKRDLPASGKSRSDCVTRRNCGRSKPSSKLRDAFSAQMVKNTVNRKALKTERKRKLNQLPSVTLDAVLQGDRERGGSLRGGAEDPSKEDPLQIMGHLTSEDGDHFSDVHFDSKVKQSDPGKISEKGLSFENGKGPELDSVMNSENDELNGVNQVVPKKRWQRLNQRRTKPRKRMNRFKEKENSECAFRVLLPSDPVQEGRDEFPEHRTPSASILEEPLTEQNHADCLDSAGPRLNVCDKSSASIGDMEKEPGIPSLTPQAELPEPAVRSEKKRLRKPSKWLLEYTEEYDQIFAPKKKQKKVQEQVHKVSSRCEEESLLARGRSSAQNKQVDENSLISTKEEPPVLEREAPFLEGPLAQSELGGGHAELPQLTLSVPVAPEVSPRPALESEELLVKTPGNYESKRQRKPTKKLLESNDLDPGFMPKKGDLGLSKKVCYFCKF

SEQ ID NO: 840166 - protein, 336 aa, Homo sapiens
MDQTCELPRRNCLLPFSNPVNLDAPEDKDSPFGNGQSNFSEPLNGCTMQLSTVSGTSQNAYGQDSPSCYIPLRRLQDLASMINVEYLNGSADGSESFQDPEKSDSRAQTPIVCTSLSPGGPTALAMKQEPSCNNSPELQVKVTKTIKNGFLHFENFTCVDDADVDSEMDPEQPVTEDESIEEIFEETQTNATCNYETKSENGVKVAMGSEQDSTPESRHGAVKSPFLPLAPQTETQKNKQRNEVDGSNEKAALLPAPFSLGDTNITIEEQLNSINLSFQDDPDSSTSTLGNMLELPGTSSSSTSQELPFRLALSCCPGWRRDSWAHSILLHQLELQ

SEQ ID NO: 840167 - protein, 237 aa, Homo sapiens
MDQTCELPRRNCLLPFSNPVNLDAPEDKDSPFGNGQSNFSEPLNGCTMQLSTVSGTSQNAYGQDSPSCYIPLRRLQDLASMINVEYLNGSADGSESFQDPEKSDSRAQTPIVCTSLSPGGPTALAMKQEPSCNNSPELQVKVTKTIKNGFLHFENFTCVDDADVDSEMDPEQPVTEDESIEEIFEETQTNATCNYETKSENGVKVAMGSEQDSTPESRHGAVKSPFLPLAPQTETQS

SEQ ID NO: 840168 - protein, 1441 aa, Homo sapiens
MDQTCELPRRNCLLPFSNPVNLDAPEDKDSPFGNGQSNFSEPLNGCTMQLSTVSGTSQNAYGQDSPSCYIPLRRLQDLASMINVEYLNGSADGSESFQDPEKSDSRAQTPIVCTSLSPGGPTALAMKQEPSCNNSPELQVKVTKTIKNGFLHFENFTCVDDADVDSEMDPEQPVTEDESIEEIFEETQTNATCNYETKSENGVKVAMGSEQDSTPESRHGAVKSPFLPLAPQTETQKNKQRNEVDGSNEKAALLPAPFSLGDTNITIEEQLNSINLSFQDDPDSSTSTLGNMLELPGTSSSSTSQELPFCQPKKKSTPLKYEVGDLIWAKFKRRPWWPCRICSDPLINTHSKMKVSNRRPYRQYYVEAFGDPSERAWVAGKAIVMFEGRHQFEELPVLRRRGKQKEKGYRHKVPQKILSKWEASVGLAEQYDVPKGSKNRKCIPGSIKLDSEEDMPFEDCTNDPESEHDLLLNGCLKSLAFDSEHSADEKEKPCAKSRARKSSDNPKRTSVKKGHIQFEAHKDERRGKIPENLGLNFISGDISDTQASNELSRIANSLTGSNTAPGSFLFSSCGKNTAKKEFETSNGDSLLGLPEGALISKCSREKNKPQRSLVCGSKVKLCYIGAGDEEKRSDSISICTTSDDGSSDLDPIEHSSESDNSVLEIPDAFDRTENMLSMQKNEKIKYSRFAATNTRVKAKQKPLISNSHTDHLMGCTKSAEPGTETSQVNLSDLKASTLVHKPQSDFTNDALSPKFNLSSSISSENSLIKGGAANQALLHSKSKQPKFRSIKCKHKENPVMAEPPVINEECSLKCCSSDTKGSPLASISKSGKVDGLKLLNNMHEKTRDSSDIETAVVKHVLSELKELSYRSLGEDVSDSGTSKPSKPLLFSSASSQNHIPIEPDYKFSTLLMMLKDMHDSKTKEQRLMTAQNLVSYRSPGRGDCSTNSPVGVSKVLVSGGSTHNSEKKGDGTQNSANPSPSGGDSALSGELSASLPGLLSDKRDLPASGKSRSDCVTRRNCGRSKPSSKLRDAFSAQMVKNTVNRKALKTERKRKLNQLPSVTLDAVLQGDRERGGSLRGGAEDPSKEDPLQIMGHLTSEDGDHFSDVHFDSKVKQSDPGKISEKGLSFENGKGPELDSVMNSENDELNGVNQVVPKKRWQRLNQRRTKPRKRMNRFKEKENSECAFRVLLPSDPVQEGRDEFPEHRTPSASILEEPLTEQNHADCLDSAGPRLNVCDKSSASIGDMEKEPGIPSLTPQAELPEPAVRSEKKRLRKPSKWLLEYTEEYDQIFAPKKKQKKVQEQVHKVSSRCEEESLLARGRSSAQNKQVDENSLISTKEEPPVLEREAPFLEGPLAQSELGGGHAELPQLTLSVPVAPEVSPRPALESEELLVKTPGNYESKRQRKPTKKLLESNDLDPGFMPKKGDLGLSKKVCYFCKF

SEQ ID NO: 840169 - protein, 1463 aa, Homo sapiens
MDQTCELPRRNCLLPFSNPVNLDAPEDKDSPFGNGQSNFSEPLNGCTMQLSTVSGTSQNAYGQDSPSCYIPLRRLQDLASMINVEYLNGSADGSESFQDPEKSDSRAQTPIVCTSLSPGGPTALAMKQEPSCNNSPELQVKVTKTIKNGFLHFENFTCVDDADVDSEMDPEQPVTEDESIEEIFEETQTNATCNYETKSENGVKVAMGSEQDSTPESRHGAVKSPFLPLAPQTETQKNKQRNEVDGSNEKAALLPAPFSLGDTNITIEEQLNSINLSFQDDPDSSTSTLGNMLELPGTSSSSTSQELPFCQPKKKSTPLKYEVGDLIWAKFKRRPWWPCRICSDPLINTHSKMKVSNRRPYRQYYVEAFGDPSERAWVAGKAIVMFEGRHQFEELPVLRRRGKQKEKGYRHKVPQKILSKWEASVGLAEQYDVPKGSKNRKCIPGSIKLDSEEDMPFEDCTNDPESEHDLLLNGCLKSLAFDSEHSADEKEKPCAKSRARKSSDNPKRTSVKKGHIQFEAHKDERRGKIPENLGLNFISGDISDTQASNELSRIANSLTGSNTAPGSFLFSSCGKNTAKKEFETSNGDSLLGLPEGALISKCSREKNKPQRSLVCGSKVKLCYIGAGDEEKRSDSISICTTSDDGSSDLDPIEHSSESDNSVLEIPDAFDRTENMLSMQKNEKIKYSRFAATNTRVKAKQKPLISNSHTDHLMGCTKSAEPGTETSQVNLSDLKASTLVHKPQSDFTNDALSPKFNLSSSISSENSLIKGGAANQALLHSKSKQPKFRSIKCKHKENPVMAEPPVINEECSLKCCSSDTKGSPLASISKSGKVDGLKLLNNMHEKTRDSSDIETAVVKHVLSELKELSYRSLGEDVSDSGTSKPSKPLLFSSASSQNHIPIEPDYKFSTLLMMLKDMHDSKTKEQRLMTAQNLVSYRSPGRGDCSTNSPVGVSKVLVSGGSTHNSEKKGDGTQNSANPSPSGGDSALSGELSASLPGLLSDKRDLPASGKSRSDCVTRRNCGRSKPSSKLRDAFSAQMVKNTVNRKALKTERKRKLNQLPSVTLDAVLQGDRERGGSLRGGAEDPSKEDPLQIMGHLTSEDGDHFSDVHFDSKVKQSDPGKISEKGLSFENGKGPELDSVMNSENDELNGVNQVVPKKRWQRLNQRRTKPRKRMNRFKEKENSECAFRVLLPSDPVQEGRDEFPEHRTPSASILEEPLTEQNHADCLDSAGPRLNVCDKSSASIGDMEKEPGIPSLTPQAELPEPAVRSEKKRLRKPSKWLLEYTEEYDQIFAPKKKQKKVQEQVHKVSSRCEEESLLARGRSSAQNKQVDENSLISTKEEPPVLEREAPFLEGPLAQSELGGGHAELPQLTLSVPVAPEVSPRPALESEELLVKTPGNYESKRQRKPTKKLLESNDLDPGFMPKKGDLGLSKKCYEAGHLENGITESCATSYSKDFGGGEYF

SEQ ID NO: 840170 - protein, 987 aa, Homo sapiens
MPFEDCTNDPESEHDLLLNGCLKSLAFDSEHSADEKEKPCAKSRARKSSDNPKRTSVKKGHIQFEAHKDERRGKIPENLGLNFISGDISDTQASNELSRIANSLTGSNTAPGSFLFSSCGKNTAKKEFETSNGDSLLGLPEGALISKCSREKNKPQRSLVCGSKVKLCYIGAGDEEKRSDSISICTTSDDGSSDLDPIEHSSESDNSVLEIPDAFDRTENMLSMQKNEKIKYSRFAATNTRVKAKQKPLISNSHTDHLMGCTKSAEPGTETSQVNLSDLKASTLVHKPQSDFTNDALSPKFNLSSSISSENSLIKGGAANQALLHSKSKQPKFRSIKCKHKENPVMAEPPVINEECSLKCCSSDTKGSPLASISKSGKVDGLKLLNNMHEKTRDSSDIETAVVKHVLSELKELSYRSLGEDVSDSGTSKPSKPLLFSSASSQNHIPIEPDYKFSTLLMMLKDMHDSKTKEQRLMTAQNLVSYRSPGRGDCSTNSPVGVSKVLVSGGSTHNSEKKGDGTQNSANPSPSGGDSALSGELSASLPGLLSDKRDLPASGKSRSDCVTRRNCGRSKPSSKLRDAFSAQMVKNTVNRKALKTERKRKLNQLPSVTLDAVLQGDRERGGSLRGGAEDPSKEDPLQIMGHLTSEDGDHFSDVHFDSKVKQSDPGKISEKGLSFENGKGPELDSVMNSENDELNGVNQVVPKKRWQRLNQRRTKPRKRMNRFKEKENSECAFRVLLPSDPVQEGRDEFPEHRTPSASILEEPLTEQNHADCLDSAGPRLNVCDKSSASIGDMEKEPGIPSLTPQAELPEPAVRSEKKRLRKPSKWLLEYTEEYDQIFAPKKKQKKVQEQVHKVSSRCEEESLLARGRSSAQNKQVDENSLISTKEEPPVLEREAPFLEGPLAQSELGGGHAELPQLTLSVPVAPEVSPRPALESEELLVKTPGNYESKRQRKPTKKLLESNDLDPGFMPKKGDLGLSKKVCYFCKF

SEQ ID NO: 840171 - protein, 328 aa, Homo sapiens
MDQTCELPRRNCLLPFSNPVNLDAPEDKDSPFGNGQSNFSEPLNGCTMQLSTVSGTSQNAYGQDSPSCYIPLRRLQDLASMINVEYLNGSADGSESFQDPEKSDSRAQTPIVCTSLSPGGPTALAMKQEPSCNNSPELQVKVTKTIKNGFLHFENFTCVDDADVDSEMDPEQPVTEDESIEEIFEETQTNATCNYETKSENGVKVAMGSEQDSTPESRHGAVKSPFLPLAPQTETQKNKQRNEVDGSNEKAALLPAPFSLGDTNITIEEQLNSINLSFQDDPDSSTSTLGNMLELPGTSSSSTSQELPFVSSFWYNLNIYIYVYIQAT

SEQ ID NO: 840172 - protein, 189 aa, Homo sapiens [sequence omitted]

SEQ ID NO: 840173 - protein, 389 aa, Homo sapiens
MEVTTRLTWNDENHLRKLLGNVSLSLLYKSSVHGGSIEDMVERCSRQGCTITMAYIDYNMIVAFMLGNYINLRESSTEPNDSLWFSLQKKNDTTEIETLLLNTAPKIIDEQLVCRLSKTDIFIICRDNKIYLDKMITRNLKLRFYGHRQYLECEVFRVEGIKDNLDDIKRIIKAREHRNRLLADIRDYRPYADLVSEIRILLVGPVGSGKSSFFNSVKSIFHGHVTGQAVVGSDITSITERYRIYSVKDGKNGKSLPFMLCDTMGLDGAEGAGLCMDDIPHILKGCMPDRYQFNSRKPITPEHSTFITSPSLKDRIHCVAYVLDINSIDNLYSKMLAKVKQVHKEVLNCGIAYVALLTKVDDCSEVLQDNFLNMSRSMTSQSRIWNWTP

SEQ ID NO: 840174 - protein, 194 aa, Homo sapiens
MLCDTMGLDGAEGAGLCMDDIPHILKGCMPDRYQFNSRKPITPEHSTFITSPSLKDRIHCVAYVLDINSIDNLYSKMLAKVKQVHKEVLNCGIAYVALLTKVDDCSEVLQDNFLNMSRSMTSQSRVMNVHKMLGIPISNILMVGNYASDLELDPMKDILILSALRQMLRAADDFLEDLPLEETGAIERALQPCI

SEQ ID NO: 840175 - protein, 436 aa, Homo sapiens
MEVTTRLTWNDENHLRKLLGNVSLSLLYKSSVHGGSIEDMVERCSRQGCTITMAYIDYNMIVAFMLGNYINLRESSTEPNDSLWFSLQKKNDTTEIETLLLNTAPKIIDEQLVCRLSKTDIFIICRDNKIYLDKMITRNLKLRFYGHRQYLECEVFRVEGIKDNLDDIKRIIKAREHRNRLLADIRDYRPYADLVSEIRILLVGPVGSGKSSFFNSVKSIFHGHVTGQAVVGSDITSITERYRIYSVKDGKNGKSLPFMLCDTMGLDGAEGAGLCMDDIPHILKGCMPDRYQFNSRKPITPEHSTFITSPSLKDRIHCVAYVLDINSIDNLYSKMLAKVKQVHKEVLNCGIAYVALLTKVDDCSEVLQDNFLNMSRSMTSQSRVMNVHKMLGIPISNILMVGNYASGFCFCSFCLLSLEQSYLKFKGQNLRSGGLR

SEQ ID NO: 840176 - protein, 90 aa, Homo sapiens
WQDTSAGWAKGQNQGNLSQSRVMNVHKMLGIPISNILMVGNYASDLELDPMKDILILSALRQMLRAADDFLEDLPLEETGAIERALQPCI

SEQ ID NO: 840177 - protein, 429 aa, Homo sapiens
MEVTTRLTWNDENHLRKLLGNVSLSLLYKSSVHGGSIEDMVERCSRQGCTITMAYIDYNMIVAFMLGNYINLRESSTEPNDSLWFSLQKKNDTTEIETLLLNTAPKIIDEQLVCRLSKTDIFIICRDNKIYLDKMITRNLKLRFYGHRQYLECEVFRVEGIKDNLDDIKRIIKAREHRNRLLADIRDYRPYADLVSEIRILLVGPVGSGKSSFFNSVKSIFHGHVTGQAVVGSDITSITERYRIYSVKDGKNGKSLPFMLCDTMGLDGAEGAGLCMDDIPHILKGCMPDRYQDRIHCVAYVLDINSIDNLYSKMLAKVKQVHKEVLNCGIAYVALLTKVDDCSEVLQDNFLNMSRSMTSQSRVMNVHKMLGIPISNILMVGNYASDLELDPMKDILILSALRQMLRAADDFLEDLPLEETGAIERALLA

SEQ ID NO: 840178 - protein, 255 aa, Homo sapiens
MEVTTRLTWNDENHLRKLLGNVSLSLLYKSSVHGGSIEDMVERCSRQGCTITMAYIDYNMIVAFMLGNYINLRESSTEPNDSLWFSLQKKNDTTEIETLLLNTAPKIIDEQLVCRLSKTDIFIICRDNKIYLDKMITRNLKLRFYGHRQYLECEVFRVEGIKDNLDDIKRIIKAREHRNRLLADIRDYRPYADLVSEIRILLVGPVGSGKSSFFNSVKSIFHGHVTGQAVVGSDITSITERGNPNIQLNAKSNGK

SEQ ID NO: 840179 - protein, 452 aa, Homo sapiens [sequence omitted]

SEQ ID NO: 840180 - protein, 452 aa, Homo sapiens [sequence omitted]

SEQ ID NO: 840181 - protein, 450 aa, Homo sapiens
MEVTTRLTWNDENHLRKLLGNVSLSLLYKSSVHGGSIEDMVERCSRQGCTITMAYIDYNMIVAFMLGNYINLRESSTEPNDSLWFSLQKKNDTTEIETLLLNTAPKIIDEQLVCRLSKTDIFIICRDNKIYLDKMITRNLKLRFYGHRQYLECEVFRVEGIKDNLDDIKRIIKAREHRNRLLADIRDYRPYADLVSEIRILLVGPVGSGKSSFFNSVKSIFHGHVTGQAVVGSDITSITERYRIYSVKDGKNGKSLPFMLCDTMGLDGAEGAGLCMDDIPHILKGCMPDRYQFNSRKPITPEHSTFITSPSLKDRIHCVAYVLDINSIDNLYSKMLAKVKQVHKEVLNCGIAYVALLTKVDDCSEVLQDNFLNMSRSMTSQSRVMNVHKMLGIPISNILMVGNYASDLELDPMKDILILSALRQMLRAADDFLEDLPLEETGAIERALLA

SEQ ID NO: 840182 - protein, 255 aa, Homo sapiens
MEVTTRLTWNDENHLRKLLGNVSLSLLYKSSVHGGSIEDMVERCSRQGCTITMAYIDYNMIVAFMLGNYINLRESSTEPNDSLWFSLQKKNDTTEIETLLLNTAPKIIDEQLVCRLSKTDIFIICRDNKIYLDKMITRNLKLRFYGHRQYLECEVFRVEGIKDNLDDIKRIIKAREHRNRLLADIRDYRPYADLVSEIRILLVGPVGSGKSSFFNSVKSIFHGHVTGQAVVGSDITSITERITISHRLFSPFWFE

SEQ ID NO: 840183 - protein, 478 aa, Homo sapiens
MLDMGDRKEVKMIPKSSFSINSLVPEGLQNDNHHASHGHHNSHHPQHHHHHHHHHHHPPPPAPQPPPPPQQQQPPPPPPPPLAPQTRGAAPPTDDKGPQLLLLPAAPATTGRRPELKRRRRPAGGAGARRAGREGEGRRRRGGGEEGAGEGGKDGEGGKEGEKKNGKYEKPPFSYNALIMMAIRQSPEKRLTLNGIYEFIMKNFPYYRENKQGWQNSIRHNLSLNKCFVKVPRHYDDPGKGNYWMLDPSSDDVFIGGTTGKLRRRSTTSRAKLAFKRGARLTSTGLTFMDRAGSLYWPMSPFLSLHHPRASSTLSYNGTTSAYPSHPMPYSSVLTQNSLGNNHSFSTANGLSVDRLVNGEIPYATHHLTAAALAASVPCGLSVPCSGTYSLNPCSVNLLAGQTSYFFPHVPHPSMTSQSSTSMSARAASSSTSPQAPSTLPCESLRPSLPSFTTGLSGGLSDYFTHQNQGSSSNPLIH

SEQ ID NO: 840184 - protein, 478 aa, Homo sapiens
MLDMGDRKEVKMIPKSSFSINSLVPEGLQNDNHHASHGHHNSHHPQHHHHHHHHHHHPPPPAPQPPPPPQQQQPPPPPRRGAPRRRPTKRAPSCFCSPPHRHHRPPPGAKAEGWRQGRAGGRPGELAPVGPDEKEKGAGAGGEEKKGAGEGGKDGEGGKEGEKKNGKYEKPPFSYNALIMMAIRQSPEKRLTLNGIYEFIMKNFPYYRENKQGWQNSIRHNLSLNKCFVKVPRHYDDPGKGNYWMLDPSSDDVFIGGTTGKLRRRSTTSRAKLAFKRGARLTSTGLTFMDRAGSLYWPMSPFLSLHHPRASSTLSYNGTTSAYPSHPMPYSSVLTQNSLGNNHSFSTANGLSVDRLVNGEIPYATHHLTAAALAASVPCGLSVPCSGTYSLNPCSVNLLAGQTSYFFPHVPHPSMTSQSSTSMSARAASSSTSPQAPSTLPCESLRPSLPSFTTGLSGGLSDYFTHQNQGSSSNPLIH

SEQ ID NO: 840185 - protein, 478 aa, Homo sapiens; identical to SEQ ID NO: 840184

SEQ ID NO: 840186 - protein, 320 aa, Homo sapiens
YTRRHHDWPIRAAARRVMPAPRLKRTFLRRSLSERHVRRYRTQRHPKTTEAGATNTSPVADHNLSLNKCFVKVPRHYDDPGKGNYWMLDPSSDDVFIGGTTGKLRRRSTTSRAKLAFKRGARLTSTGLTFMDRAGSLYWPMSPFLSLHHPRASSTLSYNGTTSAYPSHPMPYSSVLTQNSLGNNHSFSTANGLSVDRLVNGEIPYATHHLTAAALAASVPCGLSVPCSGTYSLNPCSVNLLAGQTSYFFPHVPHPSMTSQSSTSMSARAASSSTSPQAPSTLPCESLRPSLPSFTTGLSGGLSDYFTHQNQGSSSNPLIH

SEQ ID NO: 840187 - protein, 109 aa, Homo sapiens
MIIKKKKKKKKKKLKDVLNENLQRKREGLHSLAFKSYKPEIQNKLLIIKKKAKHKKHKSGTVREKTTIAVTSRGYYGLEDEKGTACTSNKASVKREVWQYIKQGSSRTP

SEQ ID NO: 840188 - protein, 850 aa, Homo sapiens
RPPPAAEGEDDEEEVAAAAQTSGPAHGRSASSLEDADDQEEEMEAMVIGGGCCKEQELTYELQQGYRILGEFLQEKHRGLTAPFLQPLGGVATAEEEVAEGPRSGGRGGRAFPQQPGQGMCLLQMEEKFASGQYGGITEFVADFRLMLETCYRLHGVDHWISKQGQKLEMMLEQKLALLSRHLREKTTIAVTSRGYYGLEDEKGTACTSTRRRSTPRSLAGLTSGVFESIMVQVLRQEEQLRAKEEKRLREQERKEAEEASQKEIEEWERKLLAQAAPTCMETMWEIPAIGHFLCLAQQILNLPEIVFYELERCLLMPQCNAFLSKIMTSLLSPPHRRPTLHRRPTLPYRTWEAALRQKVQQWYTAVGQTENPDNCAEKLGLCPQFFKVLGEVNPLEEKPFHELPFYQKVWLLKGLCDFVYETQKEVQDAVLGQPIHECREVILGYDYLENAYVHFPQFCGADVRIYKQRPFQAPEFPIPPIKIQRVPRIKLEKLKCDYVSTSNGEHRCSRDSLPSSFKKEQENNFDPACCPAKMILDNHDISVEMGVKSNYEIRIRRPCEIKKTDCCKENLEKPRSPGEVTGFGEPLSPGEIRFIENQEKYGEASRIKIEPSPLKENTLKSCQIHVNGSHSDHPEINCHKVVRDILLEQSLQSHKKLKLTKMRAKKKKKKKKKLKDVLNENLQRKREGLHSLAFKSYKPEIQNKLLIIKKKAKHKKHKSGKKSVSKKAITKKRKTVIKSPTVPEFQLICTNLDELRELITKIENELKDLENSRKKSGKWYHRRQAVKELHSTLIRLLNELLPWEPKLMKAFQRNRSRLKKDYDDFRRQPDHDTFNRELWTTDEGEGDLG

SEQ ID NO: 840189 - protein, 98 aa, Homo sapiens
PSPLKENTLKSCQIHVNGSHSDHPEINCHKVVRDILLEQSLQSHKKLKLTKMRAKKKKKKKKKLKDVLNENLQRKREGLHSLAFKSYKPEIQNKLLII

SEQ ID NO: 840190 - protein, 220 aa, Homo sapiens
MRKSKWWQRDGSLQRPLQSGIPTLVVGSLRRSPTMVLRPQQFQFYQPQGIPSSPSAVVVEMGSKPALTGEPALTCISRGSEARIHSAASSLIMEDKEIPIKSEPLPKPPASAPPSILVKPENSRNGIEKQVKTVRFQNYSPPPTKHYTSHPTSGKPEQPATLKASQPEAASLGPEMTVLFAHRSGCHSGQQTDLRRKSALAKATTLVSTASGTQTVFPSK

SEQ ID NO: 840191 - protein, 735 aa, Homo sapiens [sequence omitted]

SEQ ID NO: 840192 - protein, 488 aa, Homo sapiens
MDDLTLLDLLECPVCFEKLDVTAKVLPCQHTFCKPCLQRVFKAHKELRCPECRTPVFSNIEALPANLLLVRLLDGVRSGQSSGRGGSFRRPGTMTLQDGRKSRTNPRRLQASPFRLVPNVRIHMDGVPRAKALCNYRGQNPGDLRFNKGDIILLRRQLDENWYQGEINGISGNFPASSVEVIKQLPQPPPLCRALYNFDLRGKDKSENQDCLTFLKDDIITVISRVDENWAEGKLGDKVGIFPILFVEPNLTARHLLEKNKGRQSSCTKNLSLVSSSSRGNTSTLRRGPGSRRKVPGQFSITTALNTLNRMVHSPSGRHMVEISTPVLISSSNPSVITQPMEKADVPSSCVGQVSTYHPAPVSPGHSTAVVSLPGSQQHLSANMFVALHSYSAHGPDELDLQKGEGVRVLGKCQDGWLRGVSLVTGRVGIFPNNYVIPIFRKTSSFPDSRSPGLYTTWTLSTSSVSAISFSLCKVIILAAKGGFLRGV

SEQ ID NO: 840193 - protein, 565 aa, Homo sapiens [sequence omitted]

SEQ ID NO: 840194 - protein, 307 aa, Homo sapiens
MDDLTLLDLLECPVCFEKLDVTAKVLPCQHTFCKPCLQRVFKAHKELRCPECRTPVFSNIEALPANLLLVRLLDGVRSGQSSGRGGSFRRPGTMTLQDGRKSRTNPRRLQASPFRLVPNVRIHMDGVPRAKALCNYRGQNPGDLRFNKGDIILLRRQLDENWYQGEINGISGNFPASSVEVIKQLPQPPPLCRALYNFDLRGKDKSENQDCLTFLKDDIITVISRVDENWAEGKLGDKVGIFPILFVEPNLTARHLLEKNKGRQSSCTKNLSLVSSSSRGNTSTLYNFDLRRKNKSEQDCSDLSSRS

SEQ ID NO: 840195 - protein, 220 aa, Homo sapiens; identical to SEQ ID NO: 840190

SEQ ID NO: 840196 - protein, 255 aa, Homo sapiens
ENVSAVRLGKRLSILGYQEALLTQPHPTYCQPPLLLISLSYNSPDGSLQRPLQSGIPTLVVGSLRRSPTMVLRPQQFQFYQPQGIPSSPSAVVVEMGSKPALTGEPALTCISRGSEARIHSAASSLIMEDKEIPIKSEPLPKPPASAPPSILVKPENSRNGIEKQVKTVRFQNYSPPPTKHYTSHPTSGKPEQPATLKASQPEAASLGPEMTVLFAHRSGCHSGQQTDLRRKSALAKATTLVSTASGTQTVFPSK

SEQ ID NO: 840197 - protein, 400 aa, Homo sapiens
MDDLTLLDLLECPVCFEKLDVTAKVLPCQHTFCKPCLQRVFKAHKELRCPECRTPVFSNIEALPANLLLVRLLDGVRSGQSSGRGGSFRRPGTMTLQDGRKSRTNPRRLQASPFRLVPNVRIHMDGVPRAKALCNYRGQNPGDLRFNKGDIILLRRQLDENWYQGEINGISGNFPASSVEVIKQLPQPPPLCRALYNFDLRGKDKSENQDCLTFLKDDIITVISRVDENWAEGKLGDKVGIFPILFVEPNLTARHLLEKNKGRQSSCTKNLSLVSSSSRGNTSTLRRGPGSRRKVPGQFSITTALNTLNRMVHSPSGRHMVEISTPVLISSSNPSVITQPMEKADVPSSCVGQVSTYHPAPVSPGHSTAVVSLPGSQQHLSANMICSPALLLRATHHLLT

SEQ ID NO: 840198 - protein, 955 aa, Homo sapiens
ARAGGCSIAEEKSSLLAENQVLMERLNQSDSIEDPNSPAGRRHLQLQTQLEQLQEETFRLEAAKDDYRIRCEELEKEISELRQQNDELTTLADEAQSLKDEIDVLRHSSDKVSKLEGQVSLEFSGRCILGRRAPRLGAARTMGLPALEFSDCCLDSPHFRETLKSHEAELDKTNKFIKELIKDGKSLISALKNLSSAKRKFADSLNEFKFQCIGDAETDDEMCIARSLQEFATVLRNLEDERIRMIENASEVLITPLEKFRKEQIGAAKEAKKKYDKETEKYCGILEKHLNLSSKKKESQLQEADSQVDLVRQHFYEVSLEYVFKVQEVQERKMFEFVEPLLAFLQGLFTFYHHGYELAKDFGDFKTQLTISIQNTRNRFEGTRSEVESLMKKMKENPLEHKTISPYTMEGYLYVQEKRHFGTSWVKHYCTYQRDSKQITMVPFDQKSGGKGGEDESVILKSCTRRKTDSIEKRFCFDVEAVDRPGVITMQALSEEDRRLWMEAMDGREPVYNSNKDSQSEGTAQLDSIGFSIIRKCIHAVETRGINEQGLYRIVGVNSRVQKLLSVLMDPKTASETETDICAEWEIKTITSALKTYLRMLPGPLMMYQFQRSFIKAAKLENQESRVSEIHSLVHRLPEKNRQMLQLLMNHLANVANNHKQNLMTVANLGVVFGPTLLRPQEETVAAIMDIKFQNIVIEILIENHEKIFNTVPDMPLTNAQLHLSRKKSSDSKPPSCSERPLTLFHTVQSTEKQEQRNSIINSSLESVSSNPNSILNSSSSLQPNMNSSDPDLAVVKPTRPNSLPPNPSPTSPLSPSWPMFSAPSSPMPTSSTSSDSSPVRSVAGFVWFSVAAVVLSLARSSLHAVFSLLVNFVPCHPNLHLLFDRPEEAVHEDSSTPFRKAKALYACKAEHDSELSFTAGTVFDNVHPSQEPGWLEGTLNGKTGLIPENYVEFL

SEQ ID NO: 840199 - protein, 312 aa, Homo sapiens
MRLGSEAWVVEKLLSVLMDPKTASETETDICAEWEIKTITSALKTYLRMLPGPLMMYQFQRSFIKAAKLENQESRVSEIHSLVHRLPEKNRQMLQLLMNHLANVANNHKQNLMTVANLGVVFGPTLLRPQEETVAAIMDIKFQNIVIEILIENHEKIFNTVPDMPLTNAQLHLSRKKSSDSKPPSCSERPLTLFHTVQSTEKQEQRNSIINSSLESVSSNPNSILNSSSSLQPNMNSSDPDLAVVKPTRPNSLTPFRKAKALYACKAEHDSELSFTAGTVFDNVHPSQEPGWLEGTLNGKTGLIPENYVEFL

SEQ ID NO: 840200 - protein, 318 aa, Homo sapiens
MHACRLCPVLRFTTSLLKLLCVLMDPKTASETETDICAEWEIKTITSALKTYLRMLPGPLMMYQFQRSFIKAAKLENQESRVSEIHSLVHRLPEKNRQMLQLLMNHLANVANNHKQNLMTVANLGVVFGPTLLRPQEETVAAIMDIKFQNIVIEILIENHEKIFNTVPDMPLTNAQLHLSRKKSSDSKPPSCSERPLTLFHTVQSTEKQEQRNSIINSSLESVSSNPNSILNSSSSLQPNMNSSDPDLAVVKPTRPNSLTPFRKAKALYACKAEHDSELSFTAGTVFDNVHPSQEPGWLEGTLNGKTGLIPENYVEFL

SEQ ID NO: 840201 - protein, 922 aa, Homo sapiens
ARAGGCSIAEEKSSLLAENQVLMERLNQSDSIEDPNSPAGRRHLQLQTQLEQLQEETFRLEAAKDDYRIRCEELEKEISELRQQNDELTTLADEAQSLKDEIDVLRHSSDKVSKLEGQVSLEFSGRCILGRRAPRLGAARTMGLPALEFSDCCLDSPHFRETLKSHEAELDKTNKFIKELIKDGKSLISALKNLSSAKRKFADSLNEFKFQCIGDAETDDEMCIARSLQEFATVLRNLEDERIRMIENASEVLITPLEKFRKEQIGAAKEAKKKYDKETEKYCGILEKHLNLSSKKKESQLQEADSQVDLVRQHFYEVSLEYVFKVQEVQERKMFEFVEPLLAFLQGLFTFYHHGYELAKDFGDFKTQLTISIQNTRNRFEGTRSEVESLMKKMKENPLEHKTISPYTMEGYLYVQEKRHFGTSWVKHYCTYQRDSKQITMVPFDQKSGGKGGEDESVILKSCTRRKTDSIEKRFCFDVEAVDRPGVITMQALSEEDRRLWMEAMDGREPVYNSNKDSQSEGTAQLDSIGFSIIRKCIHAVETRGINEQGLYRIVGVNSRVQKLLSVLMDPKTASETETDICAEWEIKTITSALKTYLRMLPGPLMMYQFQRSFIKAAKLENQESRVSEIHSLVHRLPEKNRQMLQLLMNHLANVANNHKQNLMTVANLGVVFGPTLLRPQEETVAAIMDIKFQNIVIEILIENHEKIFNTVPDMPLTNAQLHLSRKKSSDSKPPSCSERPLTLFHTVQSTEKQEQRNSIINSSLESVSSNPNSILNSSSSLQPNMNSSDPDLAVVKPTRPNSLPPNPSPTSPLSPSWPMFSAPSSPMPTSSTSSDSSPVSTPFRKAKALYACKAEHDSELSFTAGTVFDNESVLQLPQPSSLPHRSSGHLHLSPGHFHWPPDTSSHICSCCHNPLFTEQRE

SEQ ID NO: 840202 - protein, 312 aa, Homo sapiens; identical to SEQ ID NO: 840199

SEQ ID NO: 840203 - protein, 158 aa, Homo sapiens
MFSAPSSPMPTSSTSSDSSPVRSVAGFVWFSVAAVVLSLARSSLHAVFSLLVNFVPCHPNLHLLFDRPEEAVHEDSSTPFRKAKALYACKAEHDSELSFTAGTVFDNESVLQLPQPSSLPHRSSGHLHLSPGHFHWPPDTSSHICSCCHNPLFTEQRE

SEQ ID NO: 840204 - protein, 805 aa, Homo sapiens
ARAGGCSIAEEKSSLLAENQVLMERLNQSDSIEDPNSPAGRRHLQLQTQLEQLQEETFRLEAAKDDYRIRCEELEKEISELRQQNDELTTLADEAQSLKDEIDVLRHSSDKVSKLEGQVSLEFSGRCILGRRAPRLGAARTMGLPALEFSDCCLDSPHFRETLKSHEAELDKTNKFIKELIKDGKSLISALKNLSSAKRKFADSLNEFKFQCIGDAETDDEMCIARSLQEFATVLRNLEDERIRMIENASEVLITPLEKFRKEQIGAAKEAKKKYDKETEKYCGILEKHLNLSSKKKESQLQEADSQVDLVRQHFYEVSLEYVFKVQEVQERKMFEFVEPLLAFLQGLFTFYHHGYELAKDFGDFKTQLTISIQNTRNRFEGTRSEVESLMKKMKENPLEHKTISPYTMEGYLYVQEKRHFGTSWVKHYCTYQRDSKQITMVPFDQKSGGKGGEDESVILKSCTRRKTDSIEKRFCFDVEAVDRPGVITMQALSEEDRRLWMEAMDGREPVYNSNKDSQSEGTAQLDSIGFSIIRKCIHAVETRGINEQGLYRIVGVNSRVQKLLSVLMDPKTASETETDICAEWEIKTITSALKTYLRMLPGPLMMYQFQRSFIKAAKLENQESRVSEIHSLVHRLPEKNRQMLQLLMNHLANVANNHKQNLMTVANLGVVFGPTLLRPQEETVAAIMDIKFQNIVIEILIENHEKIFNTVPDMPLTNAQLHLSRKKSSDSKPPSCSERPLTLFHTVQSTEKQEQRNSIINSSLESVSSNPNSILNSSSSLQPNMNSSDPDLAVVKPTRPNSLL

SEQ ID NO: 840205 - protein, 165 aa, Homo sapiens
MHACRLCPVLRFTTSLLKLLCVLMDPKTASETETDICAEWEIKTITSALKTYLRMLPGPLMMYQFQRSFIKAAKLENQESRVSEIHSLVHRLPEKNRQMLQLLMNHLAKENRYNQKRTSASYHHNIHTCAYVSAISPVRQGNPVLLPKGIPFPGTLEPIDSPLDL

SEQ ID NO: 840206 - protein, 272 aa, Homo sapiens
MRLGSEAWVVEKLLSVLMDPKTASETETDICAEWEIKTITSALKTYLRMLPGPLMMYQFQRSFIKAAKLENQESRVSEIHSLVHRLPEKNRQMLQLLMNHLANVANNHKQNLMTVANLGVVFGPTLLRPQEETVAAIMDIKFQNIVIEILIENHEKIFNTVPDMPLTNAQLHLSRKKSSDSKPPSCSERPLTLFHTVQSTEKQEQRNSIINSSLESVSSNPNSILNSSSSLQPNMNSSDPDLAVVKPTRPNSLTTTPNPMPNTPRKSGTSSM

SEQ ID NO: 840207 - protein, 257 aa, Homo sapiens
MYQFQRSFIKAAKLENQESRVSEIHSLVHRLPEKNRQMLQLLMNHLANVANNHKQNLMTVANLGVVFGPTLLRPQEETVAAIMDIKFQNIVIEILIENHEKIFNTVPDMPLTNAQLHLSRKKSSDSKPPSCSERPLTLFHTVQSTEKQEQRNSIINSSLESVSSNPNSILNSSSSLQPNMNSSDPDLAVVKPTRPNSLTPFRKAKALYACKAEHDSELSFTAGTVFDNVHPSQEPGWLEGTLNGKTGLIPENYVEFL

SEQ ID NO: 840208 - protein, 977 aa, Homo sapiens
ARAGGCSIAEEKSSLLAENQVLMERLNQSDSIEDPNSPAGRRHLQLQTQLEQLQEETFRLEAAKDDYRIRCEELEKEISELRQQNDELTTLADEAQSLKDEIDVLRHSSDKVSKLEGQVSLEFSGRCILGRRAPRLGAARTMGLPALEFSDCCLDSPHFRETLKSHEAELDKTNKFIKELIKDGKSLISALKNLSSAKRKFADSLNEFKFQCIGDAETDDEMCIARSLQEFATVLRNLEDERIRMIENASEVLITPLEKFRKEQIGAAKEAKKKYDKETEKYCGILEKHLNLSSKKKESQLQEADSQVDLVRQHFYEVSLEYVFKVQEVQERKMFEFVEPLLAFLQGLFTFYHHGYELAKDFGDFKTQLTISIQNTRNRFEGTRSEVESLMKKMKENPLEHKTISPYTMEGYLYVQEKRHFGTSWVKHYCTYQRDSKQITMVPFDQKSGGKGGEDESVILKSCTRRKTDSIEKRFCFDVEAVDRPGVITMQALSEEDRRLWMEAMDGREPVYNSNKDSQSEGTAQLDSIGFSIIRKCIHAVETRGINEQGLYRIVGVNSRVQKLLSVLMDPKTASETETDICAEWEIKTITSALKTYLRMLPGPLMMYQFQRSFIKAAKLENQESRVSEIHSLVHRLPEKNRQMLQLLMNHLANVANNHKQNLMTVANLGVVFGPTLLRPQEETVAAIMDIKFQNIVIEILIENHEKIFNTVPDMPLTNAQLHLSRKKSSDSKPPSCSERPLTLFHTVQSTEKQEQRNSIINSSLESVSSNPNSILNSSSSLQPNMNSSDPDLAVVKPTRPNSLPPNPSPTSPLSPSWPMFSAPSSPMPTSSTSSDSSPVRSVAGFVWFSVAAVVLSLARSSLHAVFSLLVNFVPCHPNLHLLFDRPEEAVHEDSSTPFRKAKALYACKAEHDSELSFTAGTVFDNESVLQLPQPSSLPHRSSGHLHLSPGHFHWPPDTSSHICSCCHNPLFTEQRE

SEQ ID NO: 840209 - protein, 896 aa, Homo sapiens
ARAGGCSIAEEKSSLLAENQVLMERLNQSDSIEDPNSPAGRRHLQLQTQLEQLQEETFRLEAAKDDYRIRCEELEKEISELRQQNDELTTLADEAQSLKDEIDVLRHSSDKVSKLEGQVSLEFSGRCILGRRAPRLGAARTMGLPALEFSDCCLDSPHFRETLKSHEAELDKTNKFIKELIKDGKSLISALKNLSSAKRKFADSLNEFKFQCIGDAETDDEMCIARSLQEFATVLRNLEDERIRMIENASEVLITPLEKFRKEQIGAAKEAKKKYDKETEKYCGILEKHLNLSSKKKESQLQEADSQVDLVRQHFYEVSLEYVFKVQEVQERKMFEFVEPLLAFLQGLFTFYHHGYELAKDFGDFKTQLTISIQNTRNRFEGTRSEVESLMKKMKENPLEHKTISPYTMEGYLYVQEKRHFGTSWVKHYCTYQRDSKQITMVPFDQKSGGKGGEDESVILKSCTRRKTDSIEKRFCFDVEAVDRPGVITMQALSEEDRRLWMEAMDGREPVYNSNKDSQSEGTAQLDSIGFSIIRKCIHAVETRGINEQGLYRIVGVNSRVQKLLSVLMDPKTASETETDICAEWEIKTITSALKTYLRMLPGPLMMYQFQRSFIKAAKLENQESRVSEIHSLVHRLPEKNRQMLQLLMNHLANVANNHKQNLMTVANLGVVFGPTLLRPQEETVAAIMDIKFQNIVIEILIENHEKIFNTVPDMPLTNAQLHLSRKKSSDSKPPSCSERPLTLFHTVQSTEKQEQRNSIINSSLESVSSNPNSILNSSSSLQPNMNSSDPDLAVVKPTRPNSLPPNPSPTSPLSPSWPMFSAPSSPMPTSSTSSDSSPVRSVAGFVWFSVAAVVLSLARSSLHAVFSLLVNFVPCHPNLHLLFDRPEEAVHEDSR

SEQ ID NO: 840210 - protein, 828 aa, Homo sapiens
ARAGGCSIAEEKSSLLAENQVLMERLNQSDSIEDPNSPAGRRHLQLQTQLEQLQEETFRLEAAKDDYRIRCEELEKEISELRQQNDELTTLADEAQSLKDEIDVLRHSSDKVSKLEGQVSLEFSGRCILGRRAPRLGAARTMGLPALEFSDCCLDSPHFRETLKSHEAELDKTNKFIKELIKDGKSLISALKNLSSAKRKFADSLNEFKFQCIGDAETDDEMCIARSLQEFATVLRNLEDERIRMIENASEVLITPLEKFRKEQIGAAKEAKKKYDKETEKYCGILEKHLNLSSKKKESQLQEADSQVDLVRQHFYEVSLEYVFKVQEVQERKMFEFVEPLLAFLQGLFTFYHHGYELAKDFGDFKTQLTISIQNTRNRFEGTRSEVESLMKKMKENPLEHKTISPYTMEGYLYVQEKRHFGTSWVKHYCTYQRDSKQITMVPFDQKSGGKGGEDESVILKSCTRRKTDSIEKRFCFDVEAVDRPGVITMQALSEEDRRLWMEAMDGREPVYNSNKDSQSEGTAQLDSIGFSIIRKCIHAVETRGINEQGLYRIVGVNSRVQKLLSVLMDPKTASETETDICAEWEIKTITSALKTYLRMLPGPLMMYQFQRSFIKAAKLENQESRVSEIHSLVHRLPEKNRQMLQLLMNHLANVANNHKQNLMTVANLGVVFGPTLLRPQEETVAAIMDIKFQNIVIEILIENHEKIFNTVPDMPLTNAQLHLSRKKSSDSKPPSCSERPLTLFHTVQSTEKQEQRNSIINSSLESVSSNPNSILNSSSSLQPNMNSSDPDLAVVKPTRPNSLVANNHKQNLMTVANLGVVFGPTLL

SEQ ID NO: 840211 - protein, 159 aa, Homo sapiens
MHACRLCPVLRFTTSLLKLLCVLMDPKTASETETDICAEWEIKTITSALKTYLRMLPGPLMMYQFQRSFIKAAKLENQESRVSEIHSLVHRLPEKNRQMLQLLMNHLAKYAGGLGKKCVKCSLQWRTAANAKMAFPEDAGEVLMQPGHQAEFSGGFYLW

SEQ ID NO: 840212 - protein, 171 aa, Homo sapiens
ARCRRRGVAGLWFRVGPRRSQLSARSRSAPPPRSGPGRRRLQGRSRGHMAEGDAGSDQRQVRPRRGAVSPGSAPARLAMPVLLSRGALRLGPPRVPPALATPFAPPRSIFPALPVGRALLGRRLLGGRGLGLSRTVSSSTINTRLSSSGPKAKTGVSIPTLPPPSHLGQIT

SEQ ID NO: 840213 - protein, 365 aa, Homo sapiens
ARCRRRGVAGLWFRVGPRRSQLSARSRSAPPPRSGPGRRRLQGRSRGHMAEGDAGSDQRQNEEIEAMAAIYGEEWCVIDDCAKIFCIRISDDIDDPKWTLCLQVMLPNEYPGTAPPIYQLNAPWLKGQERADLSNSLEEIYIQNIGESILYLWVEKIRDVLIQKSQMTEPGPDVKKKTEEEDVECEDDLILACQPESSVKALDFDISETRTEVEVEELPPIDHGIPITDRRSTFQAHLAPVVCPKQVKMVLSKLYENKKIASATHNIYAYRIYCEDKQTFLQDCEDDGETAAGGRLLHLMEILNVKNVMVVVSRWYGGILLGPDRFKHINNCARNILVEKNYTNSPEESSKALGKNKKAYLGELI

SEQ ID NO: 840214 - protein, 305 aa, Homo sapiens
ARCRRRGVAGLWFRVGPRRSQLSARSRSAPPPRSGPGRRRLQGRSRGHMAEGDAGSDQRQNEEIEAMAAIYGEEWCVIDDCAKIFCIRISDDIDDPKWTLCLQVMLPNEYPGTAPPIYQLNAPWLKGQERADLSNSLEEIYIQNIGESILYLWVEKIRDVLIQKSQMTEPGPDVKKKTEEEDVECEDDLILACQPESSVKALDFDISETRTEVEVEELPPIDHGIPITDRRSTFQAHLAPVVCPKQVKMVLSKLYENKKIASATHNIYAYRIYCEDKQTFLQDCEDDGETAAGGRLLHLMEVGVS

SEQ ID NO: 840215 - protein, 368 aa, Homo sapiens
ARCRRRGVAGLWFRVGPRRSQLSARSRSAPPPRSGPGRRRLQGRSRGHMAEGDAGSDQRQNEEIEAMAAIYGEEWCVIDDCAKIFCIRISDDIDDPKWTLCLQVMLPNEYPGTAPPIYQLNAPWLKGQERADLSNSLEEIYIQNIGESILYLWVEKIRDVLIQKSQMTEPGPDVKKKTEEEDVECEDDLILACQPESSVKALDFDISETRTEVEVEELPPIDHGIPITDRRSTFQAHLAPVVCPKQVKMVLSKLYENKKIASATHNIYAYRIYCEDKQTFLQDCEDDGETAAGGRLLHLMEILNVKNVMVVVSRWYGGILLGPDRFKHINNCARNILVEKNYTNSPEESSKALGKNKKVRKDKKRNEH

SEQ ID NO: 840216 - protein, 368 aa, Homo sapiens; identical to SEQ ID NO: 840215

SEQ ID NO: 840217 - protein, 368 aa, Homo sapiens; identical to SEQ ID NO: 840215

SEQ ID NO: 840218 - protein, 368 aa, Homo sapiens; identical to SEQ ID NO: 840215

SEQ ID NO: 840219 - protein, 102 aa, Homo sapiens
MGREPRFWLLVFLLFLLSDAGAFPWTVYFPWTLWAWFFHECVTLWSFTRPCWWSRWGPQGSDLTCPFSYLLHSLLSHQHSFLSQKCSFQNADLPMSPNDVTY

SEQ ID NO: 840220 - protein, 104 aa, Homo sapiens [sequence omitted]

SEQ ID NO: 840221 - protein, 375 aa, Homo sapiens
SSLPCPRSSRMGVSFEKQDCFYKSVYEPARLTARLTSRLTARLTSPLPRLTSRLPRLTSRLPRLLATASVPVASRGSPSEHARGAGDQTTGVGVRVAVGVPGPEHEPERESAARTPVATRVPGAARSHQRSAAMEPSSKKLTGRLMLAVGGAVLGSLQFGYNTGVINAPQKVIEEFYNQTWVHRYGESILPTTLTTLWSLSVAIFSVGGMIGSFSVGLFVNRFGRRNSMLMMNLLAFVSAVLMGFSKLGKSFEMLILGRFIIGVYCGLTTGFVPMYVGEVSPTSPSWGPWGTLHQLGIVVGILIAQVFGLDSIMGNKDLWPLLLSIIFIQPVMIGCLCQSPVLYNREDRQSVKLRDCVPAVNGDDIGKAPGGRGH

SEQ ID NO: 840222 - protein, 582 aa, Homo sapiens
ANGRGPINATVRALSGKRQEVATASVPVASRGSPSEHARGAGDQTTGVGVRVAVGVPGPEHEPERESAARTPVATRVPGAARSHQRSAAMEPSSKKLTGRLMLAVGGAVLGSLQFGYNTGVINAPQKVIEEFYNQTWVHRYGESILPTTLTTLWSLSVAIFSVGGMIGSFSVGLFVNRFGRRNSMLMMNLLAFVSAVLMGFSKLGKSFEMLILGRFIIGVYCGLTTGFVPMYVGEVSPTSPSWGPWGTLHQLGIVVGILIAQVFGLDSIMGNKDLWPLLLSIIFIPALLQCIVLPFCPESPRFLLINRNEENRAKSVLKKLRGTADVTHDLQEMKEESRQMMREKKVTILELFRSPAYRQPILIAVVLQLSQQLSGINAVFYYSTSIFEKAGVQQPVYATIGSGIVNTAFTVVSLFVVERAGRRTLHLIGLAGMAGCAILMTIALALLEQLPWMSYLSIVAIFGFVAFFEVGPGPIPWFIVAELFSQGPRPAAIAVAGFSNWTSNFIVGMCFQYVEQLCGPYVFIIFTVLLVLFFIFTYFKVPETKGRTFDEIASGFRQGGASQSDKTPEELFHPLGADSQV

SEQ ID NO: 840223 - protein, 582 aa, Homo sapiens; identical to SEQ ID NO: 840222

SEQ ID NO: 840224 - protein, 582 aa, Homo sapiens; identical to SEQ ID NO: 840222

SEQ ID NO: 840225 - protein, 582 aa, Homo sapiens; identical to SEQ ID NO: 840222

SEQ ID NO: 840226 - protein, 524 aa, Homo sapiens
ANGRGPINATVRALSGKRQEVATASVPVASRGSPSEHARGAGDQTTGVGVRVAVGVPGPEHEPERESAARTPVATRVPGAARSHQRSAAMEPSSKKLTGRLMLAVGGAVLGSLQFGYNTGVINAPQKVIEEFYNQTWVHRYGESILPTTLTTLWSLSVAIFSVGGMIGSFSVGLFVNRFGRRNSMLMMNLLAFVSAVLMGFSKLGKSFEMLILGRFIIGVYCGLTTGFVPMYVGEVSPTSPSWGPWGTLHQLGIVVGILIAQVFGLDSIMGNKDLWPLLLSIIFIPALLQCIVLPFCPESPRFLLINRNEENRAKSVLKKLRGTADVTHDLQEMKEESRQMMREKKVTILELFRSPAYRQPILIAVVLQLSQQLSGINAVFYYSTSIFEKAGVQQPVYATIGSGIVNTAFTVVSLFVVERAGRRTLHLIGLAGMAGCAILMTIALALLEQLPWMSYLSIVAIFGFVAFFEVGPGPIPWFIVAELFSQGPRPAAIAVAGFSNWTSNFIVGSFLQPAMMSRRIFRT

SEQ ID NO: 840227 - protein, 481 aa, Homo sapiens
MLAVGGAVLGSLQFGYNTGVINAPQKVIEEFYNQTWVHRYGESILPTTLTTLWSLSVAIFSVGGMIGSFSVGLFVNRFGRRNSMLMMNLLAFVSAVLMGFSKLGKSFEMLILGRFIIGVYCGLTTGFVPMYVGEVSPTSPSWGPWGTLHQLGIVVGILIAQVFGLDSIMGNKDLWPLLLSIIFIPALLQCIVLPFCPESPRFLLINRNEENRAKSVLKKLRGTADVTHDLQEMKEESRQMMREKKVTILELFRSPAYRQPILIAVVLQLSQQLSGINAVFYYSTSIFEKAGVQQPVYATIGSGIVNTAFTVVSLFVVERAGRRTLHLIGLAGMAGCAILMTIALALLEQLPWMSYLSIVAIFGFVAFFEVGPGPIPWFIVAELFSQGPRPAAIAVAGFSNWTSNFIVGMCFQYVEQLCGPYVFIIFTVLLVLFFIFTYFKVPETKGRTFDEIASGFRQGGASQSDKTPEELFHPLGADSQV

SEQ ID NO: 840228 - protein, 417 aa, Homo sapiens
MIGSFSVGLFVNRFGRRNSMLMMNLLAFVSAVLMGFSKLGKSFEMLILGRFIIGVYCGLTTGFVPMYVGEVSPTSPSWGPWGTLHQLGIVVGILIAQVFGLDSIMGNKDLWPLLLSIIFIPALLQCIVLPFCPESPRFLLINRNEENRAKSVLKKLRGTADVTHDLQEMKEESRQMMREKKVTILELFRSPAYRQPILIAVVLQLSQQLSGINAVFYYSTSIFEKAGVQQPVYATIGSGIVNTAFTVVSLFVVERAGRRTLHLIGLAGMAGCAILMTIALALLEQLPWMSYLSIVAIFGFVAFFEVGPGPIPWFIVAELFSQGPRPAAIAVAGFSNWTSNFIVGMCFQYVEQLCGPYVFIIFTVLLVLFFIFTYFKVPETKGRTFDEIASGFRQGGASQSDKTPEELFHPLGADSQV

SEQ ID NO: 840229 - protein, 546 aa, Homo sapiens
ANGRGPINATVRALSGKRQEVATASVPVASRGSPSEHARGAGDQTTGVGVRVAVGVPGPEHEPERESAARTPVATRVPGAARSHQRSAAMEPSSKKLTGRLMLAVGGAVLGSLQFGYNTGVINAPQKVIEEFYNQTWVHRYGESILPTTLTTLWSLSVAIFSVGGMIGSFSVGLFVNRFGRRNSMLMMNLLAFVSAVLMGFSKLGKSFEMLILGRFIIGVYCGLTTGFVPMYVGEVSPTSPSWGPWGTLHQLGIVVGILIAQVFGLDSIMGNKDLWPLLLSIIFIPALLQCIVLPFCPESPRFLLINRNEENRAKSVLKKLRGTADVTHDLQEMKEESRQMMREKKVTILELFRSPAYRQPILIAVVLQLSQQLSGINAVFYYSTSIFEKAGVQQPVYATIGSGIVNTAFTVVSLFVVERAGRRTLHLIGLAGMAGCAILMTIALALLEQLPWMSYLSIVAIFGFVAFFEVGPGPIPWFIVAELFSQGPRPAAIAVAGFSNWTSNFIVGMCFQYVEQLCGPYVFIIFTVLLVLFFILSRHLPSSPS

SEQ ID NO: 840230 - protein, 203 aa, Homo sapiens
ATLDGPLSWTKAGVQQPVYATIGSGIVNTAFTVVSLFVVERAGRRTLHLIGLAGMAGCAILMTIALALLEQLPWMSYLSIVAIFGFVAFFEVGPGPIPWFIVAELFSQGPRPAAIAVAGFSNWTSNFIVGMCFQYVEQLCGPYVFIIFTVLLVLFFIFTYFKVPETKGRTFDEIASGFRQGGASQSDKTPEELFHPLGADSQV

SEQ ID NO: 840231 - protein, 582 aa, Homo sapiens; identical to SEQ ID NO: 840222

SEQ ID NO: 840232 - protein, 287 aa, Homo sapiens
ANGRGPINATVRALSGKRQEVATASVPVASRGSPSEHARGAGDQTTGVGVRVAVGVPGPEHEPERESAARTPVATRVPGAARSHQRSAAMEPSSKKLTGRLMLAVGGAVLGSLQFGYNTGVINAPQKVIEEFYNQTWVHRYGESILPTTLTTLWSLSVAIFSVGGMIGSFSVGLFVNRFGRRNSMLMMNLLAFVSAVLMGFSKLGKSFEMLILGRFIIGVYCGLTTGFVPMYVGEVSPTSPSWGPWGTLHQLGIVVGILIAQGSWMRLPNLTDVSRAGPGAPFSSQQ

SEQ ID NO: 840233 - protein, 589 aa, Homo sapiens
ANGRGPINATVRALSGKRQEVATASVPVASRGSPSEHARGAGDQTTGVGVRVAVGVPGPEHEPERESAARTPVATRVPGAARSHQRSAAMEPSSKKLTGRLMLAVGGAVLGSLQFGYNTGVINAPQKVIEEFYNQTWVHRYGESILPTTLTTLWSLSVAIFSVGGMIGSFSVGLFVNRFGRRNSMLMMNLLAFVSAVLMGFSKLGKSFEMLILGRFIIGVYCGLTTGFVPMYVGEVSPTSPSWGPWGTLHQLGIVVGILIAQVFGLDSIMGNKDLWPLLLSIIFIPALLQCIVLPFCPESPRFLLINRNEENRAKSVLKKLRGTADVTHDLQEMKEESRQMMREKKVTILELFRSPAYRQPILIAVVLQLSQQLSGINAVFYYSTSIFEKAGVQQPVYATIGSGIVNTAFTVVSLFVVERAGRRTLHLIGLAGMAGCAILMTIALALLEQLPWMSYLSIVAIFGFVAFFEVGPGPIPWFIVAELFSQGPRPAAIAVAGFSNWTSNFIVGMCFQYVEQLCGPYVFIIFTVLLVLFFIFTYFKVPETKGRTFDEIASGFRQGGASQSDKTPDSCPVVYRCKIFIYIFGCQY

SEQ ID NO: 840234 - protein, 610 aa, Homo sapiens
ANGRGPINATVRALSGKRQEVATASVPVASRGSPSEHARGAGDQTTGVGVRVAVGVPGPEHEPERESAARTPVATRVPGAARSHQRSAAMEPSSKKLTGRLMLAVGGAVLGSLQFGYNTGVINAPQKVIEEFYNQTWVHRYGESILPTTLTTLWSLSVAIFSVGGMIGSFSVGLFVNRFGRRNSMLMMNLLAFVSAVLMGFSKLGKSFEMLILGRFIIGVYCGLTTGFVPMYVGEVSPTSPSWGPWGTLHQLGIVVGILIAQVFGLDSIMGNKDLWPLLLSIIFIPALLQCIVLPFCPESPRFLLINRNEENRAKSVLKKLRGTADVTHDLQEMKEESRQMMREKKVTILELFRSPAYRQPILIAVVLQLSQQLSGINAVFYYSTSIFEKAGVQQPVYATIGSGIVNTAFTVVSLFVVERAGRRTLHLIGLAGMAGCAILMTIALALLEQLPWMSYLSIVAIFGFVAFFEVGPGPIPWFIVAELFSQGPRPAAIAVAGFSNWTSNFIVGMCFQYVEQLCGPYVFIIFTVLLVLFFIFTYFKVPETKGRTFDEIVPGSSLLCTEGHTITMRRGPVGACKLTAQEDMETPALLCIDARYLYIFLVVNIKYRH

SEQ ID NO: 840235 - protein, 331 aa, Homo sapiens
ANGRGPINATVRALSGKRQEVATASVPVASRGSPSEHARGAGDQTTGVGVRVAVGVPGPEHEPERESAARTPVATRVPGAARSHQRSAAMEPSSKKLTGRLMLAVGGAVLGSLQFGYNTGVINAPQKVIEEFYNQTWVHRYGESILPTTLTTLWSLSVAIFSVGGMIGSFSVGLFVNRFGRRNSMLMMNLLAFVSAVLMGFSKLGKSFEMLILGRFIIGVYCGLTTGFVPMYVGEVSPTSPSWGPWGTLHQLGIVVGILIAQVFGLDSIMGNKDLWPLLLSIIFIQPVMIGCLCQSPVLYNREDRQSVKLRDCVPAVNGDDIGKAPGGRGH

SEQ ID NO: 840236 - protein, 295 aa, Homo sapiens
ANGRGPINATVRALSGKRQEVATASVPVASRGSPSEHARGAGDQTTGVGVRVAVGVPGPEHEPERESAARTPVATRVPGAARSHQRSAAMEPSSKKLTGRLMLAVGGAVLGSLQFGYNTGVINAPQKVIEEFYNQTWVHRYGESILPTTLTTLWSLSVAIFSVGGMIGSFSVGLFVNRFGRRNSMLMMNLLAFVSAVLMGFSKLGKSFEMLILGRFIIGVYCGLTTGFVPMYVGEVSPTSPSWGPWGTLHQLGIVVGILIAQSVPAWDFHSLGPTKGPCGPLACLNHSIFHPNPL

SEQ ID NO: 840237 - protein, 264 aa, Homo sapiens
ANGRGPINATVRALSGKRQEVATASVPVASRGSPSEHARGAGDQTTGVGVRVAVGVPGPEHEPERESAARTPVATRVPGAARSHQRSAAMEPSSKKLTGRLMLAVGGAVLGSLQFGYNTGVINAPQKVIEEFYNQTWVHRYGESILPTTLTTLWSLSVAIFSVGGMIGSFSVGLFVNRFGRRNSMLMMNLLAFVSAVLMGFSKLGNPKLETTDTPLPKKFPFRPQARKVTAVQCPFCLSICPLHSLLILGPTSTATEAGKGHNV

SEQ ID NO: 840238 - protein, 149 aa, Homo sapiens
ANGRGPINATVRALSGKRQEVATASVPVASRGSPSEHARGAGDQTTGVGVRVAVGVPGPEHEPERESAARTPVATRVPGAARSHQRSAAMEPSSKKLTGRLMLAVGGAVLGSLQFGYNTGVINAPQKVSTVPSLAYGHQPALLHITHAH

SEQ ID NO: 840239 - protein, 126 aa, Homo sapiens
VSAVLMGFSKLGKSFEMLILGRFIIGVYCGLTTGFVPMYVGEVSPTSPSWGPWGTLHQLGIVVGILIAQGKLGQDLPAWHGPCPQLQWLSDLCPAGQSFSSAQPPQPCRGQLWYTGPENTAPWPPS

SEQ ID NO: 840240 - protein, 102 aa, Homo sapiens
MIWPFPFSPNHFKLILSPEPSRQMMRKKVTILKLVPGSPAYRQPILINRNEENRAKSVLKKLRGTADVTHDLQEMKEESRQMMREHWSAGRRGEGPVWAAGF

SEQ ID NO: 840241 - protein, 579 aa, Homo sapiens
CLFGRIFSSRRPGRNSRDATASVPVASRGSPSEHARGAGDQTTGVGVRVAVGVPGPEHEPERESAARTPVATRVPGAARSHQRSAAMEPSSKKLTGRLMLAVGGAVLGSLQFGYNTGVINAPQKVIEEFYNQTWVHRYGESILPTTLTTLWSLSVAIFSVGGMIGSFSVGLFVNRFGRRNSMLMMNLLAFVSAVLMGFSKLGKSFEMLILGRFIIGVYCGLTTGFVPMYVGEVSPTSPSWGPWGTLHQLGIVVGILIAQVFGLDSIMGNKDLWPLLLSIIFIPALLQCIVLPFCPESPRFLLINRNEENRAKSVLKKLRGTADVTHDLQEMKEESRQMMREKKVTILELFRSPAYRQPILIAVVLQLSQQLSGINAVFYYSTSIFEKAGVQQPVYATIGSGIVNTAFTVVSLFVVERAGRRTLHLIGLAGMAGCAILMTIALALLEQLPWMSYLSIVAIFGFVAFFEVGPGPIPWFIVAELFSQGPRPAAIAVAGFSNWTSNFIVGMCFQYVEQLCGPYVFIIFTVLLVLFFIFTYFKVPETKGRTFDEIASGFRQGGASQSDKTPEELFHPLGADSQV

SEQ ID NO: 840242 - protein, 626 aa, Homo sapiens
SSLPCPRSSRMGVSFEKQDCFYKSVYEPARLTARLTSRLTARLTSPLPRLTSRLPRLTSRLPRLLATASVPVASRGSPSEHARGAGDQTTGVGVRVAVGVPGPEHEPERESAARTPVATRVPGAARSHQRSAAMEPSSKKLTGRLMLAVGGAVLGSLQFGYNTGVINAPQKVIEEFYNQTWVHRYGESILPTTLTTLWSLSVAIFSVGGMIGSFSVGLFVNRFGRRNSMLMMNLLAFVSAVLMGFSKLGKSFEMLILGRFIIGVYCGLTTGFVPMYVGEVSPTSPSWGPWGTLHQLGIVVGILIAQVFGLDSIMGNKDLWPLLLSIIFIPALLQCIVLPFCPESPRFLLINRNEENRAKSVLKKLRGTADVTHDLQEMKEESRQMMREKKVTILELFRSPAYRQPILIAVVLQLSQQLSGINAVFYYSTSIFEKAGVQQPVYATIGSGIVNTAFTVVSLFVVERAGRRTLHLIGLAGMAGCAILMTIALALLEQLPWMSYLSIVAIFGFVAFFEVGPGPIPWFIVAELFSQGPRPAAIAVAGFSNWTSNFIVGMCFQYVEQLCGPYVFIIFTVLLVLFFIFTYFKVPETKGRTFDEIASGFRQGGASQSDKTPEELFHPLGADSQV

SEQ ID NO: 840243 - protein, 617 aa, Homo sapiens
SSLPCPRSSRMGVSFEKQDCFYKSVYEPARLTARLTSRLTAASRLPCLASRLACLASRLACPVCWQQRACRSLVAGPRVSTPGGVRVAVGVPGPEHEPERESAARTPVATRVPGAARSHQRSAAMEPSSKKLTGRLMLAVGGAVLGSLQFGYNTGVINAPQKVIEEFYNQTWVHRYGESILPTTLTTLWSLSVAIFSVGGMIGSFSVGLFVNRFGRRNSMLMMNLLAFVSAVLMGFSKLGKSFEMLILGRFIIGVYCGLTTGFVPMYVGEVSPTSPSWGPWGTLHQLGIVVGILIAQVFGLDSIMGNKDLWPLLLSIIFIPALLQCIVLPFCPESPRFLLINRNEENRAKSVLKKLRGTADVTHDLQEMKEESRQMMREKKVTILELFRSPAYRQPILIAVVLQLSQQLSGINAVFYYSTSIFEKAGVQQPVYATIGSGIVNTAFTVVSLFVVERAGRRTLHLIGLAGMAGCAILMTIALALLEQLPWMSYLSIVAIFGFVAFFEVGPGPIPWFIVAELFSQGPRPAAIAVAGFSNWTSNFIVGMCFQYVEQLCGPYVFIIFTVLLVLFFIFTYFKVPETKGRTFDEIASGFRQGGASQSDKTPEELFHPLGADSQV

SEQ ID NO: 840244 - protein, 550 aa, Homo sapiens
ANGRGPINATVRALSGKRQEVATASVPVASRGSPSEHARGAGDQTTGVGVRVAVGVPGPEHEPERESAARTPVATRVPGAARSHQRSAAMEPSSKVIEEFYNQTWVHRYGESILPTTLTTLWSLSVAIFSVGGMIGSFSVGLFVNRFGRRNSMLMMNLLAFVSAVLMGFSKLGKSFEMLILGRFIIGVYCGLTTGFVPMYVGEVSPTSPSWGPWGTLHQLGIVVGILIAQVFGLDSIMGNKDLWPLLLSIIFIPALLQCIVLPFCPESPRFLLINRNEENRAKSVLKKLRGTADVTHDLQEMKEESRQMMREKKVTILELFRSPAYRQPILIAVVLQLSQQLSGINAVFYYSTSIFEKAGVQQPVYATIGSGIVNTAFTVVSLFVVERAGRRTLHLIGLAGMAGCAILMTIALALLEQLPWMSYLSIVAIFGFVAFFEVGPGPIPWFIVAELFSQGPRPAAIAVAGFSNWTSNFIVGMCFQYVEQLCGPYVFIIFTVLLVLFFIFTYFKVPETKGRTFDEIASGFRQGGASQSDKTPEELFHPLGADSQV

SEQ ID NO: 840245 - protein, 542 aa, Homo sapiens
ANGRGPINATVRALSGKRQEVATASVPVASRGSPSEHARGAGDQTTGVGVRVAVGVPGPEHEPERESAARTPVATRVPGAARSHQRSAAMEPSSKKLTGRLMLAVGGAVLGSLQFGYNTGVINAPQKVIEEFYNQTWVHRYGESILPTTLTTLWSLSVAIFSVGGMIGSFSVGLFVNRFGRRNSMLMMNLLAFVSAVLMGFSKLGKSFEMLILGRFIIGVYCGLTTGFVPMYVGEVSPTSPSWGPWGTLHQLGIVVGILIAQVFGLDSIMGNKDLWPLLLSIIFIPALLQCIVLPFCPESPRFLLINRNEENRAKSVLKKLRGTADVTHDLQEMKEESRQMMREKKVTILELFRSPAYRQPILIAVVLQLSQQLSGINAVFYYSTSIFEKAGVQQPVYATIGSGIVNTAFTVVSLFVVERAGRRTLHLIGLAGMAGCAILMTIALALLEQLPWMSYLSIVAIFGFVAFFEVGPGPIPWFIVAELFSQGPRPAAIAVAGFSNWTSNFIVGMCFQYVEQLCGPYVFIIFTVLLVLFFIYVLRTH

SEQ ID NO: 840246 - protein, 582 aa, Homo sapiens; identical to SEQ ID NO: 840222

SEQ ID NO: 840247 - protein, 151 aa, Homo sapiens
VIFTYFKVPETKGRTFDEIASGFRQGGASQSDKTTLHLIGLAGMAGCAILMTIALALLEQLPWMSYLSIVAIFGFVAFFEVGPGPIPWFIVAELFSQGPRPAAIAVAGFSNWTSNFIVGMCFQYVEQLCGPYVFIIFTVLLVLFFICSQQP

SEQ ID NO: 840248 - protein, 244 aa, Homo sapiens
ANGRGPINATVRALSGKRQEVATASVPVASRGSPSEHARGAGDQTTGVGVRVAVGVPGPEHEPERESAARTPVATRVPGAARSHQRSAAMEPSSKKLTGRLMLAVGGAVLGSLQFGYNTGVINAPQKVIEEFYNQTWVHRYGESILPTTLTTLWSLSVAIFSVGGMIGSFSVGLFVNRFGRRNSMLMMNLLAFVSAVLMGFSKLGKSFEMLILGRFIIGVYCGLTTGFVLEPLPAPHREASVPS

SEQ ID NO: 840249 - protein, 136 aa, Homo sapiens [sequence omitted]

SEQ ID NO: 840250 - protein, 282 aa, Homo sapiens
AEGHEREESGFLGDGDLGVGRTPKARRPGGGLLALGLDICKREIWGRRSKSGGGGGLGFGPQDPISGPLIQRGLQRDMAEAHQAVGFRPSLTSDGAEVELSAPVLQEIYLSGLRSWKRHLSRFWNDFLTGVFPASPLSWLFLFSAIQLAWFLQLDPSLGLMEKIKELLPDWGGQHHGLRGVLAAALFASCLWGALIFTLHVALRLLLSYHGWLLEPHGAMSSPTKTWLALVRIFSGRHPMLFSYQRSLPRQPVPSVQDTVRKYLESAGHLLEEEFDDGLRGS

SEQ ID NO: 840251 - protein, 792 aa, Homo sapiens
MAEAHQAVGFRPSLTSDGAEVELSAPVLQEIYLSGLRSWKRHLSRFWNDFLTGVFPASPLSWLFLFSAIQLAWFLQLDPSLGLMEKIKELLPDWGGQHHGLRGVLAAALFASCLWGALIFTLHVALRLLLSYHGWLLEPHGAMSSPTKTWLALVRIFSGRHPMLFSYQRSLPRQPVPSVQDTVRKYLESVRPILSDEDFDWTAVLAQEFLRLQASLLQWYLRLKSWWASNYVSDWWEEFVYLRSRNPLMVNSNYYMMAARAGNAVHALLLYRHRLNRQEIPPTLLMGMRPLCSAQYEKIFNTTRIPGVQKDYIRHLHDSQHVAVFHRGRFFRMGTHSRNSLLSPRALEQQFQRILDDPSPACPHEEHLAALTAAPRGTWAQVRTSLKTQAAEALEAVEGAAFFVSLDAEPAGLTREDPAASLDAYAHALLAGRGHDRWFDKSFTLIVFSNGKLGLSVEHSWADCPISGHMWEFTLATECFQLGYSTDGHCKGHPDPTLPQPQRLQWDLPDQIHSSISLALRGAKILSENVDCHVVPFSLFGKSFIRRCHLSSDSFIQIALQLAHFRDRGQFCLTYESAMTRLFLEGRTETVRSCTREACNFVRAMEDKEKTDPQCLALFRVAVDKHQALLKAAMSGQGVDRHLFALYIVSRFLHLQSPFLTQVHSEQWQLSTSQIPVQQMHLFDVHNYPDYVSSGGGFGPADDHGYGVSYIFMGDGMITFHISSKKSSTKTDSHRLGQHIEDALLDVASLFQAGQHFKRRFRGSGKENSRHRCGFLSRQTGASKASMTSTDF

SEQ ID NO: 840252 - protein, 792 aa, Homo sapiens; identical to SEQ ID NO: 840251

SEQ ID NO: 840253 - protein, 792 aa, Homo sapiens; identical to SEQ ID NO: 840251

SEQ ID NO: 840254 - protein, 558 aa, Homo sapiens
MAEAHQAVGFRPSLTSDGAEVELSAPVLQEIYLSGLYRHRLNRQEIPPTLLMGMRPLCSAQYEKIFNTTRIPGVQKDYIRHLHDSQHVAVFHRGRFFRMGTHSRNSLLSPRALEQQFQRILDDPSPACPHEEHLAALTAAPRGTWAQVRTSLKTQAAEALEAVEGAAFFVSLDAEPAGLTREDPAASLDAYAHALLAGRGHDRWFDKSFTLIVFSNGKLGLSVEHSWADCPISGHMWEFTLATECFQLGYSTDGHCKGHPDPTLPQPQRLQWDLPDQIHSSISLALRGAKILSENVDCHVVPFSLFGKSFIRRCHLSSDSFIQIALQLAHFRDRGQFCLTYESAMTRLFLEGRTETVRSCTREACNFVRAMEDKEKTDPQCLALFRVAVDKHQALLKAAMSGQGVDRHLFALYIVSRFLHLQSPFLTQVHSEQWQLSTSQIPVQQMHLFDVHNYPDYVSSGGGFGPADDHGYGVSYIFMGDGMITFHISSKKSSTKTDSHRLGQHIEDALLDVASLFQAGQHFKRRFRGSGKENSRHRCGFLSRQTGASKASMTSTDF

SEQ ID NO: 840255 - protein, 300 aa, Homo sapiens
MAEAHQAVGFRPSLTSDGAEVELSAPVLQEIYLSGLRSWKRHLSRFWNDFLTGVFPASPLSWLFLFSAIQLAWFLQLDPSLGLMEKIKELLPDWGGQHHGLRGVLAAALFASCLWGALIFTLHVALRLLLSYHGWLLEPHGAMSSPTKTWLALVRIFSGRHPMLFSYQRSLPRQPVPSVQDTVRKYLESVRPILSDEDFDWTAVLAQEFLRLQASLLQWYLRLKSWWASNYVSDWWEEFVYLRSRNPLMVNSNYYMMAARAGNAVHALLLYRHRLNRQEIPPVRGPQWVRDGGVVLWPLG

SEQ ID NO: 840256 - protein, 641 aa, Homo sapiens
MLFSYQRSLPRQPVPSVQDTVRKYLESVRPILSDEDFDWTAVLAQEFLRLQASLLQWYLRLKSWWASNYVSDWWEEFVYLRSRNPLMVNSNYYMMDFLYVTPTPLQAARAGNAVHALLLYRHRLNRQEIPPTLLMGMRPLCSAQYEKIFNTTRIPGVQKDYIRHLHDSQHVAVFHRGRFFRMGTHSRNSLLSPRALEQQFQRILDDPSPACPHEEHLAALTAAPRGTWAQVRTSLKTQAAEALEAVEGAAFFVSLDAEPAGLTREDPAASLDAYAHALLAGRGHDRWFDKSFTLIVFSNGKLGLSVEHSWADCPISGHMWEFTLATECFQLGYSTDGHCKGHPDPTLPQPQRLQWDLPDQIHSSISLALRGAKILSENVDCHVVPFSLFGKSFIRRCHLSSDSFIQIALQLAHFRDRGQFCLTYESAMTRLFLEGRTETVRSCTREACNFVRAMEDKEKTDPQCLALFRVAVDKHQALLKAAMSGQGVDRHLFALYIVSRFLHLQSPFLTQVHSEQWQLSTSQIPVQQMHLFDVHNYPDYVSSGGGFGPADDHGYGVSYIFMGDGMITFHISSKKSSTKTDSHRLGQHIEDALLDVASLFQAGQHFKRRFRGSGKENSRHRCGFLSRQTGASKASMTSTDF

SEQ ID NO: 840257 - protein, 159 aa, Homo sapiens [sequence omitted]

SEQ ID NO: 840258 - protein, 66 aa, Homo sapiens
MGSCPQVHSEQWQLSTSQIPVQQMHLFDVHNYPDYVSSGGGFGPVSGAGRAGPQRKEGAGGPALLH

SEQ ID NO: 840259 - protein, 136 aa, Homo sapiens
MGSCPQVHSEQWQLSTSQIPVQQMHLFDVHNYPDYVSSGGGFGPADDHGYGVSYIFMGDGMITFHISSKKSSTKTDSHRLGQHIEDALLDVASLFQAGQHFKRRFRGSGKENSRHRCGFLSRQTGASKASMTSTDF

SEQ ID NO: 840260 - protein, 792 aa, Homo sapiens; identical to SEQ ID NO: 840251

SEQ ID NO: 840261 - protein, 792 aa, Homo sapiens; identical to SEQ ID NO: 840251

SEQ ID NO: 840262 - protein, 869 aa, Homo sapiens
AEGHEREESGFLGDGDLGVGRTPKARRPGGGLLALGLDICKREIWGRRSKSGGGGGLGFGPQDPISGPLIQRGLQRDMAEAHQAVGFRPSLTSDGAEVELSAPVLQEIYLSGLRSWKRHLSRFWNDFLTGVFPASPLSWLFLFSAIQLAWFLQLDPSLGLMEKIKELLPDWGGQHHGLRGVLAAALFASCLWGALIFTLHVALRLLLSYHGWLLEPHGAMSSPTKTWLALVRIFSGRHPMLFSYQRSLPRQPVPSVQDTVRKYLESVRPILSDEDFDWTAVLAQEFLRLQASLLQWYLRLKSWWASNYVSDWWEEFVYLRSRNPLMVNSNYYMMAARAGNAVHALLLYRHRLNRQEIPPTLLMGMRPLCSAQYEKIFNTTRIPGVQKDYIRHLHDSQHVAVFHRGRFFRMGTHSRNSLLSPRALEQQFQRILDDPSPACPHEEHLAALTAAPRGTWAQVRTSLKTQAAEALEAVEGAAFFVSLDAEPAGLTREDPAASLDAYAHALLAGRGHDRWFDKSFTLIVFSNGKLGLSVEHSWADCPISGHMWEFTLATECFQLGYSTDGHCKGHPDPTLPQPQRLQWDLPDQIHSSISLALRGAKILSENVDCHVVPFSLFGKSFIRRCHLSSDSFIQIALQLAHFRDRGQFCLTYESAMTRLFLEGRTETVRSCTREACNFVRAMEDKEKTDPQCLALFRVAVDKHQALLKAAMSGQGVDRHLFALYIVSRFLHLQSPFLTQVHSEQWQLSTSQIPVQQMHLFDVHNYPDYVSSGGGFGPADDHGYGVSYIFMGDGMITFHISSKKSSTKTDSHRLGQHIEDALLDVASLFQAGQHFKRRFRGSGKENSRHRCGFLSRQTGASKASMTSTDF

SEQ ID NO: 840263 - protein, 909 aa, Homo sapiens
AEGHEREESGFLGDGDLGVGRTPKARRPGGGLLALGLDICKREIWGRRSKSGGGGGLGFGPQDPISGPLIQRGLQRDMAEAHQAVGFRPSLTSDGAEVELSAPVLQEIYLSGLRSWKRHLSRFWGLTYFVTQAGGSVTITAHFIPELLGSSDPPASAFQVAGTKNDFLTGVFPASPLSWLFLFSAIQLAWFLQLDPSLGLMEKIKELLPDWGGQHHGLRGVLAAALFASCLWGALIFTLHVALRLLLSYHGWLLEPHGAMSSPTKTWLALVRIFSGRHPMLFSYQRSLPRQPVPSVQDTVRKYLESVRPILSDEDFDWTAVLAQEFLRLQASLLQWYLRLKSWWASNYVSDWWEEFVYLRSRNPLMVNSNYYMMAARAGNAVHALLLYRHRLNRQEIPPTLLMGMRPLCSAQYEKIFNTTRIPGVQKDYIRHLHDSQHVAVFHRGRFFRMGTHSRNSLLSPRALEQQFQRILDDPSPACPHEEHLAALTAAPRGTWAQVRTSLKTQAAEALEAVEGAAFFVSLDAEPAGLTREDPAASLDAYAHALLAGRGHDRWFDKSFTLIVFSNGKLGLSVEHSWADCPISGHMWEFTLATECFQLGYSTDGHCKGHPDPTLPQPQRLQWDLPDQIHSSISLALRGAKILSENVDCHVVPFSLFGKSFIRRCHLSSDSFIQIALQLAHFRDRGQFCLTYESAMTRLFLEGRTETVRSCTREACNFVRAMEDKEKTDPQCLALFRVAVDKHQALLKAAMSGQGVDRHLFALYIVSRFLHLQSPFLTQVHSEQWQLSTSQIPVQQMHLFDVHNYPDYVSSGGGFGPADDHGYGVSYIFMGDGMITFHISSKKSSTKTDSHRLGQHIEDALLDVASLFQAGQHFKRRFRGSGKENSRHRCGFLSRQTGASKASMTSTDF

SEQ ID NO: 840264 - protein, 650 aa, Homo sapiens
MSSPTKTWLALVRIFSGRHPMLFSYQRSLPRQPVPSVQDTVRKYLESVRPILSDEDFDWTAVLAQEFLRLQASLLQWYLRLKSWWASNYVSDWWEEFVYLRSRNPLMVNSNYYMMAARAGNAVHALLLYRHRLNRQEIPPTLLMGMRPLCSAQYEKIFNTTRIPGVQKDYIRHLHDSQHVAVFHRGRFFRMGTHSRNSLLSPRALEQQFQRILDDPSPACPHEEHLAALTAAPRGTWAQVRTSLKTQAAEALEAVEGAAFFVSLDAEPAGLTREDPAASLDAYAHALLAGRGHDRWFDKSFTLIVFSNGKLGLSVEHSWADCPISGHMWEFTLATECFQLGYSTDGHCKGHPDPTLPQPQRLQWDLPDQIHSSISLALRGAKILSENVDCHVVPFSLFGKSFIRRCHLSSDSFIQIALQLAHFRDRGQFCLTYESAMTRLFLEGRTETVRSCTREACNFVRAMEDKEKTDPQCLALFRVAVDKHQALLKAAMSGQGVDRHLFALYIVSRFLHLQSPFLTQVHSEQWQLSTSQIPVQQMHLFDVHNYPDYVSSGGGFGPADDHGYGVSYIFMGDGMITFHISSKKSSTKTDSHRLGQHIEDALLDVASLFQAGQHFKRRFRGSGKENSRHRCGFLSRQTGASKASMTSTDF

SEQ ID NO: 840265 - protein, 1805 aa, Homo sapiens
MSDTKVKVAVRVRPMNRRELELNTKCVVEMEGNQTVLHPPPSNTKQGERKPPKVFAFDYCFWSMDESNTTKYAGQEVVFKCLGEGILEKAFQGYNACIFAYGQTGSGKSFSMMGHAEQLGLIPRLCCALFKRISLEQNESQTFKVEVSYMEIYNEKVRDLLDPKGSRQSLKVREHKVLGPYVDGLSQLAVTSFEDIESLMSEGNKSRTVAATNMNEESSRSHAVFNIIITQTLYDLQSGNSGEKVSKVSLVDLAGSERVSKTGAAGERLKEGSNINKSLTTLGLVISSLADQAAGKGKSKFVPYRDSVLTWLLKDNLGGNSQTSMIATISPAADNYEETLSTLRYADRAKRIVNHAVVNEDPNAKVIRELREEVEKLREQLSQAEAMKAPELKEKLEESEKLIKELTVTWEEKLRKTEEIAQERQRQLESMGISLEMSGIKVGDDKCYLVNLNADPALNELLVYYLKDHTRVGADTSQDIQLFGIGIQPQHCEIDIASDGDVTLTPKENARSCVNGTLVCSTTQLWHGDRILWGNNHFFRINLPKRKRRDWLKDFEKETGPPEHDLDAASEASSEPDYNYEFAQMEVIMKTLNSNDPVQNVVQVLEKQYLEEKRSALEEQRLMYERELEQLRQQLSPDRQPQSSGPDRLAYSSQTAQQKVTQWAEERDELFRQSLAKLREQLVKANTLVREANFLAEEMSKLTDYQVTLQIPAANLSANRKRGAIVSEPAIQVRRKGKSTQVWTIEKLENKLIDMRDLYQEWKEKVPEAKRLYGKRGDPFYEAQENHNLIGVANVFLECLFCDVKLQYAVPIISQQGEVAGRLHVEVMRVTGAVPERVVEDDSSENSSESGSLEVVDSSGEIIHRVKKLTCRVKIKEATGLPLNLSNFVFCQYTFWDQCESTVAAPVVDPEVPSPQSKDAQYTVTFSHCKDYVVNVTEEFLEFISDGALAIEVWGHRCAGNGSSIWEVDSLHAKTRTLHDRWNEVTRRIEMWISILELNELGEYAAVELHQAKDVNTGGIFQLRQGHSRRVQVTVKPVQHSGTLPLMVEAILSVSIGCVTARSTKLQRGLDSYQRDDEDGDDMDSYQEEDLNCVRERWSDALIKRREYLDEQIKKVSNKTEKTEDDVEREAQLVEQWVGLTEERNAVLVPAPGSGIPGAPADWIPPPGMETHIPVLFLDLNADDLSANEQLVGPHASGVNSILPKEHGSQFFYLPIIKHSDDEVSATASWDSSVHDSVHLNRVTPQNERIYLIVKTTVQLSHPAAMELVLRKRIAANIYNKQSFTQSLKRRISLKNIFYSCGVTYEIVSNIPKATEEIEDRETLALLAARSENEGTSDGETYIEKYTRGVLQVENILSLERLRQAVTVKEALSTKARHIRRSLSTPNVHNVSSSRPDLSGFDEDDKGWPENQLDMSDYSSSYQDVACYGTLPRDSPRRNKEGCTSETPHALTVSPFKAFSPQPPKFFKPLMPVKEEHKKRIALEARPLLSQESMPPPQAHNPGCIVPSGSNGSSMPVEHNSKREKKIDSEEEENELEAINRKLISSQPYVPVEFADFSVYNASLENREWFSSKVDLSNSRVLEKEVSRSPTTSSITSGYFSHSASNATLSDMVVPSSDSSDQLAIQTKDADSTEHSTPSLVHDFRPSSNKELTEVEKGLVKDKIIVVPLKENSALAKGSPSSQSIPEKNSKSLCRTGSCSELDACPSKISQPARGFCPREVTVEHTTNILEDHSFTEFMGVSEGKDFDGLTDSSAGELSSRRSLPNKTGGKTVSDGLHHPSQLHSKLENDQVIIPEAAFWVLCCQ

SEQ ID NO: 840266 - protein, 1757 aa, Homo sapiens
MSDTKVKVAVRVRPMNRRELELNTKCVVEMEGNQTVLHPPPSNTKQGERKPPKVFAFDYCFWSMDESNTTKYAGQEVVFKCLGEGILEKAFQGYNACIFAYGQTGSGKSFSMMGHAEQLGLIPRLCCALFKRISLEQNESQTFKVEVSYMEIYNEKVRDLLDPKGSRQSLKVREHKVLGPYVDGLSQLAVTSFEDIESLMSEGNKSRTVAATNMNEESSRSHAVFNIIITQTLYDLQSGNSGEKVSKVSLVDLAGSERVSKTGAAGERLKEGSNINKSLTTLGLVISSLADQAAGKGKSKFVPYRDSVLTWLLKDNLGGNSQTSMIATISPAADNYEETLSTLRYADRAKRIVNHAVVNEDPNAKVIRELREEVEKLREQLSQAEAMKAPELKEKLEESEKLIKELTVTWEEKLRKTEEIAQERQRQLESMGISLEMSGIKVGDDKCYLVNLNADPALNELLVYYLKDHTRVGADTSQDIQLFGIGIQPQHCEIDIASDGDVTLTPKENARSCVNGTLVCSTTQLWHGDRILWGNNHFFRINLPKRKRRDWLKDFEKETGPPEHDLDAASEASSEPDYNYEFAQMEVIMKTLNSNDPVQNVVQVLEKQYLEEKRSALEEQRLMYERELEQLRQQLSPDRQPQSSGPDRLAYSSQTAQQKVTQWAEERDELFRQSLAKLREQLVKANTLVREANFLAEEMSKLTDYQVTLQIPAANLSANRKRGAIVSEPAIQVRRKGKSTQVWTIEKLENKLIDMRDLYQEWKEKVPEAKRLYGKRGDPFYEAQENHNLIGVANVFLECLFCDVKLQYAVPIISQQGEVAGRLHVEVMRVTGAVPERVVEDDSSENSSESGSLEVVDSSGEIIHRVKKLTCRVKIKEATGLPLNLSNFVFCQYTFWDQCESTVAAPVVDPEVPSPQSKDAQYTVTFSHCKDYVVNVTEEFLEFISDGALAIEVWGHRCAGNGSSIWEVDSLHAKTRTLHDRWNEVTRRIEMWISILELNELGEYAAVELHQAKDVNTGGIFQLRQGHSRRVQVTVKPVQHSGTLPLMVEAILSVSIGCVTARSTKLQRGLDSYQEEDLNCVRERWSDALIKRREYLDEQIKKVSNKTEKTEDDVEREAQLVEQWVGLTEERNAVLVPAPGSGIPGAPADWIPPPGMETHIPVLFLDLNADDLSANEQLVGPHASGVNSILPKEHGSQFFYLPIIKHSDDEVSATASWDSSVHDSVHLNRVTPQNERIYLIVKTTVQLSHPAAMELVLRKRIAANIYNKQSFTQSLKRRISLKNIFYSCGVTYEIVSNIPKATEEIEDRETLALLAARSENEGTSDGETYIEKYTRGVLQVENILSLERLRQAVTVKEALSTKARHIRRSLSTPNVHNVSSSRPDLSGFDEDDKGWPENQLDMSDYSSSYQDVACYGTLPRDSPRRNKEGCTSETPHALTVSPFKAFSPQPPKFFKPLMPVKEEHKKRIALEARPLLSQEDSEEEENELEAINRKLISSQPYVPVEFADFSVYNASLENREWFSSKVDLSNSRVLEKEVSRSPTTSSITSGYFSHSASNATLSDMVVPSSDSSDQLAIQTKDADSTEHSTPSLVHDFRPSSNKELTEVEKGLVKDKIIVVPLKENSALAKGSPSSQSIPEKNSKSLCRTGSCSELDACPSKISQPARGFCPREVTVEHTTNILEDHSFTEFMGVSEGKDFDGLTDSSAGELSSRRSLPNKTGGKTVSDGLHHPSQLHSKLENDQVIIPEAAFWVLCCQ

SEQ ID NO: 840267 - protein, 1748 aa, Homo sapiens
MSDTKVKVAVRVRPMNRRELELNTKCVVEMEGNQTVLHPPPSNTKQGERKPPKVFAFDYCFWSMDESNTTKYAGQEVVFKCLGEGILEKAFQGYNACIFAYGQTGSGKSFSMMGHAEQLGLIPRLCCALFKRISLEQNESQTFKVEVSYMEIYNEKVRDLLDPKGSRQSLKVREHKVLGPYVDGLSQLAVTSFEDIESLMSEGNKSRTVAATNMNEESSRSHAVFNIIITQTLYDLQSGNSGEKVSKVSLVDLAGSERVSKTGAAGERLKEGSNINKSLTTLGLVISSLADQAAGKGKSKFVPYRDSVLTWLLKDNLGGNSQTSMIATISPAADNYEETLSTLRYADRAKRIVNHAVVNEDPNAKVIRELREEVEKLREQLSQAEAMKAPELKEKLEESEKLIKELTVTWEEKLRKTEEIAQERQRQLESMGISLEMSGIKVGDDKCYLVNLNADPALNELLVYYLKDHTRVGADTSQDIQLFGIGIQPQHCEIDIASDGDVTLTPKENARSCVNGTLVCSTTQLWHGDRILWGNNHFFRINLPKRKRRDWLKDFEKETGPPEHDLDAASEASSEPDYNYEFAQMEVIMKTLNSNDPVQNVVQVLEKQYLEEKRSALEEQRLMYERELEQLRQQLSPDRQPQSSGPDRLAYSSQTAQQKVTQWAEERDELFRQSLAKLREQLVKANTLVREANFLAEEMSKLTDYQVTLQIPAANLSANRKRGAIVSEPAIQVRRKGKSTQVWTIEKLENKLIDMRDLYQEWKEKVPEAKRLYGKRGDPFYEAQENHNLIGVANVFLECLFCDVKLQYAVPIISQQGEVAGRLHVEVMRVTGAVPERVVEDDSSENSSESGSLEVVDSSGEIIHRVKKLTCRVKIKEATGLPLNLSNFVFCQYTFWDQCESTVAAPVVDPEVPSPQSKDAQYTVTFSHCKDYVVNVTEEFLEFISDGALAIEVWGHRCAGNGSSIWEVDSLHAKTRTLHDRWNEVTRRIEMWISILELNELGEYAAVELHQAKDVNTGGIFQLRQGHSRRVQVTVKPVQHSGTLPLMVEAILSVSIGCVTARSTKLQRGLDSYQEEDLNCVRERWSDALIKRREYLDEQIKKVSNKTEKTEDDVEREAQLVEQWVGLTEERNAVLVPAPGSGIPGAPADWIPPPGMETHIPVLFLDLNADDLSANEQLVGPHASGVNSILPKEHGSQFFYLPIIKHSDDEVSATASWDSSVHDSVHLNRVTPQNERIYLIVKTTVQLSHPAAMELVLRKRIAANIYNKQSFTQSLKRRISLKNIFYSCGVTYEIVSNIPKATEEIEDRETLALLAARSENEGTSDGETYIEKYTRGVLQVENILSLERLRQAVTVKEALSTKARHIRRSLSTPNVHNVSSSRPDLSGFDEDDKGWPENQLDMSDYSSSYQDVACYGTLPRDSPRRNKEGCTSETPHALTVSPFKAFSPQPPKFFKPLMPVKEEHKKRIALEARPLLSQEDSEEEENELEAINRKLISSQPYVPVEFADFSVYNASLENREWFSSKVDLSNSRVLEKEVSRSPTTSSITSGYFSHSASNATLSDMVVPSSDSSDQLAIQTKDADSTEHSTPSLVHDFRPSSNKELTEVEKGLVKDKIIVVPLKENSALAKGSPSSQSIPEKNSKSLCRTGSCSELDACPSKISQPARGFCPREVTVEHTTNILEDHSFTEFMGVSEGKDFDGLTDSSAGELSSRRSLPNKTGGKTVSDGLHHPSQLHSKLENDGGTTSR

SEQ ID NO: 840268 - protein, 684 aa, Homo sapiens
MSDTKVKVAVRVRPMNRRELELNTKCVVEMEGNQTVLHPPPSNTKQGERKPPKVFAFDYCFWSMDESNTTKYAGQEVVFKCLGEGILEKAFQGYNACIFAYGQTGSGKSFSMMGHAEQLGLIPRLCCALFKRISLEQNESQTFKVEVSYMEIYNEKVRDLLDPKGSRQSLKVREHKVLGPYVDGLSQLAVTSFEDIESLMSEGNKSRTVAATNMNEESSRSHAVFNIIITQTLYDLQSGNSGEKVSKVSLVDLAGSERVSKTGAAGERLKEGSNINKSLTTLGLVISSLADQAAGKGKSKFVPYRDSVLTWLLKDNLGGNSQTSMIATISPAADNYEETLSTLRYADRAKRIVNHAVVNEDPNAKVIRELREEVEKLREQLSQAEAMKAPELKEKLEESEKLIKELTVTWEEKLRKTEEIAQERQRQLESMGISLEMSGIKVGDDKCYLVNLNADPALNELLVYYLKDHTRVGADTSQDIQLFGIGIQPQHCEIDIASDGDVTLTPKENARSCVNGTLVCSTTQLWHGDRILWGNNHFFRINLPKRKRRDWLKDFEKETGPPEHDLDAASEASSEPDYNYEFAQMEVIMKTLNSNDPVQNVVQVLEKQYLEEKRSALEEQRLMYERELEQLRQQLSPDRQPQSSGPDRLAYSSQTAQQKVTQWAEESYHLGKTSHTEIGAEGTQ

SEQ ID NO: 840269 - protein, 1104 aa, Homo sapiens
DDLMLLPLQIPAGNLSANRKRGAIVSEPAIQVRRKGKSTQVWTIEKLENKLIDMRDLYQEWKEKVPEAKRLYGKRGDPFYEAQENHNLIGVANVFLECLFCDVKLQYAVPIISQQGEVAGRLHVEVMRVTGAVPERVVEDDSSENSSESGSLEVVDSSGEIIHRVKKLTCRVKIKEATGLPLNLSNFVFCQYTFWDQCESTVAAPVVDPEVPSPQSKDAQYTVTFSHCKDYVVNVTEEFLEFISDGALAIEVWGHRCAGNGSSIWEVDSLHAKTRTLHDRWNEVTRRIEMWISILELNELGEYAAVELHQAKDVNTGGIFQLRQGHSRRVQVTVKPVQHSGTLPLMVEAILSVSIGCVTARSTKLQRGLDSYQRDDEDGDDMDSYQEEDLNCVRERWSDALIKRREYLDEQIKKVSNKTEKTEDDVEREAQLVEQWVGLTEERNAVLVPAPGSGIPGAPADWIPPPGMETHIPVLFLDLNADDLSANEQLVGPHASGVNSILPKEHGSQFFYLPIIKHSDDEVSATASWDSSVHDSVHLNRVTPQNERIYLIVKTTVQLSHPAAMELVLRKRIAANIYNKQSFTQSLKRRISLKNIFYSCGVTYEIVSNIPKATEEIEDRETLALLAARSENEGTSDGETYIEKYTRGVLQVENILSLERLRQAVTVKEALSTKARHIRRSLSTPNVHNVSSSRPDLSGFDEDDKGWPENQLDMSDYSSSYQDVACYGTLPRDSPRRNKEGCTSETPHALTVSPFKAFSPQPPKFFKPLMPVKEEHKKRIALEARPLLSQESMPPPQAHNPGCIVPSGSNGSSMPVEHNSKREKKIDSEEEENELEAINRKLISSQPYVPVEFADFSVYNASLENREWFSSKVDLSNSRVLEKEVSRSPTTSSITSGYFSHSASNATLSDMVVPSSDSSDQLAIQTKDADSTEHSTPSLVHDFRPSSNKELTEVEKGLVKDKIIVVPLKENSALAKGSPSSQSIPEKNSKSLCRTGSCSELDACPSKISQPARGFCPREVTVEHTTNILEDHSFTEFMGVSEGKDFDGLTDSSAGELSSRRSLPNKTGGKTVSDGLHHPSQLHSKLENDQVIIPEAAFWVLCCQ

SEQ ID NO: 840270 - protein, 484 aa, Homo sapiens
MSDTKVKVAVRVRPMNRRELELNTKCVVEMEGNQTVLHPPPSNTKQGERKPPKVFAFDYCFWSMDESNTTKYAGQEVVFKCLGEGILEKAFQGYNACIFAYGQTGSGKSFSMMGHAEQLGLIPRLCCALFKRISLEQNESQTFKVEVSYMEIYNEKVRDLLDPKGSRQSLKVREHKVLGPYVDGLSQLAVTSFEDIESLMSEGNKSRTVAATNMNEESSRSHAVFNIIITQTLYDLQSGNSGEKVSKVSLVDLAGSERVSKTGAAGERLKEGSNINKSLTTLGLVISSLADQAAGKGKSKFVPYRDSVLTWLLKDNLGGNSQTSMIATISPAADNYEETLSTLRYADRAKRIVNHAVVNEDPNAKVIRELREEVEKLREQLSQAEAMKAPELKEKLEESEKLIKELTVTWEEKLRKTEEIAQERQRQLESMGISLEMSGIKVGDDKCYLVNLNADPALNELLVYYLKSFNQSRRFLLGEFMLKE

SEQ ID NO: 840271 - protein, 77 aa, Homo sapiens
AAALEGRAAAAAAAPRVRGRLRPSGRGERPGERSQHVGYQGKSCRPGPAHEPTRTGTEHQVRGGDGRESNGPAPSSF

SEQ ID NO: 840272 - protein, 1770 aa, Homo sapiens
MSDTKVKVAVRVRPMNRRELELNTKCVVEMEGNQTVLHPPPSNTKQGERKPPKVFAFDYCFWSMDESNTTKYAGQEVVFKCLGEGILEKAFQGYNACIFAYGQTGSGKSFSMMGHAEQLGLIPRLCCALFKRISLEQNESQTFKVEVSYMEIYNEKVRDLLDPKGSRQSLKVREHKVLGPYVDGLSQLAVTSFEDIESLMSEGNKSRTVAATNMNEESSRSHAVFNIIITQTLYDLQSGNSGEKVSKVSLVDLAGSERVSKTGAAGERLKEGSNINKSLTTLGLVISSLADQAAGKGKSKFVPYRDSVLTWLLKDNLGGNSQTSMIATISPAADNYEETLSTLRYADRAKRIVNHAVVNEDPNAKVIRELREEVEKLREQLSQAEAMKAPELKEKLEESEKLIKELTVTWEEKLRKTEEIAQERQRQLESMGISLEMSGIKVGDDKCYLVNLNADPALNELLVYYLKDHTRVGADTSQDIQLFGIGIQPQHCEIDIASDGDVTLTPKENARSCVNGTLVCSTTQLWHGDRILWGNNHFFRINLPKRKRRDWLKDFEKETGPPEHDLDAASEASSEPDYNYEFAQMEVIMKTLNSNDPVQNVVQVLEKQYLEEKRSALEEQRLMYERELEQLRQQLSPDRQPQSSGPDRLAYSSQTAQQKVTQWAEERDELFRQSLAKLREQLVKANTLVREANFLAEEMSKLTDYQVTLQIPAANLSANRKRGAIVSEPAIQVRRKGKSTQVWTIEKLENKLIDMRDLYQEWKEKVPEAKRLYGKRGDPFYEAQENHNLIGVANVFLECLFCDVKLQYAVPIISQQGEVAGRLHVEVMRVTGAVPERVVEDDSSENSSESGSLEVVDSSGEIIHRVKKLTCRVKIKEATGLPLNLSNFVFCQYTFWDQCESTVAAPVVDPEVPSPQSKDAQYTVTFSHCKDYVVNVTEEFLEFISDGALAIEVWGHRCAGNGSSIWEVDSLHAKTRTLHDRWNEVTRRIEMWISILELNELGEYAAVELHQAKDVNTGGIFQLRQGHSRRVQVTVKPVQHSGTLPLMVEAILSVSIGCVTARSTKLQRGLDSYQRDDEDGDDMDSYQEEDLNCVRERWSDALIKRREYLDEQIKKVSNKTEKTEDDVEREAQLVEQWVGLTEERNAVLVPAPGSGIPGAPADWIPPPGMETHIPVLFLDLNADDLSANEQLVGPHASGVNSILPKEHGSQFFYLPIIKHSDDEVSATASWDSSVHDSVHLNRVTPQNERIYLIVKTTVQLSHPAAMELVLRKRIAANIYNKQSFTQSLKRRISLKNIFYSCGVTYEIVSNIPKATEEIEDRETLALLAARSENEGTSDGETYIEKYTRGVLQVENILSLERLRQAVTVKEALSTKARHIRRSLSTPNVHNVSSSRPDLSGFDEDDKGWPENQLDMSDYSSSYQDVACYGTLPRDSPRRNKEGCTSETPHALTVSPFKAFSPQPPKFFKPLMPVKEEHKKRIALEARPLLSQEDSEEEENELEAINRKLISSQPYVPVEFADFSVYNASLENREWFSSKVDLSNSRVLEKEVSRSPTTSSITSGYFSHSASNATLSDMVVPSSDSSDQLAIQTKDADSTEHSTPSLVHDFRPSSNKELTEVEKGLVKDKIIVVPLKENSALAKGSPSSQSIPEKNSKSLCRTGSCSELDACPSKISQPARGFCPREVTVEHTTNILEDHSFTEFMGVSEGKDFDGLTDSSAGELSSRRSLPNKTGGKTVSDGLHHPSQLHSKLENDQVIIPEAAFWVLCCQ

SEQ ID NO: 840273 - protein, 1495 aa, Homo sapiens
MSDTKVKVAVRVRPMNRRELELNTKCVVEMEGNQTVLHPPPSNTKQGERKPPKVFAFDYCFWSMDESNTTKYAGQEVVFKCLGEGILEKAFQGYNACIFAYGQTGSGKSFSMMGHAEQLGLIPRLCCALFKRISLEQNESQTFKVEVSYMEIYNEKVRDLLDPKGSRQSLKVREHKVLGPYVDGLSQLAVTSFEDIESLMSEGNKSRTVAATNMNEESSRSHAVFNIIITQTLYDLQSGNSGEKVSKVSLVDLAGSERVSKTGAAGERLKEGSNINKSLTTLGLVISSLADQAAGKGKSKFVPYRDSVLTWLLKDNLGGNSQTSMIATISPAADNYEETLSTLRYADRAKRIVNHAVVNEDPNAKVIRELREEVEKLREQLSQAEAMKAPELKEKLEESEKLIKELTVTWEEKLRKTEEIAQERQRQLESMGISLEMSGIKVGDDKCYLVNLNADPALNELLVYYLKDHTRVGADTSQDIQLFGIGIQPQHCEIDIASDGDVTLTPKENARSCVNGTLVCSTTQLWHGDRILWGNNHFFRINLPKRKRRDWLKDFEKETGPPEHDLDAASEASSEPDYNYEFAQMEVIMKTLNSNDPVQNVVQVLEKQYLEEKRSALEEQRLMYERELEQLRQQLSPDRQPQSSGPDRLAYSSQTAQQKVTQWAEERDELFRQSLAKLREQLVKANTLVREANFLAEEMSKLTDYQVTLQIPAANLSANRKRGAIVSEPAIQVRRKGKSTQVWTIEKLENKLIDMRDLYQEWKEKVPEAKRLYGKRGDPFYEAQENHNLIGVANVFLECLFCDVKLQYAVPIISQQGEVAGRLHVEVMRVTGAVPERVVEDDSSENSSESGSLEVVDSSGEIIHRVKKLTCRVKIKEATGLPLNLSNFVFCQYTFWDQCESTVAAPVVDPEVPSPQSKDAQYTVTFSHCKDYVVNVTEEFLEFISDGALAIEVWGHRCAGNGSSIWEVDSLHAKTRTLHDRWNEVTRRIEMWISILELNELGEYAAVELHQAKDVNTGGIFQLRQGHSRRVQVTVKPVQHSGTLPLMVEAILSVSIGCVTARSTKLQRGLDSYQRDDEDGDDMDSYQEEDLNCVRERWSDALIKRREYLDEQIKKVSNKTEKTEDDVEREAQLVEQWVGLTEERNAVLVPAPGSGIPGAPADWIPPPGMETHIPVLFLDLNADDLSANEQLVGPHASGVNSILPKEHGSQFFYLPIIKHSDDEVSATASWDSSVHDSVHLNRVTPQNERIYLIVKTTVQLSHPAAMELVLRKRIAANIYNKQSFTQSLKRRISLKNIFYSCGVTYEIVSNIPKATEEIEDRETLALLAARSENEGTSDGETYIEKYTRGVLQVENILSLERLRQAVTVKEALSTKARHIRRSLSTPNVHNVSSSRPDLSGFDEDDKGWPENQLDMSDYSSSYQDVACYGTLPRDSPRRNKEGCTSETPHALTVSPFKAFSPQPPKFFKPLMPVKEEHKKRIALEARPLLSQEVNA

SEQ ID NO: 840274 - protein, 1709 aa, Homo sapiens
MSDTKVKVAVRVRPMNRRELELNTKCVVEMEGNQTVLHPPPSNTKQGERKPPKVFAFDYCFWSMDESNTTKYAGQEVVFKCLGEGILEKAFQGYNACIFAYGQTGSGKSFSMMGHAEQLGLIPRLCCALFKRISLEQNESQTFKVEVSYMEIYNEKVRDLLDPKGSRQSLKVREHKVLGPYVDGLSQLAVTSFEDIESLMSEGNKSRTVAATNMNEESSRSHAVFNIIITQTLYDLQSGNSGEKVSKVSLVDLAGSERVSKTGAAGERLKEGSNINKSLTTLGLVISSLADQAAGKGKSKFVPYRDSVLTWLLKDNLGGNSQTSMIATISPAADNYEETLSTLRYADRAKRIVNHAVVNEDPNAKVIRELREEVEKLREQLSQAEAMKAPELKEKLEESEKLIKELTVTWEEKLRKTEEIAQERQRQLESMGISLEMSGIKVGDDKCYLVNLNADPALNELLVYYLKDHTRVGADTSQDIQLFGIGIQPQHCEIDIASDGDVTLTPKENARSCVNGTLVCSTTQLWHGDRILWGNNHFFRINLPKRKRRDWLKDFEKETGPPEHDLDAASEASSEPDYNYEFAQMEVIMKTLNSNDPVQNVVQVLEKQYLEEKRSALEEQRLMYERELEQLRQQLSPDRQPQSSGPDRLAYSSQTAQQKVTQWAEERDELFRQSLAKLREQLVKANTLVREANFLAEEMSKLTDYQVTLQIPAANLSANRKRGAIVSEPAIQVRRKGKSTQVWTIEKLENKLIDMRDLYQEWKEKVPEAKRLYGKRGDPFYEAQENHNLIGVANVFLECLFCDVKLQYAVPIISQQGEVAGRLHVEVMRVTGAVPERVVEDDSSENSSESGSLEVVDSSGEIIHRVKKLTCRVKIKEATGLPLNLSNFVFCQYTFWDQCESTVAAPVVDPEVPSPQSKDAQYTVTFSHCKDYVVNVTEEFLEFISDGALAIEVWGHRCAGNGSSIWEVDSLHAKTRTLHDRWNEVTRRIEMWISILELNELGEYAAVELHQAKDVNTGGIFQLRQGHSRRVQVTVKPVQHSGTLPLMVEAILSVSIGCVTARSTKLQRGLDSYQRDDEDGDDMDSYQEEDLNCVRERWSDALIKRREYLDEQIKKVSNKTEKTEDDVEREAQLVEQWVGLTEERNAVLVPAPGSGIPGAPADWIPPPGMETHIPVLFLDLNADDLSANEQLVGPHASGVNSILPKEHGSQFFYLPIIKHSDDEVSATASWDSSVHDSVHLNRVTPQNERIYLIVKTTVQLSHPAAMELVLRKRIAANIYNKQSFTQSLKRRISLKNIFYSCGVTYEIVSNIPKATEEIEDRETLALLAARSENEGTSDGETYIEKYTRGVLQVENILSLERLRQAVTVKEALSTKARHIRRSLSTPNVHNVSSSRPDLSGFDEDDKGWPENQLDMSDYSSSYQDVACYGTLPRDSPRRNKEGCTSETPHALTVSPFKAFSPQPPKFFKPLMPVKEEHKKRIALEARPLLSQEDSEEEENELEAINRKLISSQPYVPVEFADFSVYNASLENREWFSSKVDLSNSRVLEKEVSRSPTTSSITSGYFSHSASNATLSDMVVPSSDSSDQLAIQTKDADSTEHSTPSLVHDFRPSSNKELTEVEKGLVKDKIIVVPLKENSALAKGSPSSQSIPEKNSKSLCRTGSCSELDACPSKISQPARGFCPREVTVEHTTNIQVIIPEAAFWVLCCQ

SEQ ID NO: 840275 - protein, 627 aa, Homo sapiens
MWLADDLSANEQLVGPHASGVNSILPKEHGSQFFYLPIIKHSDDEVSATASWDSSVHDSVHLNRVTPQNERIYLIVKTTVQLSHPAAMELVLRKRIAANIYNKQSFTQSLKRRISLKNIFYSCGVTYEIVSNIPKATEEIEDRETLALLAARSENEGTSDGETYIEKYTRGVLQVENILSLERLRQAVTVKEALSTKARHIRRSLSTPNVHNVSSSRPDLSGFDEDDKGWPENQLDMSDYSSSYQDVACYGTLPRDSPRRNKEGCTSETPHALTVSPFKAFSPQPPKFFKPLMPVKEEHKKRIALEARPLLSQESMPPPQAHNPGCIVPSGSNGSSMPVEHNSKREKKIDSEEEENELEAINRKLISSQPYVPVEFADFSVYNASLENREWFSSKVDLSNSRVLEKEVSRSPTTSSITSGYFSHSASNATLSDMVVPSSDSSDQLAIQTKDADSTEHSTPSLVHDFRPSSNKELTEVEKGLVKDKIIVVPLKENSALAKGSPSSQSIPEKNSKSLCRTGSCSELDACPSKISQPARGFCPREVTVEHTTNILEDHSFTEFMGVSEGKDFDGLTDSSAGELSSRRSLPNKTGGKTVSDGLHHPSQLHSKLENDQVIIPEAAFWVLCCQ

SEQ ID NO: 840276 - protein, 77 aa, Homo sapiens; identical to SEQ ID NO: 840271

SEQ ID NO: 840277 - protein, 121 aa, Homo sapiens [sequence omitted]

SEQ ID NO: 840278 - protein, 230 aa, Homo sapiens
MTRRCMPARPGFPSSPAPGSSPPRCHLRPGSTAHAAAGKRTESPGDRKQSIIDFFKPASKQDRHMLDSPQKSNIKYGGSRLSITGTEQFERKLSSPKESKPKRVPPEKSPIIEAFMKGVKEHHEDHGIHESRRPCLSLASKYLAKGTNIYVPSSYHLPKEMKSLKKKHRSPERRKSLFIHENNEKNDRDRGKTNADSKKQTTVAEADIFNNSSRSLSSRSSLSRHHPEES

SEQ ID NO: 840279 - protein, 492 aa, Homo sapiens
MALNSGSPPAIGPYYENHGYQPENPYPAQPTVVPTVYEVHPAQYYPSPVPQYAPRVLTQASNPVVCTQPKSPSGTVCTSKTKKALCITLTLGTFLVGAALAAGLLWKFMGSKCSNSGIECDSSGTCINPSNWCDGVSHCPGGEDENRCVRLYGPNFILQMYSSQRKSWHPVCQDDWNENYGRAACRDMGYKNNFYSSQGIVDDSGSTSFMKLNTSAGNVDIYKKLYHSDACSSKAVVSLRCIACGVNLNSSRQSRIVGGESALPGAWPWQVSLHVQNVHVCGGSIITPEWIVTAAHCVEKPLNNPWHWTAFAGILRQSFMFYGAGYQVEKVISHPNYDSKTKNNDIALMKLQKPLTFNDLVKPVCLPNPGMMLQPEQLCWISGWGATEEKGKTSEVLNAAKVLLIETQRCNSRYVYDNLITPAMICAGFLQGNVDSCQGDSGGPLVTSKNNIWWLIGDTSWGSGCAKAYRPGVYGNVMVFTDWIYRQMRADG

SEQ ID NO: 840280 - protein, 492 aa, Homo sapiens; identical to SEQ ID NO: 840279

SEQ ID NO: 840281 - protein, 430 aa, Homo sapiens
MTSKQLWSERCTLLLLPETKKALCITLTLGTFLVGAALAAGLLWKFMGSKCSNSGIECDSSGTCINPSNWCDGVSHCPGGEDENRCVRLYGPNFILQMYSSQRKSWHPVCQDDWNENYGRAACRDMGYKNNFYSSQGIVDDSGSTSFMKLNTSAGNVDIYKKLYHSDACSSKAVVSLRCIACGVNLNSSRQSRIVGGESALPGAWPWQVSLHVQNVHVCGGSIITPEWIVTAAHCVEKPLNNPWHWTAFAGILRQSFMFYGAGYQVEKVISHPNYDSKTKNNDIALMKLQKPLTFNDLVKPVCLPNPGMMLQPEQLCWISGWGATEEKGKTSEVLNAAKVLLIETQRCNSRYVYDNLITPAMICAGFLQGNVDSCQGDSGGPLVTSKNNIWWLIGDTSWGSGCAKAYRPGVYGNVMVFTDWIYRQMRADG

SEQ ID NO: 840282 - protein, 385 aa, Homo sapiens
MDTNRKTPIPHSPLWSPLSTRCIRLSTTRPPCPGGEDENRCVRLYGPNFILQMYSSQRKSWHPVCQDDWNENYGRAACRDMGYKNNFYSSQGIVDDSGSTSFMKLNTSAGNVDIYKKLYHSDACSSKAVVSLRCIACGVNLNSSRQSRIVGGESALPGAWPWQVSLHVQNVHVCGGSIITPEWIVTAAHCVEKPLNNPWHWTAFAGILRQSFMFYGAGYQVEKVISHPNYDSKTKNNDIALMKLQKPLTFNDLVKPVCLPNPGMMLQPEQLCWISGWGATEEKGKTSEVLNAAKVLLIETQRCNSRYVYDNLITPAMICAGFLQGNVDSCQGDSGGPLVTSKNNIWWLIGDTSWGSGCAKAYRPGVYGNVMVFTDWIYRQMRADG

SEQ ID NO: 840283 - protein, 492 aa, Homo sapiens; identical to SEQ ID NO: 840279

SEQ ID NO: 840284 - protein, 492 aa, Homo sapiens; identical to SEQ ID NO: 840279

SEQ ID NO: 840285 - protein, 71 aa, Homo sapiens
AKDLMESKMKGISTNICAHLHLVQAGCYSGAGNAEVNRVRQMSLLSGALPLFWMSVVGTGQVWSDRWETNN

SEQ ID NO: 840286 - protein, 71 aa, Homo sapiens; identical to SEQ ID NO: 840285

SEQ ID NO: 840287 - protein, 132 aa, Homo sapiens
VRAGEGNLGAWDPPMPPAPPGGESGCEERGAAGHIEHSRYLSLLDAVDNSKMALNSGSPPAIGPYYENHGYKLGFWLCQSLQTRSVRECDGIHGLDLSTNEGRRLIHMVFVLDVVLQENNGAGFASPCMIYS

SEQ ID NO: 840288 - protein, 81 aa, Homo sapiens
CPGGEDENRCGESALTLGRDSSAHLGDSSRVQGPLGDWAWRASSTLTHDVIESLLQAEPWGSERLCFRPNLTQQVGDDRAT

SEQ ID NO: 840289 - protein, 250 aa, Homo sapiens
RHVARSWPIRFESHFFPLTPPSGAVVRSDRSKMATVEPETTPTPNPPTTEEEKTESNQEVANPEHYIKHPLQNRWALWFFKNDKSKTWQANLRLISKFDTVEDFWALYNHIQLSSNLMPGCDYSLFKDGIEPMWEDEKNKRGGRWLITLNKQQRRSDLDRFWLETLLCLIGESFDDYSDDVCGAVVNVRAKGDKIAIWTTECENQRSCYTYREGIQGNRLGLPPKIVIGYQSHADTATKSGSTTKNRFVV

SEQ ID NO: 840290 - protein, 135 aa, Homo sapiens
RHVARSWPIRFESHFFPLTPPSGAVVRSDRSKMATVEPETTPTPNPPTTEEEKTESNQEVANPEHYIKHPLQNRWALWFFKNDKSKTWQANLRLISKFDTVEDFWALYNHIQLSSNLMPGCDYSLFKKGGKFGGA

SEQ ID NO: 840291 - protein, 250 aa, Homo sapiens; identical to SEQ ID NO: 840289

SEQ ID NO: 840292 - protein, 239 aa, Homo sapiens
GHARVPEEGDGERAHGGDRSKMATVEPETTPTPNPPTTEEEKTESNQEVANPEHYIKHPLQNRWALWFFKNDKSKTWQANLRLISKFDTVEDFWALYNHIQLSSNLMPGCDYSLFKDGIEPMWEDEKNKRGGRWLITLNKQQRRSDLDRFWLETLLCLIGESFDDYSDDVCGAVVNVRAKGDKIAIWTTECENQRSCYTYREGIQGNRLGLPPKIVIGYQSHADTATKSGSTTKNRFVV

SEQ ID NO: 840293 - protein, 246 aa, Homo sapiens
MKKKQNKKERKKMRAEDGENDAIKKQAESLRESQETTPTPNPPTTEEEKTESNQEVANPEHYIKHPLQNRWALWFFKNDKSKTWQANLRLISKFDTVEDFWALYNHIQLSSNLMPGCDYSLFKDGIEPMWEDEKNKRGGRWLITLNKQQRRSDLDRFWLETLLCLIGESFDDYSDDVCGAVVNVRAKGDKIAIWTTECENQRSCYTYREGIQGNRLGLPPKIVIGYQSHADTATKSGSTTKNRFVV

SEQ ID NO: 840294 - protein, 224 aa, Homo sapiens
EQIASRMAMVEAETTPTPNPPTTEEEKTESNQEVANPEHYIKHPLQNRWALWFFKNDKSKTWQANLRLISKFDTVEDFWALYNHIQLSSNLMPGCDYSLFKDGIEPMWEDEKNKRGGRWLITLNKQQRRSDLDRFWLETLLCLIGESFDDYSDDVCGAVVNVRAKGDKIAIWTTECENQRSCYTYREGIQGNRLGLPPKIVIGYQSHADTATKSGSTTKNRFVV

SEQ ID NO: 840295 - protein, 232 aa, Homo sapiens
RHVARSWPIRFESHFFPLTPPSGAVVRSDRSKMATVEPETTPTPNPPTTEEEKTESNQEVANPEHYIKHPLQNRWALWFFKNDKSKTWQANLRLISKFDTVEDFWALYNHIQLSSNLMPGCDYSLFKDGIEPMWEDESDLDRFWLETLLCLIGESFDDYSDDVCGAVVNVRAKGDKIAIWTTECENQRSCYTYREGIQGNRLGLPPKIVIGYQSHADTATKSGSTTKNRFVV

SEQ ID NO: 840296 - protein, 220 aa, Homo sapiens
GHARVPEEGDGERAHGGDRSKMATVEPETTPTPNPPTTEEEKTESNQEVANPEHYIKHPLQNRWALWFFKNDKSKTWQANLRLISKFDTVEDFWALYNHIQLSSNLMPGCDYSLFKDGIEPMWEDEKNKRGGRWLITLNKQQRRSDLDRFWLETLLCLIGESFDDYSDDVCGAVVNVRAKGDKIAIWTTECVPPKIVIGYQSHADTATKSGSTTKNRFVV

SEQ ID NO: 840297 - protein, 250 aa, Homo sapiens; identical to SEQ ID NO: 840289

SEQ ID NO: 840298 - protein, 250 aa, Homo sapiens; identical to SEQ ID NO: 840289

SEQ ID NO: 840299 - protein, 250 aa, Homo sapiens; identical to SEQ ID NO: 840289

SEQ ID NO: 840300 - protein, 250 aa, Homo sapiens; identical to SEQ ID NO: 840289

SEQ ID NO: 840301 - protein, 133 aa, Homo sapiens
MPGCDYSLFKDGIEPMWEDEKNKRGGRWLITLNKQQRRSDLDRFWLETLLCLIGESFDDYSDDVCGAVVNVRAKGDKIAIWTTECENQRSCYTYREGIQGNRLGLPPKIVIGYQSHADTATKSGSTTKNRFVV

SEQ ID NO: 840302 - protein, 214 aa, Homo sapiens
VTWPEAGQSGLNLIFFLLPPLLERLCDQIDLRWRLSNRWALWFFKNDKSKTWQANLRLISKFDTVEDFWALYNHIQLSSNLMPGCDYSLFKDGIEPMWEDEKNKRGGRWLITLNKQQRRSDLDRFWLETLLCLIGESFDDYSDDVCGAVVNVRAKGDKIAIWTTECENQRSCYTYREGIQGNRLGLPPKIVIGYQSHADTATKSGSTTKNRFVV

SEQ ID NO: 840303 - protein, 133 aa, Homo sapiens; identical to SEQ ID NO: 840301

SEQ ID NO: 840304 - protein, 281 aa, Homo sapiens
RHVARSWPIRFESHFFPLTPPSGAVVRSDRSKMATVEPETTPTPNPPTTEEEKTESNQEVANPEHYIKHPLQNRWALWFFKNDKSKTWQANLRLISKFDTVEDFWALYNHIQLSSNLMPGCDYSLFKDGIEPMWEDEKNKRGGRWLITLNKQQRRSDLDRFWLETRWDLAMLPRLVSNFWPQVILPLQPPKVLELQLLCLIGESFDDYSDDVCGAVVNVRAKGDKIAIWTTECENQRSCYTYREGIQGNRLGLPPKIVIGYQSHADTATKSGSTTKNRFVV

SEQ ID NO: 840305 - protein, 177 aa, Homo sapiens
EQIASRMAMVEAETTPTPNPPTTEEEKTESNQEVANPEHYIKHPLQNRWALWFFKNDKSKTWQANLRLISKFDTVEDFWALYNHIQLSSNLMPGCDYSLFKDGIEPMWEDEKNKRGGRWLITLNKQQRRSDLDRFWLETEGIQGNRLGLPPKIVIGYQSHADTATKSGSTTKNRFVV

SEQ ID NO: 840306 - protein, 240 aa, Homo sapiens
RRAPARGRRQRAAQPSRASRGRPPPCRPPRRASWGARARDPRTQLRRTGGRARALEATGMMLRVLVGAVLPAMLLAAPPPINKLALFPDKSAWCEAKNITQIVGHSGCEAKSIQNRACLGQCFSYSVPNTFPQSTESLVHCDSCMPAQSMWEIVTLECPGHEEVPRVDKLVEKILHCSCQACGKEPSHEGLSVYVQGEDGPGSQPGTHPHPHPHPHPGGQTPEPEDPPGAPHTEEEGAED

SEQ ID NO: 840307 - protein, 216 aa, Homo sapiens
MPGNLMSQTSRAVSIWKFPAKLGKTHGHRALEATGMMLRVLVGAVLPAMLLAAPPPINKLALFPDKSAWCEAKNITQIVGHSGCEAKSIQNRACLGQCFSYSVPNTFPQSTESLVHCDSCMPAQSMWEIVTLECPGHEEVPRVDKLVEKILHCSCQACGKEPSHEGLSVYVQGEDGPGSQPGTHPHPHPHPHPGGQTPEPEDPPGAPHTEEEGAED

SEQ ID NO: 840308 - protein, 240 aa, Homo sapiens; identical to SEQ ID NO: 840306

SEQ ID NO: 840309 - protein, 240 aa, Homo sapiens; identical to SEQ ID NO: 840306

SEQ ID NO: 840310 - protein, 240 aa, Homo sapiens; identical to SEQ ID NO: 840306

SEQ ID NO: 840311 - protein, 161 aa, Homo sapiens
RRAPARGRRQRAAQPSRASRGRPPPCRPPRRASWGARARDPRTQLRRTGGRARALEATGMMLRVLVGAVLPAMLLAAPPPINKLALFPDKSAWCEAKNITQIVGHSGCEAKSIQNRACLGQCFSYSVPNTFPQSTESLVHCDSCMPAQSMWEIPWGCRWYC

SEQ ID NO: 840312 - protein, 240 aa, Homo sapiens; identical to SEQ ID NO: 840306

SEQ ID NO: 840313 - protein, 240 aa, Homo sapiens; identical to SEQ ID NO: 840306

SEQ ID NO: 840314 - protein, 240 aa, Homo sapiens; identical to SEQ ID NO: 840306

SEQ ID NO: 840315 - protein, 206 aa, Homo sapiens
RRAPARGRRQRAAQPSRASRGRPPPCRPPRRASWGARARDPRTQLRRTGGRARALEATGMMLRVLVGAVLPAMLLAAPPPINKLALFPDKSAWCEAKNITQIVGHSGCEAKSIQNRACLGQCFSYSVPNTFPQSTESLVHCDSCMPAQSMWEIVTLECPGHEEVPRVDKLVEKIWLPAHCLLPGVAWPSWLLRRGLLELVTIGQSP

SEQ ID NO: 840316 - protein, 240 aa, Homo sapiens; identical to SEQ ID NO: 840306

SEQ ID NO: 840317 - protein, 240 aa, Homo sapiens; identical to SEQ ID NO: 840306

SEQ ID NO: 840318 - protein, 240 aa, Homo sapiens; identical to SEQ ID NO: 840306

SEQ ID NO: 840319 - protein, 240 aa, Homo sapiens; identical to SEQ ID NO: 840306

SEQ ID NO: 840320 - protein, 240 aa, Homo sapiens; identical to SEQ ID NO: 840306

SEQ ID NO: 840321 - protein, 240 aa, Homo sapiens; identical to SEQ ID NO: 840306

SEQ ID NO: 840322 - protein, 240 aa, Homo sapiens; identical to SEQ ID NO: 840306

SEQ ID NO: 840323 - protein, 282 aa, Homo sapiens
RRAPARGRRQRAAQPSRASRGRPPPCRPPRRASWGARARDPRTQLRRTGGRARALEATGMMLRVLVGAVLPAMLLAAPPPINKLALFPDKSAWCEAKNITQIVGHSGCEAKSIQNRACLGQCFSYSVPNTFPQSTESLVHCDSCMPAQSMWEIVTLECPGHEEVPRVDKLVEKILHCSCQACGKEPSHEGLSVYVQGEDGPGSQPGTHPQHGIGGYRTDWSATAVPVRLVTVDGGGGLGGGDTSMSACRVCQSTGPARCLTACDDVYVAGKAEPEEPGVVRV

SEQ ID NO: 840324 - protein, 61 aa, Homo sapiens
MKRTQDKDTLPDSQLLPLLEIRFLELIRQFGEGFTWRLSNAPILPTQCATRSRRALYLSDP

SEQ ID NO: 840325 - protein, 59 aa, Homo sapiens
MKRTQDKTRYLTLSYCRSSKFVSWGLYASSGKVSPGDYPMLPYYPHNAPPDAAPCIYQT

SEQ ID NO: 840326 - protein, 56 aa, Homo sapiens
TRVRGFILEVSETKNPSEGTDQGHSFFWRLSGKNPFPCLSQLSEAAYLLWPVASFS

SEQ ID NO: 840327 - protein, 108 aa, Homo sapiens
RGEKKGEGRRRKMEEEEGEGERGGRGEGRGKRRGRGRGRGGREGEASRKKRRSEKRKKHGRKRRNEGTHQAAFPAGPMPCLRGRREPSSASPNGRVQGCFCLIMMGLV

SEQ ID NO: 840328 - protein, 288 aa, Homo sapiens
MSDSGEQNYGERESRSASRSGSAHGSGKSARHTPARSRSKEDSRRSRSKSRSRSESRSRSRRSSRRHYTRSRSRSRSHRRSRSRSYSRDYRRRHSHSHSPMSTRRRHVGNRANPDPNCCLGVFGLSLYTTERDLREVFSKYGPIADVSIVYDQQSRRSRGFAFVYFENVDDAKEAKERANGMELDGRRIRVDFSITKRPHTPTPGIYMGRPTYGSSRRRDYYDRGYDRGYDDRDYYSRSYRGGGGGGGGWRAAQDRDQIYRRRSPSPYYSRGGYRSRSRSRSYSPRRY

SEQ ID NO: 840329 - protein, 288 aa, Homo sapiens; identical to SEQ ID NO: 840328

SEQ ID NO: 840330 - protein, 188 aa, Homo sapiens
MSTRRRHVGNRANPDPNCCLGVFGLSLYTTERDLREVFSKYGPIADVSIVYDQQSRRSRGFAFVYFENVDDAKEAKERANGMELDGRRIRVDFSITKRPHTPTPGIYMGRPTYGSSRRRDYYDRGYDRGYDDRDYYSRSYRGGGGGGGGWRAAQDRDQIYRRRSPSPYYSRGGYRSRSRSRSYSPRRY

SEQ ID NO: 840331 - protein, 268 aa, Homo sapiens
MSDSGEQNYGERESRSASRSGSAHGSGKSARHTPARSRSKEDSRRSRSKSRSRSESRSRSRRSSRRHYTRSRSRSRSHRRSRSRSYSRDYRRRHSHSHSPMSTRRRHVGNRANPDPNCCLGVFGLSLYTTERDLREVFSKYGPIADVSIVYDQQSRRSRGFAFVYFENVDDAKEAKERANGMELDGRRIRVDFSITKRPHTPTPGIYMGRPTYGSSRRRDYYDRGYDRGYDDRDYYSRSYRRRSPSPYYSRGGYRSRSRSRSYSPRRY

SEQ ID NO: 840332 - protein, 188 aa, Homo sapiens; identical to SEQ ID NO: 840330

SEQ ID NO: 840333 - protein, 188 aa, Homo sapiens; identical to SEQ ID NO: 840330

SEQ ID NO: 840334 - protein, 220 aa, Homo sapiens
MSDSGEQNYGERESRSASRSGSAHGSGKSARHTPARSRSKEDSRRSRSKSRSRSESRSRSRRSSRRHYTRSRSRSRSHRRSRSRSYSRDYRRRHSHSHSPMSTRRRHVGNRANPDPNCCLGVFGLSLYTTERDLREVFSKYGPIADVSIVYDQQSRRSRGFAFVYFENVDDAKEAKERANGMELDGRRIRVDFSITKRPHTPTPGIYMGRPTYGSSRRRD

SEQ ID NO: 840335 - protein, 188 aa, Homo sapiens; identical to SEQ ID NO: 840330

SEQ ID NO: 840336 - protein, 107 aa, Homo sapiens
MELDGRRIRVDFSITKRPHTPTPGIYMGRPTYGSSRRRDYYDRGYDRGYDDRDYYSRSYRGGGGGGGGWRAAQDRDQIYRRRSPSPYYSRGGYRSRSRSRSYSPRRY

SEQ ID NO: 840337 - protein, 304 aa, Homo sapiens
MSDSGEQNYGERESRSASRSGSAHGSGKSARHTPARSRSKEDSRRSRSKSRSRSESRSRSRRSSRRHYTRSRSRSRSHRRSRSRSYSRDYRRRHSHSHSPMSTRRRHVGNRANPDPNCCLGVFGLSLYTTERDLREVFSKYGPIADVSIVYDQQSRRSRGFAFVYFENVDDAKEAKERANGMELDGRRIRVDFSITKRPHTPTPGIYMGRPTYGSSRRRDYYDRGYDRGYDDRDYYSRSYRGGGGGGGGWRAAQDRDQIYRNQEFNKKGGQPSSLTNRVGGGTTQNLRYPESFGINIFKLGPGI

SEQ ID NO: 840338 - protein, 264 aa, Homo sapiens
MSDSGEQNYGERESRSASRSGSAHGSGKSARHTPARSRSKEDSRRSRSKSRSRSESRSRSRRSSRRHYTRSRSRSRSHRRSRSRSYSRDYRRRHSHSHSPMSTRRRHVGNRANPDPNCCLGVFGLSLYTTERDLREVFSKYGPIADVSIVYDQQSRRSRGFAFVYFENVDDAKEAKERANGMELDGRRIRVDFSITKRPHTPTPGIYMGRPTYGSSRRRDYYDRGYDRGYDDRDYYSRSYRGGRLRRTERSDWHAAAQDRASDP

SEQ ID NO: 840339 - protein, 164 aa, Homo sapiens
MSDSGEQNYGERESRSASRSGSAHGSGKSARHTPARSRSKEDSRRSRSKSRSRSESRSRSRRSSRRHYTRSRSRSRSHRRSRSRSYSRDYRRRHSHSHSPMSTRRRHVGNRANPDPNCCLGVFGLSLYTTERDLREVFSKYGPIADVSIVYDQQSRRSRGFAKK

SEQ ID NO: 840340 - protein, 38 aa, Homo sapiens
MSDSGEQNYGERVNVEEGKCGSRHLTSFINEYLKLRNK

SEQ ID NO: 840341 - protein, 38 aa, Homo sapiens; identical to SEQ ID NO: 840340

SEQ ID NO: 840342 - protein, 288 aa, Homo sapiens; identical to SEQ ID NO: 840328

SEQ ID NO: 840343 - protein, 288 aa, Homo sapiens; identical to SEQ ID NO: 840328

SEQ ID NO: 840344 - protein, 288 aa, Homo sapiens; identical to SEQ ID NO: 840328

SEQ ID NO: 840345 - protein, 188 aa, Homo sapiens; identical to SEQ ID NO: 840330

SEQ ID NO: 840346 - protein, 188 aa, Homo sapiens; identical to SEQ ID NO: 840330

SEQ ID NO: 840347 - protein, 288 aa, Homo sapiens; identical to SEQ ID NO: 840328

SEQ ID NO: 840348 - protein, 238 aa, Homo sapiens
LTYALTGSRSRRSSRRHYTRSRSRSRSHRRSRSRSYSRDYRRRHSHSHSPMSTRRRHVGNRANPDPNCCLGVFGLSLYTTERDLREVFSKYGPIADVSIVYDQQSRRSRGFAFVYFENVDDAKEAKERANGMELDGRRIRVDFSITKRPHTPTPGIYMGRPTYGSSRRRDYYDRGYDRGYDDRDYYSRSYRGGGGGGGGWRAAQDRDQIYRRRSPSPYYSRGGYRSRSRSRSYSPRRY

SEQ ID NO: 840349 - protein, 134 aa, Homo sapiens
EDLSPDLGTSKFVSAQPPEQAKERANGMELDGRRIRVDFSITKRPHTPTPGIYMGRPTYGSSRRRDYYDRGYDRGYDDRDYYSRSYRGGGGGGGGWRAAQDRDQIYRRRSPSPYYSRGGYRSRSRSRSYSPRRY

SEQ ID NO: 840350 - protein, 247 aa, Homo sapiens
MSDSGEQNYGERESRSASRSGSAHGSGKSARHTPARSRSKEDSRRSRSKSRSRSESRSRSRRSSRRHYTRSRSRSRSHRRSRSRSYSRDYRRRHSHSHSPMSTRRRHVGNRANPDPNCCLGVFGLSLYTTERDLREVFSKYGPIADVSIVYDQQSRRSRGFAFVYFENVDDAKEAKERANGMELDGRRIRVDFSITKRPHTPTPGIYMGRPTYGSSRRRDYYDRGYDRGYDDRDYYSRSYRGGGGGR

SEQ ID NO: 840351 - protein, 113 aa, Homo sapiens
MSDSGEQNYGERESRSASRSGSAHGSGKSARHTPARSRSKEDSRRSRSKSRSRSESRSRSRRSSRRHYTRSRSRSRSHRRSRSRSYSRDYRRRHSHSHSPMSTRRRHVGNRVR

SEQ ID NO: 840352 - protein, 101 aa, Homo sapiens
FCSVVQAGVQWRDLGSLQPPPPGFKRLSRLSLPSSWDYRCPPPRPTTFFVFLVEAGFHHVDQAGLELLTSGNPPASASQSAEITGVSHRARPSSVYSLPTQ

SEQ ID NO: 840353 - protein, 154 aa, Homo sapiens
MSAAEAWGLRSRTIPPPRQSERAPVVTFIYLSVHPKLSLVSLTLRRDSNLKRCSKLLGPSPKHPFDWDPRPCMGPRAEGGVYVCECRGRLGLRPLLLPPLASGVGVGCCGCVCGCGSVPGVLSPGCVQPPLHPPYLRVTNPGCDSPPAGTVQPF

SEQ ID NO: 840354 - protein, 295 aa, Homo sapiens
MEKMSRPLPLNPTFIPPPYGVLRSLLENPLKLPLHHEDAFSKDKDKEKKLDDESNSPTVPQSAFLGPTLWDKTLPYDGDTFQLEYMDLEEFLSENGIPPSPSQHDHSPHPPGLQPASSAAPSVMDLSSRASAPLHPGIPSPNCMQSPIRPGQLLPANRNTPSPIDPDTIQVPVGYEPDPADLALSSIPGQEMFDPRKRKFSEEELKPQPMIKKARKVFIPDDLKDDKYWARRRKNNMAAKRSRDARRLKENQIAIRASFLEKENSALRQEVADLRKELGKCKNILAKYEARHGPL

SEQ ID NO: 840355 - protein, 295 aa, Homo sapiens; identical to SEQ ID NO: 840354

SEQ ID NO: 840356 - protein, 106 aa, Homo sapiens
STGLGRNQGTYNHGGKGNKHVLLHVVARRRMRAERRGKPLIKPSDLMRTYYHANSVEEIPDYLPLGPSHNMWRLWVLQFNMRFGWGHSQTTSTGILYCKFLLNFKS

SEQ ID NO: 840357 - protein, 312 aa, Homo sapiens
SELRARLQGFAGTRAGDRARGSCRGGKGARAPCFRRSGALPGSPALALLAAPAAGRAACKMSVRRGRRPARPGTRLSWLLCCSALLSPAAGYVIVSSVSWAVTNEVDEELDSASTEEAMPALLEDSGSIWQQSFPASAHKEDAHLRPRAGAARARPPPAPPGMFSYRREGGQTASAPPGPRLRAATARSLAHASVWGCWPPCPPTRRSKDCHLGTACPSVMAPSTIALGFLSSTMTAKDPVVADLMKNPMASLMLPESEGEFCRTNIVDPEDPRCVQLTAHWADDSQCLQTEVEFGKQPSFQGTRVRNGLSY

SEQ ID NO: 840358 - protein, 214 aa, Homo sapiens
SELRARLQGFAGTRAGDRARGSCRGGKGARAPCFRRSGALPGSPALALLAAPAAGRAACKMSVRRGRRPARPGTRLSWLLCCSALLSPAAGYVIVSSVSWAVTNEVDEELDSASTEEAMPALLEDSGSIWQQSFPASAHKEDAHLRPRAGAARARPPPAPPGMFSYRREGGQTASAPPGPRLRAATARSLAHASVWGCLATVSTHKKSLVFALK

SEQ ID NO: 840359 - protein, 264 aa, Homo sapiens
SELRARLQGFAGTRAGDRARGSCRGGKGARAPCFRRSGALPGSPALALLAAPAAGRAACKMSVRRGRRPARPGTRLSWLLCCSALLSPAAGYVIVSSVSWAVTNEVDEELDSASTEEAMPALLEDSGSIWQQSFPASAHKEDAHLRPRAGAARARPPPAPPGMFSYRREGGQTASAPPGPRLRAATARSLAHASVWGCWPPCPPTRRSKDCHLGTACPSVMAPSTIALGFLSSTMTAKDPVVADLMKNPMASLMLPESEGEFCR

SEQ ID NO: 840360 - protein, 243 aa, Homo sapiens
SELRARLQGFAGTRAGDRARGSCRGGKGARAPCFRRSGALPGSPALALLAAPAAGRAACKMSVRRGRRPARPGTRLSWLLCCSALLSPAAGYVIVSSVSWAVTNEVDEELDSASTEEAMPALLEDSGSIWQQSFPASAHKEDAHLRPRAGAARARPPPAPPGMFSYRREGGQTASAPPGPRLRAATARSLAHASVWGCLATVSTHKKIQGLPFGNCLPVSDGPFNNSTGIPFFYNDSQGPRGG

SEQ ID NO: 840361 - protein, 243 aa, Homo sapiens; identical to SEQ ID NO: 840360

SEQ ID NO: 840362 - protein, 30 aa, Homo sapiens
RTFPATLVLPTEIGVHGAHLFPQETLGHHL

SEQ ID NO: 840363 - protein, 504 aa, Homo sapiens
MCSRVPLLLPLLLLLALGPGVQGCPSGCQCSQPQTVFCTARQGTTVPRDVPPDTVGLYVFENGITMLDAGSFAGLPGLQLLDLSQNQIASLPSGVFQPLANLSNLDLTANRLHEITNETFRGLRRLERLYLGKNRIRHIQPGAFDTLDRLLELKLQDNELRALPPLRLPRLLLLDLSHNSLLALEPGILDTANVEALRLAGLGLQQLDEGLFSRLRNLHDLDVSDNQLERVPPVIRGLRGLTRLRLAGNTRIAQLRPEDLAGLAALQELDVSNLSLQALPGDLSGLFPRLRLLAAARNPFNCVCPLSWFGPWVRESHVTLASPEETRCHFPPKNAGRLLLELDYADFGCPATTTTATVPTTRPVVREPTALSSSLAPTWLSPTEPATEAPSPPSTAPPTVGPVPQPQDCPPSTCLNGGTCHLGTRHHLACLCPEGFTGLYCESQMGQGTRPSPTPVTPRPPRSLTLGIEPVSPTSLRVGLQRYLQGSSVQLRSLQSPLHAKPYI

SEQ ID NO: 840364 - protein, 436 aa, Homo sapiens
MCSRVPLLLPLLLLLALGPGVQGCPSGCQCSQPQTVFCTARQGTTVPRDVPPDTVGLYVFENGITMLDAGSFAGLPGLQLLDLSQNQIASLPSGVFQPLANLSNLDLTANRLHEITNETFRGLRRLERLYLGKNRIRHIQPGAFDTLDRLLELKLQDNELRALPPLRLPRLLLLDLSHNSLLALEPGILDTANVEALRLAGLGLQQLDEGLFSRLRNLHDLDVSDNQLERVPPVIRGLRGLTRLRLAGNTRIAQLRPEDLAGLAALQELDVSNLSLQALPGDLSGLFPRLRLLAAARNPFNCVCPLSWFGPWVRESHVTLASPEETRCHFPPKNAGRLLLELDYADFGCPATTTTATVPTTRPVVREPTALSSSLAPTWLSPTEPAMKEAPGKSRGRAGRRLCDSSLGPRKRRNKRNWKGRCFRNMFCFFKIYIYL

SEQ ID NO: 840365 - protein, 673 aa, Homo sapiens
MCSRVPLLLPLLLLLALGPGVQGCPSGCQCSQPQTVFCTARQGTTVPRDVPPDTVGLYVFENGITMLDAGSFAGLPGLQLLDLSQNQIASLPSGVFQPLANLSNLDLTANRLHEITNETFRGLRRLERLYLGKNRIRHIQPGAFDTLDRLLELKLQDNELRALPPLRLPRLLLLDLSHNSLLALEPGILDTANVEALRLAGLGLQQLDEGLFSRLRNLHDLDVSDNQLERVPPVIRGLRGLTRLRLAGNTRIAQLRPEDLAGLAALQELDVSNLSLQALPGDLSGLFPRLRLLAAARNPFNCVCPLSWFGPWVRESHVTLASPEETRCHFPPKNAGRLLLELDYADFGCPATTTTATVPTTRPVVREPTALSSSLAPTWLSPTEPATEAPSPPSTAPPTVGPVPQPQDCPPSTCLNGGTCHLGTRHHLACLCPEGFTGLYCESQMGQGTRPSPTPVTPRPPRSLTLGIEPVSPTSLRVGLQRYLQGSSVQLRSLRLTYRNLSGPDKRLVTLRLPASLAEYTVTQLRPNATYSVCVMPLGPGRVPEGEEACGEAHTPPAVHSNHAPVTQAREGNLPLLIAPALAAVLLAALAAVGAAYCVRRGRAMAAAAQDKGQVGPGAGPLELEGVKVPLEPGPKATEGGGEALPSGSECEVPLMGFPGPGLQSPLHAKPYI

SEQ ID NO: 840366 - protein, 673 aa, Homo sapiens; identical to SEQ ID NO: 840365

SEQ ID NO: 840367 - protein, 104 aa, Homo sapiens
SKNHCAEGYCTSKMQAIVITLRTDPDFQALGCLLLGHSFKLIRPLHFCLWGLSCKGTWIRLASVLNLVVIILCNYYHSLGMPPFCRCGYGGLEKLKNTCKTSHS

SEQ ID NO: 840368 - protein, 771 aa, Homo sapiens
MKTDSIQNRTARALGNLAMEPESCGDIHCAGAVPLLVESLTACQDSQCLQSVVRALRNLADSPQHRLALAQQGAVRPLAELLATAPDAALTLALVRALLELSRGCSRACAEQLSLGGGLGPLVSLASHPKRAVREGTILILANLCAQGLIRPALGNAGGVEVLVDELRQRRDPNGASPTSQQPLVRAVCLLCREAINRARLRDAGGLDLLMGLLRDPRASAWHPRIVAALVGFLYDTGALGRLQALGLVPLLAGQLCGEAGEEEEEGREAASWDFPEERTPERAQGGSFRSLRSWLISEGYATGPDDISPDWSPEQCPPEPMEPASPAPTPTSLRAPRTQRTPGRSPAAAIEEPWGREGPALLLLSRFSQAPDPSGALVTGPALYGLLTYVTGAPGPPSPRALRILSRLTCNPACLEAFVRSYGAALLRAWLVLGVAPDDWPAPRARPTLHSRHRELGERLLQNLTVQAESPFGVGALTHLLLSGSPEDRVACALTLPFICRKPSLWRRLLLEQGGLRLLLAALTRPAPHPLFLFFAADSLSCLQDLVSPTVSPAVPQAVPMDLDSPSPCLYEPLLGPAPVPAPDLHFLLDSGLQLPAQRAASATASPFFRALLSGSFAEAQMDLVPLRGLSPGAAWPVLHHLHGCRGCGAALGPVPPPGQPLLGSEAEEALEAAGRFLLPGLEEELEEAVGRIHLGPQGGPESVGEVFRLGRPRLAAHCARWTLGSEQCPRKRGLALVGLVEAAGEEAGPLTEALLAVVMGIELGARVPA

SEQ ID NO: 840369 - protein, 967 aa, Homo sapiens
MAAAKPTLTDSLSFCLAQLAAAAGEALGGEKDPATNETPLSRALLALRTRHIKAAGGIERFRARGGLRPLLALLRRAAAAGSAPSQAGPGSAPSSAASGASSPAPASGPAPSAVSSSSPTPPVRLRKTLDLALSILADCCTEGACRTEVRRLGGILPLVTILQCMKTDSIQNRTARALGNLAMEPESCGDIHCAGAVPLLVESLTACQDSQCLQSVVRALRNLADSPQHRLALAQQGAVRPLAELLATAPDAALTLALVRALLELSRGCSRACAEQLSLGGGLGPLVSLASHPKRAVREGTILILANLCAQGLIRPALGNAGGVEVLVDELRQRRDPNGASPTSQQPLVRAVCLLCREAINRARLRDAGGLDLLMGLLRDPRASAWHPRIVAALVGFLYDTGALGRLQALGLVPLLAGQLCGEAGEEEEEGREAASWDFPEERTPERAQGGSFRSLRSWLISEGYATGPDDISPDWSPEQCPPEPMEPASPAPTPTSLRAPRTQRTPGRSPAAAIEEPWGREGPALLLLSRFSQAPDPSGALVTGPALYGLLTYVTGAPGPPSPRALRILSRLTCNPACLEAFVRSYGAALLRAWLVLGVAPDDWPAPRARPTLHSRHRELGERLLQNLTVQAESPFGVGALTHLLLSGSPEDRVACALTLPFICRGVGSGCLAGLGEECCVSQARCPPFERPSLPCRKPSLWRRLLLEQGGLRLLLAALTRPAPHPLFLFFAADSLSCLQDLVSPTVSPAVPQAVPMDLDSPSPCLYEPLLGPAPVPAPDLHFLLDSGLQLPAQRAASATASPFFRALLSGSFAEAQMDLVPLRGLSPGAAWPVLHHLHGCRGCGAALGPVPPPGQPLLGSEAEEALEAAGRFLLPGLEEELEEAVGRIHLGPQGGPESVGEVFRLGRPRLAAHCARWTLGSEQCPRKRGLALVGLVEAAGEEAGPLTEALLAVVMGIELGARVPA

SEQ ID NO: 840370 - protein, 941 aa, Homo sapiens
MAAAKPTLTDSLSFCLAQLAAAAGEALGGEKDPATNETPLSRALLALRTRHIKAAGGIERFRARGGLRPLLALLRRAAAAGSAPSQAGPGSAPSSAASGASSPAPASGPAPSAVSSSSPTPPVRLRKTLDLALSILADCCTEGACRTEVRRLGGILPLVTILQCMKTDSIQNRTARALGNLAMEPESCGDIHCAGAVPLLVESLTACQDSQCLQSVVRALRNLADSPQHRLALAQQGAVRPLAELLATAPDAALTLALVRALLELSRGCSRACAEQLSLGGGLGPLVSLASHPKRAVREGTILILANLCAQGLIRPALGNAGGVEVLVDELRQRRDPNGASPTSQQPLVRAVCLLCREAINRARLRDAGGLDLLMGLLRDPRASAWHPRIVAALVGFLYDTGALGRLQALGLVPLLAGQLCGEAGEEEEEGREAASWDFPEERTPERAQGGSFRSLRSWLISEGYATGPDDISPDWSPEQCPPEPMEPASPAPTPTSLRAPRTQRTPGRSPAAAIEEPWGREGPALLLLSRFSQAPDPSGALVTGPALYGLLTYVTGAPGPPSPRALRILSRLTCNPACLEAFVRSYGAALLRAWLVLGVAPDDWPAPRARPTLHSRHRELGERLLQNLTVQAESPFGVGALTHLLLSGSPEDRVACALTLPFICRPSLPCRKPSLWRRLLLEQGGLRLLLAALTRPAPHPLFLFFAADSLSCLQDLVSPTVSPAVPQAVPMDLDSPSPCLYEPLLGPAPVPAPDLHFLLDSGLQLPAQRAASATASPFFRALLSGSFAEAQMDLVPLRGLSPGAAWPVLHHLHGCRGCGAALGPVPPPGQPLLGSEAEEALEAAGRFLLPGLEEELEEAVGRIHLGPQGGPESVGEVFRLGRPRLAAHCARWTLGSEQCPRKRGLALVGLVEAAGEEAGPLTEALLAVVMGIELGARVPA

SEQ ID NO: 840371 - protein, 1289 aa, Homo sapiens
MAAAKPTLTDSLSFCLAQLAAAAGEALGGEKDPATNETPLSRALLALRTRHIKAAGGIERFRARGGLRPLLALLRRAAAAGSAPSQAGPGSAPSSAASGASSPAPASGPAPSAVSSSSPTPPVRLRKTLDLALSILADCCTEGACRTEVRRLGGILPLVTILQCMKTDSIQNRTARALGNLAMEPESCGDIHCAGAVPLLVESLTACQDSQCLQSVVRALRNLADSPQHRLALAQQGAVRPLAELLATAPDAALTLALVRALLELSRGCSRACAEQLSLGGGLGPLVSLASHPKRAVREGTILILANLCAQGLIRPALGNAGGVEVLVDELRQRRDPNGASPTSQQPLVRAVCLLCREAINRARLRDAGGLDLLMGLLRDPRASAWHPRIVAALVGFLYDTGALGRLQALGLVPLLAGQLCGEAGEEEEEGREAASWDFPEERTPERAQGGSFRSLRSWLISEGYATGPDDISPDWSPEQCPPEPMEPASPAPTPTSLRAPRTQRTPGRSPAAAIEEPWGREGPALLLLSRFSQAPDPSGALVTGPALYGLLTYVTGAPGPPSPRALRILSRLTCNPACLEAFVRSYGAALLRAWLVLGVAPDDWPAPRARPTLHSRHRELGEFPYPPVSLPPCESPSSPMASMGPEPHLPTHLSSPARPPDNLSPEWGGEQGVPVPPWAHRQSSAVSSALALGPRYPNSRCSPAPRIWAGLCFFPGSAIGSAAVLTAPHQHADLLNPSLTITPSTARDCPVCCALTTGCFMALLLDQGALLLALSGHNRRLALLSSGHTSLCPLSSYLCMAWFFPGYDYESEDYYNIGIKSNYYKLMINDIHISLRSISGITILVLYCIILEQLVSSVSCLGAWVACRPHFRGPDLHPDCPTFCPCPGPQVPSVPSPALSLQCPDFSPRGFTLLHLTGPEPCLTHPTCLRPQFPALTSFPLTGERLLQNLTVQAESPFGVGALTHLLLSGSPEDRVACALTLPFICRGVGSGCLAGLGEECCVSQARCPPFERPSLPCRKPSLWRRLLLEQGGLRLLLAALTRPAPHPLFLFFAADSLSCLQDLVSPTVSPAVPQAVPMDLDSPSPCLYEPLLGPAPVPAPDLHFLLDSGLQLPAQRAASATASPFFRALLSGSFAEAQMDLVPLRGLSPGAAWPVLHHLHGCRGCGAALGPVPPPGQPLLGSEAEEALEAAGRFLLPGLEEELEEAVGRIHLGPQGGPESVGEVFRLGRPRLAAHCARWTLGSEQCPRKRGLALVGLVEAAGEEAGPLTEALLAVVMGIELGARVPA

SEQ ID NO: 840372 - protein, 1257 aa, Homo sapiens
MAAAKPTLTDSLSFCLAQLAAAAGEALGGEKDPATNETPLSRALLALRTRHIKAAGGIERFRARGGLRPLLALLRRAAAAGSAPSQAGPGSAPSSAASGASSPAPASGPAPSAVSSSSPTPPVRLRKTLDLALSILADCCTEGACRTEVRRLGGILPLVTILQCMKTDSIQNRTARALGNLAMEPESCGDIHCAGAVPLLVESLTACQDSQCLQSVVRALRNLADSPQHRLALAQQGAVRPLAELLATAPDAALTLALVRALLELSRGCSRACAEQLSLGGGLGPLVSLASHPKRAVREGTILILANLCAQGLIRPALGNAGGVEVLVDELRQRRDPNGASPTSQQPLVRAVCLLCREAINRARLRDAGGLDLLMGLLRDPRASAWHPRIVAALVGFLYDTGALGRLQALGLVPLLAGQLCGEAGEEEEEGREAASWDFPEERTPERAQGGSFRSLRSWLISEGYATGPDDISPDWSPEQCPPEPMEPASPAPTPTSLRAPRTQRTPGRSPAAAIEEPWGREGPALLLLSRFSQAPDPSGALVTGPALYGLLTYVTGAPGPPSPRALRILSRLTCNPACLEAFVRSYGAALLRAWLVLGVAPDDWPAPRARPTLHSRHRELGEFPYPPVSLPPCESPSSPMASMGPEPHLPTHLSSPARPPDNLSPEWGGEQGVPVPPWAHRQSSAVSSALALGPRYPNSRCSPAPRIWAGLCFFPGSAIGSAAVLTAPHQHADLLNPSLTITPSTARDCPVCCALTTGCFMALLLDQGALLLALSGHNRRLALLSSGHTSLCPLSSYLCMAWFFPGYDYESEDYYNIGIKSNYYKLMINDIHISLRSISGITILVLYCIILEQLVSSVSCLGAWVACRPHFRGPDLHPDCPTFCPCPGPQVPSVPSPALSLQCPDFSPRGFTLLHLTGPEPCLTHPTCLRPQFPALTSFPLTGERLLQNLTVQAESPFGVGALTHLLLSGSPEDRVACALTLPFICRKPSLWRRLLLEQGGLRLLLAALTRPAPHPLFLFFAADSLSCLQDLVSPTVSPAVPQAVPMDLDSPSPCLYEPLLGPAPVPAPDLHFLLDSGLQLPAQRAASATASPFFRALLSGSFAEAQMDLVPLRGLSPGAAWPVLHHLHGCRGCGAALGPVPPPGQPLLGSEAEEALEAAGRFLLPGLEEELEEAVGRIHLGPQGGPESVGEVFRLGRPRLAAHCARWTLGSEQCPRKRGLALVGLVEAAGEEAGPLTEALLAVVMGIELGARVPA

SEQ ID NO: 840373 - protein, 1045 aa, Homo sapiens
PVRLLPADPEDTAMPGRAEAGEAEEEAGAGSGSEAEEDALWERIEGVRHRLARALNPAKLTPYLRQCRVIDEQDEEEVLSTYRFPCRVNRTGRLMDILRCRGKRGYEAFLEALEFYYPEHFTLLTGQEPAQRCSMILDEEGPEGLTQFLMTEVRRLREARKSQLQREQQLQARGRVLEEERAGLEQRLRDQQQAQERCQRLREDWEAGSLELLRLKDENYMIAMRLAQLSEEKNSAVLRSRDLQLAVDQLKLKVSRLEEECALLRRARGPPPGAEEKEKEKEKEKEPDNVDLVSELRAENQRLTASLRELQEGLQQEASRPGAPGSERILLDILEHDWREAQDSRQELCQKLHAVQGELQWAEELRDQYLQEMEDLRLKHRTLQKDCDLYKHRMATVLAQLEEIEKERDQAIQSRDRIQLQYSQSLIEKDQYRKQVRGLEAERDELLTTLTSLEGTKALLEVQLQRAQGGTCLKACASSHSLCSNLSSTWSLSEFPSPLGGPEATGEAAVMGGPEPHNSEEATDSEKEINRLSILPFPPSAGSILRRQREEDPAPPKRSFSSMSDITGSVTLKPWSPGLSSSSSSDSVWPLGKPEGLLARGCGLDFLNRSLAIRVSGRSPPGGPEPQDKGPDGLSFYGDRWSGAVVRRVLSGPGSARMEPREQRVEAAGLEGACLEAEAQQRTLLWNQGSTLPSLMDSKACQSFHEALEAWAKGPGAEPFYIRANLTLPERADPHALCVKAQEILRLVDSAYKRRQEWFCTRVDPLTLRDLDRGTVPNYQRAQQLLEVQEKCLPSSRHRGPRSNLKKRALDQLRLVRPKPVGAPAGDSPDQLLLEPCAEPERSLRPYSLVRPLLVSALRPVVLLPECLAPRLIRNLLDLPSSRLDFQVCPAESLSGEELCPSSAPGAPKAQPATPGLGSRIRAIQESVGKKHCLLELGARGVRELVQNEIYPIVIHVEVTEKNVREVRGLLGRPGWRDSELLRQCRGSEQVLWGLPCSWVQVPAHEWGHAEELAKVVRGRILQEQARLVWVECGSSRGCPSSSEA

SEQ ID NO: 840374 - protein, 1048 aa, Homo sapiens
PGARGDCSVRDPEDTAMPGRAEAGEAEEEAGAGSGSEAEEDALWERIEGVRHRLARALNPAKLTPYLRQCRVIDEQDEEEVLSTYRFPCRVNRTGRLMDILRCRGKRGYEAFLEALEFYYPEHFTLLTGQEPAQRCSMILDEEGPEGLTQFLMTEVRRLREARKSQLQREQQLQARGRVLEEERAGLEQRLRDQQQAQERCQRLREDWEAGSLELLRLKDENYMIAMRLAQLSEEKNSAVLRSRDLQLAVDQLKLKVSRLEEECALLRRARGPPPGAEEKEKEKEKEKEPDNVDLVSELRAENQRLTASLRELQEGLQQEASRPGAPGSERILLDILEHDWREAQDSRQELCQKLHAVQGELQWAEELRDQYLQEMEDLRLKHRTLQKDCDLYKHRMATVLAQLEEIEKERDQAIQSRDRIQLQYSQSLIEKDQYRKQVRGLEAERDELLTTLTSLEGTKALLEVQLQRAQGGTCLKACASSHSLCSNLSSTWSLSEFPSPLGGPEATGEAAVMGGPEPHNSEEATDSEKEINRLSILPFPPSAGSILRRQREEDPAPPKRSFSSMSDITGSVTLKPWSPGLSSSSSSDSVWPLGKPEGLLARGCGLDFLNRSLAIRVSGRSPPGGPEPQDKGPDGLSFYGDRWSGAVVRRVLSGPGSARMEPREQRVEAAGLEGACLEAEAQQRTLLWNQGSTLPSLMDSKACQSFHEALEAWAKGPGAEPFYIRANLTLPERADPHALCVKAQEILRLVDSAYKRRQEWFCTRVDPLTLRDLDRGTVPNYQRAQQLLEVQEKCLPSSRHRGPRSNLKKRALDQLRLVRPKPVGAPAGDSPDQLLLEPCAEPERSLRPYSLVRPLLVSALRPVVLLPECLAPRLIRNLLDLPSSRLDFQVCPAESLSGEELCPSSAPGAPKAQPATPGLGSRIRAIQESVGKKHCLLELGARGVRELVQNEIYPIVIHVEVTEKNVREVRGLLGRPGWRDSELLRQCRGSEQVLWGLPCSWVQVPAHEWGHAEELAKVVRGRILQEQARLVWVECGSSRGCPSSSEA

SEQ ID NO: 840375 - protein, 1048 aa, Homo sapiens; identical to SEQ ID NO: 840374

SEQ ID NO: 840376 - protein, 190 aa, Homo sapiens
MPTIPCTEIEDLRARKNNQGSADNRGNCDPCIECTRTLGLICFAGHHEVEEQDFEEREREQAIQSRDRIQLQYSQSLIEKDQYRKQVRGLEAERDELLTTLTSLEGTKALLEVQLQRAQGGTCLKACASSHSLCSNLSSTWSLSEFPSPLGGPEATGEAAVMGGPEPHNSEEDHRHVNTGDQFGLHTWPY

SEQ ID NO: 840377 - protein, 807 aa, Homo sapiens
MRKLGPEEVDQLKLKVSRLEEECALLRRARGPPPGAEEKEKEKEKEKEPDNVDLVSELRAENQRLTASLRELQEGLQQEASRPGAPGSERILLDILEHDWREAQDSRQELCQKLHAVQGELQWAEELRDQYLQEMEDLRLKHRTLQKDCDLYKHRMATVLAQLEEIEKERDQAIQSRDRIQLQYSQSLIEKDQYRKQVRGLEAERDELLTTLTSLEGTKALLEVQLQRAQGGTCLKACASSHSLCSNLSSTWSLSEFPSPLGGPEATGEAAVMGGPEPHNSEEATDSEKEINRLSILPFPPSAGSILRRQREEDPAPPKRSFSSMSDITGSVTLKPWSPGLSSSSSSDSVWPLGKPEGLLARGCGLDFLNRSLAIRVSGRSPPGGPEPQDKGPDGLSFYGDRWSGAVVRRVLSGPGSARMEPREQRVEAAGLEGACLEAEAQQRTLLWNQGSTLPSLMDSKACQSFHEALEAWAKGPGAEPFYIRANLTLPERADPHALCVKAQEILRLVDSAYKRRQEWFCTRVDPLTLRDLDRGTVPNYQRAQQLLEVQEKCLPSSRHRGPRSNLKKRALDQLRLVRPKPVGAPAGDSPDQLLLEPCAEPERSLRPYSLVRPLLVSALRPVVLLPECLAPRLIRNLLDLPSSRLDFQVCPAESLSGEELCPSSAPGAPKAQPATPGLGSRIRAIQESVGKKHCLLELGARGVRELVQNEIYPIVIHVEVTEKNVREVRGLLGRPGWRDSELLRQCRGSEQVLWGLPCSWVQVPAHEWGHAEELAKVVRGRILQEQARLVWVECGSSRGCPSSSEA

SEQ ID NO: 840378 - protein, 917 aa, Homo sapiens
PGARGDCSVRDPEDTAMPGRAEAGEAEEEAGAGSGSEAEEDALWERIEGVRHRLARALNPAKLTPYLRQCRVIDEQDEEEVLSTYRFPCRVNRTGRLMDILRCRGKRGYEAFLEALEFYYPEHFTLLTGQEPAQRCSMILDEEGPEGLTQFLMTEVRRLREARKSQLQREQQLQARGRVLEEERAGLEQRLRDQQQAQERCQRLREDWEAGSLELLRLKDENYMIAMRLAQLSEEKNSAVLRSRDLQLAVDQLKLKVSRLEEECALLRRARGPPPGAEEKEKEKEKEKEPDNVDLVSELRAENQRLTASLRELQEGLQQEASRPGAPGSERILLDILEHDWREAQDSRQELCQKLHAVQGELQWAEELRDQYLQEMEDLRLKHRTLQKDCDLYKHRMATVLAQLEEIEKERDQAIQSRDRIQLQYSQSLIEKDQYRKQVRGLEAERDELLTTLTSLEGTKALLEVQLQRAQGGTCLKACASSHSLCSNLSSTWSLSEFPSPLGGPEATGEAAVMGGPEPHNSEEATDSEKEINRLSILPFPPSAGSILRRQREEDPAPPKRSFSSMSDITGSVTLKPWSPGLSSSSSSDSVWPLGKPEGLLARGCGLDFLNRSLAIRVSGRSPPGGPEPQDKGPDGLSFYGDRWSGAVVRRVLSGPGSARMEPREQRVEAAGLEGACLEAEAQQRTLLWNQGSTLPSLMDSKACQSFHEALEAWAKGPGAEPFYIRANLTLPERADPHALCVKAQEILRLVDSAYKRRQEWFCTRVDPLTLRDLDRGTVPNYQRAQQLLEVQEKCLPSSRHRGPRSNLKKRALDQLRLVRPKPVGAPAGDSPDQLLLEPCAEPERSLRPYSLVRPLLVSALRPVVLLPECLAPRLIRNLLDLPSSRLDFQVCPAEASLGRNCAHPHTKHQHEVQHQH

SEQ ID NO: 840379 - protein, 133 aa, Homo sapiens [sequence omitted]

SEQ ID NO: 840380 - protein, 78 aa, Homo sapiens
MANVQVAVRVRPLSKRETKEGGRIIVEVDGKVAKIRNLKVDNRPDGFGDSREKVMAFGFDYCYWSVNPEDPQYASQDV

SEQ ID NO: 840381 - protein, 76 aa, Homo sapiens
PILQMTKLRVRKAQGPYSNKCQSQDTNTGLTPHPLGWPLLTSSQITEGPGLPETPPASAQMGLLQAAKEGTASARH

SEQ ID NO: 840382 - protein, 130 aa, Homo sapiens
MTRVEGRYQGHSGELYLAGTPQLLSVGYDTETWLGCKETDWDSRAGGRGDKAGGERQEPRRPQAQRCGAAVVVLRGGLAKLAFAPSEEFLLFFGFGKRSLFTEGAGFVPSRRVRGWRAQCCLSALSLDPA

SEQ ID NO: 840383 - protein, 115 aa, Homo sapiens
IYTDWANHYLAKSGHKRLIRDLQQDVTDGVLLAQIIQVVANEKIEDINGCPKNRSQMIENIDACLNFLAAKGINIQGLSAEEIRNGNLKAILGLFFSLSRYKQQQQQPQKQHLSS

SEQ ID NO: 840384 - protein, 135 aa, Homo sapiens
PLTAIHTPSTAEPYKFPFSTKDSQHVSSVAQTQKQYDTSSKTHSNSQQGTSAMLEDDLQLSDSEDSDSEQTPEKPPSSSAPPSAPQSLPEPVASAHSSSAESESTSDSDSSSDSESESSSSDSEENEPLETPAPE

SEQ ID NO: 840385 - protein, 123 aa, Homo sapiens
PLTAIHTPSTAEPYKFPFSTKDSQHVSSVAQTQKQYDTSSKTHSNSQQGTSAMLEDDLQLSDSEDSDSEQTPEKPPSSSAPPSAPQSLPEPVASAHSSSAESESTSDFLIPVTFLIPVTFLIH

SEQ ID NO: 840386 - protein, 129 aa, Homo sapiens
HQLPTRSPAARLSNRNISSPQDLQLHGSQTGTSAPHQISSCTALKQEHQLPTGSPAARLSNSEQTPEKPPSSSAPPSAPQSLPEPVASAHSSSAESESTSDSDSSSDSESESSSSDSEENEPLETPAPE

SEQ ID NO: 840387 - protein, 605 aa, Homo sapiens
ECVRGCFDLVGAASGTAPRRGASAQVAGLALAPPSPTQSAGRQGGPAAPLQHMPVQLTTALRVVGTSLFALAVLGGILAAYVTGYQFIHTEKHYLSFGLYGAILGLHLLIQSLFAFLEHRRMRRAGQALKLPSPRRGSVALCIAAYQEDPDYLRKCLRSAQRISFPDLKVVMVVDGNRQEDAYMLDIFHEVLGGTEQAGFFVWRSNFHEAGEGETEASLQEGMDRVRDVVRASTFSCIMQKWGGKREVMYTAFKALGDSVDYIQVCDSDTVLDPACTIEMLRVLEEDPQVGGVGGDVQILNKYDSWISFLSSVRYWMAFNVERACQSYFGCVQCISGPLGMYRNSLLQQFLEDWYHQKFLGSKCSFGDDRHLTNRVLSLGYRTKYTARSKCLTETPTKYLRWLNQQTRWSKSYFREWLYNSLWFHKHHLWMTYESVVTGFFPFFLIATVIQLFYRGRIWNILLFLLTVQLVGIIKATYACFLRGNAEMIFMSLYSLLYMSSLLPAKIFAIATINKSGWGTSGRKTIVVNFIGLIPVSIWVAVLLEGLAYTAYCQDLFSETELAFLVSGAILYGCYWVALLMLYLAIIARRCGKKPEQYSLAFAEV

SEQ ID NO: 840388 - protein, 572 aa, Homo sapiens
GAWSRRGPAELRSAAAGGTMPVQLTTALRVVGTSLFALAVLGGILAAYVTGYQFIHTEKHYLSFGLYGAILGLHLLIQSLFAFLEHRRMRRAGQALKLPSPRRGSVALCIAAYQEDPDYLRKCLRSAQRISFPDLKVVMVVDGNRQEDAYMLDIFHEVLGGTEQAGFFVWRSNFHEAGEGETEASLQEGMDRVRDVVRASTFSCIMQKWGGKREVMYTAFKALGDSVDYIQVCDSDTVLDPACTIEMLRVLEEDPQVGGVGGDVQILNKYDSWISFLSSVRYWMAFNVERACQSYFGCVQCISGPLGMYRNSLLQQFLEDWYHQKFLGSKCSFGDDRHLTNRVLSLGYRTKYTARSKCLTETPTKYLRWLNQQTRWSKSYFREWLYNSLWFHKHHLWMTYESVVTGFFPFFLIATVIQLFYRGRIWNILLFLLTVQLVGIIKATYACFLRGNAEMIFMSLYSLLYMSSLLPAKIFAIATINKSGWGTSGRKTIVVNFIGLIPVSIWVAVLLEGLAYTAYCQDLFSETELAFLVSGAILYGCYWVALLMLYLAIIARRCGKKPEQYSLAFAEV

SEQ ID NO: 840389 - protein, 478 aa, Homo sapiens
MATDSWALAVDEQEAAVKSMTNLQIKEEKVKADTNGIIKTSTTAEKTDEEEKEDRAAQSLLNKLIRSNLVDNTNQVEVLQRDPNSPLYSVKSFEELRLKPQLLQGVYAMGFNRPSKIQENALPMMLAEPPQNLIAQSQSGTGKTAAFVLAMLSRVEPSDRYPQCLCLSPTYELALQTGKVIEQMGKFYPELKLAYAVRGNKLERGQKISEQIVIGTPGTVLDWCSKLKFIDPKKIKVFVLDEADVMIATQGHQDQSIRIQRMLPRNCQMLLFSATFEDSVWKFAQKVVPDPNVIKLKREEETLDTIKQYYVLCSSRDEKFQALCNLYGAITIAQAMIFCHTRKTASWLAAELSKEGHQVALLSGEMMVEQRAAVIERFREGKEKVLVTTNVCARGIDVEQVSVVINFDLPVDKDGNPDNETYLHRIGRTGRFGKRGLAVNMVDSKHSMNILNRIQEHFNKKIERLDTDDLDEIEKIAN

SEQ ID NO: 840390 - protein, 478 aa, Homo sapiens; identical to SEQ ID NO: 840389

SEQ ID NO: 840391 - protein, 233 aa, Homo sapiens [sequence omitted]

SEQ ID NO: 840392 - protein, 220 aa, Homo sapiens
QAGRGGVESARRLFSATFEDSVWKFAQKVVPDPNVIKLKREEETLDTIKQYYVLCSSRDEKFQALCNLYGAITIAQAMIFCHTRKTASWLAAELSKEGHQVALLSGEMMVEQRAAVIERFREGKEKVLVTTNVCARGIDVEQVSVVINFDLPVDKDGNPDNETYLHRIGRTGRFGKRGLAVNMVDSKHSMNILNRIQEHFNKKIERLDTDDLDEIEKIAN

SEQ ID NO: 840393 - protein, 478 aa, Homo sapiens; identical to SEQ ID NO: 840389

SEQ ID NO: 840394 - protein, 438 aa, Homo sapiens
MATDSWALAVDEQEAAVKSMTNLQIKEEKVKADTNGIIKTSTTAEKTDEEEKEDRAAQSLLNKLIRSNLVDNTNQVEVLQRDPNSPLYSVKSFEELRLKPQLLQGVYAMGFNRPSKIQENALPMMLAEPPQNLIAQSQSGTGKTAAFVLAMLSRVEPSDRYPQCLCLSPTYELALQTGKVIEQMGKFYPELKLAYAVRGNKLERGQKISEQIVIGTPGTVLDWCSKLKFIDPKKIKVFVLDEADVMIATQGHQDQSIRIQRMLPRNCQMLLFSATFEDSVWKFAQKVVPDPNVIKLKREEETLDTIKQYYVLCSSRDEKFQALCNLYGAITIAQAMIFCHTRKTASWLAAELSKEGHQVALLSGEMMVEQRAAVIERFREGKEKVLVTTNVCARGIDVEQVSVVINFDLPVDKDGNPERKPPPALGAAPPFFYRGGRA

SEQ ID NO: 840395 - protein, 320 aa, Homo sapiens
MATDSWALAVDEQEAAVKSMTNLQIKEEKVKADTNGIIKTSTTAEKTDEEEKEDRAAQSLLNKLIRSNLVDNTNQVEVLQRDPNSPLYSVKSFEELRLKPQLLQGVYAMGFNRPSKIQENALPMMLAEPPQNLIAQSQSGTGKTAAFVLAMLSRVEPSDRYPQCLCLSPTYELALQTGKVIEQMGKFYPELKLAYAVRGNKLERGQKISEQIVIGTPGTVLDWCSKLKFIDPKKIKVFVLDEADVMIATQGHQDQSIRIQRMLPRNCQMLLFSATFEDSVWKFAQKVVPDPNVIKLKREEETLDTIKQYYVLCSSRDENS

SEQ ID NO: 840396 - protein, 125 aa, Homo sapiens
VRVRCILAPVARLGPALRRGAAHIFTSGSPLSGTMATDSWALAVDEQEAAVKSVSSSAPGEEDVAGAQAKPPKSTGSSPGWGGPWATRSCSLLGQSLALDLLLELKRPMSSFLSPSGLVKDFILW

SEQ ID NO: 840397 - protein, 390 aa, Homo sapiens
LSQFTRGQATSSSLKDIVYAMGFNRPSKIQENALPMMLAEPPQNLIAQSQSGTGKTAAFVLAMLSRVEPSDRYPQCLCLSPTYELALQTGKVIEQMGKFYPELKLAYAVRGNKLERGQKISEQIVIGTPGTVLDWCSKLKFIDPKKIKVFVLDEADVMIATQGHQDQSIRIQRMLPRNCQMLLFSATFEDSVWKFAQKVVPDPNVIKLKREEETLDTIKQYYVLCSSRDEKFQALCNLYGAITIAQAMIFCHTRKTASWLAAELSKEGHQVALLSGEMMVEQRAAVIERFREGKEKVLVTTNVCARGIDVEQVSVVINFDLPVDKDGNPDNETYLHRIGRTGRFGKRGLAVNMVDSKHSMNILNRIQEHFNKKIERLDTDDLDEIEKIAN

SEQ ID NO: 840398 - protein, 295 aa, Homo sapiens [sequence omitted]

SEQ ID NO: 840399 - protein, 301 aa, Homo sapiens
MGRALISRAGFAFEIPMKITWVSTVERGQKISEQIVIGTPGTVLDWCSKLKFIDPKKIKVFVLDEADVMIATQGHQDQSIRIQRMLPRNCQMLLFSATFEDSVWKFAQKVVPDPNVIKLKREEETLDTIKQYYVLCSSRDEKFQALCNLYGAITIAQAMIFCHTRKTASWLAAELSKEGHQVALLSGEMMVEQRAAVIERFREGKEKVLVTTNVCARGIDVEQVSVVINFDLPVDKDGNPDNETYLHRIGRTGRFGKRGLAVNMVDSKHSMNILNRIQEHFNKKIERLDTDDLDEIEKIAN

SEQ ID NO: 840400 - protein, 217 aa, Homo sapiens
MLPRNCQMLLFSATFEDSVWKFAQKVVPDPNVIKLKREEETLDTIKQYYVLCSSRDEKFQALCNLYGAITIAQAMIFCHTRKTASWLAAELSKEGHQVALLSGEMMVEQRAAVIERFREGKEKVLVTTNVCARGIDVEQVSVVINFDLPVDKDGNPDNETYLHRIGRTGRFGKRGLAVNMVDSKHSMNILNRIQEHFNKKIERLDTDDLDEIEKIAN

SEQ ID NO: 840401 - protein, 493 aa, Homo sapiens
MATDSWALAVDEQEAAVKSMTNLQIKEEKVKADTNGIIKTSTTAEKTDEEEKEDRAAQSLLNKLIRSNLVDNTNQVEVLQRDPNSPLYSVKSFEELRLKPQLLQGVYAMGFNRPSKIQENALPMMLAEPPQNLIAQSQSGTGKTAAFVLAMLSRVEPSDRYPQCLCLSPTYELALQTGKVIEQMGKFYPELKLAYAVRGNKLERGQKISEQIVIGTPGTVLDWCSKLKFIDPKKIKVFVLDEADVMIATQGHQDQSIRIQRMLPRNCQMLLFSATFEDSVWKFAQKVVPDPNVIKLKREEETLDTIKQYYVLCSSRDEKFQALCNLYGAITIAQAMIFCHTRKTASWLAAELSKEGHQVALLSGEMMVEQRAAVIERFREGKEKVLVTTNVCARGEQRTCPTWSARLGVPGPIRARNPCIQGSRMVSGRWVGLVTLFLSRRDCLDFPEVVRTHTCQVRWLMPAIPRQENCLNPGDRGCSEPRMCYSTPSWVTE

SEQ ID NO: 840402 - protein, 219 aa, Homo sapiens
MATDSWALAVDEQEAAVKSMTNLQIKEEKVKADTNGIIKTSTTAEKTDEEEKEDRAAQSLLNKLIRSNLVDNTNQVEVLQRDPNSPLYSVKSFEELRLKPQLLQGVYAMGFNRPSKIQENALPMMLAEPPQNLIAQSQSGTGKTAAFVLAMLSRVEPSDRYPQCLCLSPTYELALQTGKVIEQMGKFYPELKLAYAVRGNKCEYGRRQLNSEQGRGLGV

SEQ ID NO: 840403 - protein, 116 aa, Homo sapiens [sequence omitted]

SEQ ID NO: 840404 - protein, 169 aa, Homo sapiens
AGRKGSLAALYDLAVLKKKVKEKEEKKKKKIKTIKSEAEDLAEPLSSTEGVAPLSQAPSPLAIPAIKEEPLEDLKPCLGINEISSSFFSLLLEILLLESQASLPMLEERVLDWQSSPASSLNSWFSAAPNWAELVLPALQYLAGESRAVPSSFSPFVEFKEKTQQWKLL

SEQ ID NO: 840405 - protein, 587 aa, Homo sapiens
MASEDIAKLAETLAKTQVAGGQLSFKGKSLKLNTAEDAKDVIKEIEDFDSLEALRLEGNTVGVEAARVIAKALEKKSELKRCHWSDMFTGRLRTEIPPALISLGEGLITAGAQLVELDLSDNAFGPDGVQGFEALLKSSACFTLQELKLNNCGMGIGGGKILAAALTECHRKSSAQGKPLALKVFVAGRNRLENDGATALAEAFRVIGTLEEVHMPQNGINHPGITALAQAFAVNPLLRVINLNDNTFTEKGAVAMAETLKTLRQVEVINFGDCLVRSKGAVAIADAIRGGLPKLKELNLSFCEIKRDAALAVAEAMADKAELEKLDLNGNTLGEEGCEQLQEVLEGFNMAKVLASLSDDEDEEEEEEGEEEEEEAEEEEEEDEEEEEEEEEEEEEEPQQRGQGEKSATPSRKILDPNTGEPAPVLSSPPPADVSTFLAFPSPEKLLRLGPKSSVLIAQQTDTSDPEKVVSAFLKVSSVFKDEATVRMAVQDAVDALMQKAFNSSSFNSNTFLTRLLVHMGLLKSEDKVKAIANLYGPLMALNHMVQQDYFPKALAPLLLAFVTKPNSALESCSFARHSLLQTLYKV

SEQ ID NO: 840406 - protein, 109 aa, Homo sapiens
MASEDIAKLAETLAKTQVAGGQLSFKGKSLKLNTAEDAKDVIKEIEDFDSLEALRLEGNTVGVEAARVIAKALEKKSELKRCHWSDMFTGRLRTEIPPALISPGKEGYR

SEQ ID NO: 840407 - protein, 68 aa, Homo sapiens
YWTVVLDEFCFTMAEAGNKLQELNLSFCEIKRDAALAVAEAMADKAELEKLDLNATPWQKQEALPASA

SEQ ID NO: 840408 - protein, 587 aa, Homo sapiens; identical to SEQ ID NO: 840405

SEQ ID NO: 840409 - protein, 587 aa, Homo sapiens; identical to SEQ ID NO: 840405

SEQ ID NO: 840410 - protein, 587 aa, Homo sapiens; identical to SEQ ID NO: 840405

SEQ ID NO: 840411 - protein, 587 aa, Homo sapiens; identical to SEQ ID NO: 840405

SEQ ID NO: 840412 - protein, 542 aa, Homo sapiens
MASEDIAKLAETLAKTQVAGGQLSFKGKSLKLNTAEDAKDVIKEIEDFDSLEALRLEGNTVGVEAARVIAKALEKKSELKRCHWSDMFTGRLRTEIPPALISLGEGLITAGAQLVELDLSDNAFGPDGVQGFEALLKSSACFTLQELKLNNCGMGIGGGKVIGTLEEVHMPQNGINHPGITALAQAFAVNPLLRVINLNDNTFTEKGAVAMAETLKTLRQVEVINFGDCLVRSKGAVAIADAIRGGLPKLKELNLSFCEIKRDAALAVAEAMADKAELEKLDLNGNTLGEEGCEQLQEVLEGFNMAKVLASLSDDEDEEEEEEGEEEEEEAEEEEEEDEEEEEEEEEEEEEEPQQRGQGEKSATPSRKILDPNTGEPAPVLSSPPPADVSTFLAFPSPEKLLRLGPKSSVLIAQQTDTSDPEKVVSAFLKVSSVFKDEATVRMAVQDAVDALMQKAFNSSSFNSNTFLTRLLVHMGLLKSEDKVKAIANLYGPLMALNHMVQQDYFPKALAPLLLAFVTKPNSALESCSFARHSLLQTLYKV

SEQ ID NO: 840413 - protein, 457 aa, Homo sapiens
MLKSSSAAVATPLGEGAPAHDQGPLPFPNRILAAALTECHRKSSAQGKPLALKVFVAGRNRLENDGATALAEAFRVIGTLEEVHMPQNGINHPGITALAQAFAVNPLLRVINLNDNTFTEKGAVAMAETLKTLRQVEVINFGDCLVRSKGAVAIADAIRGGLPKLKELNLSFCEIKRDAALAVAEAMADKAELEKLDLNGNTLGEEGCEQLQEVLEGFNMAKVLASLSDDEDEEEEEEGEEEEEEAEEEEEEDEEEEEEEEEEEEEEPQQRGQGEKSATPSRKILDPNTGEPAPVLSSPPPADVSTFLAFPSPEKLLRLGPKSSVLIAQQTDTSDPEKVVSAFLKVSSVFKDEATVRMAVQDAVDALMQKAFNSSSFNSNTFLTRLLVHMGLLKSEDKVKAIANLYGPLMALNHMVQQDYFPKALAPLLLAFVTKPNSALESCSFARHSLLQTLYKV

SEQ ID NO: 840414 - protein, 587 aa, Homo sapiens; identical to SEQ ID NO: 840405

SEQ ID NO: 840415 - protein, 139 aa, Homo sapiens
DAWVDPRVRAQQTDTSDPEKVVSAFLKVSSVFKDEATVRMAVQDAVDALMQKAFNSSSFNSNTFLTRLLVHMGLLKSEDKVKAIANLYGPLMALNHMVQQDYFPKALAPLLLAFVTKPNSALESCSFARHSLLQTLYKV

SEQ ID NO: 840416 - protein, 159 aa, Homo sapiens
MPQNGINHPGITALAQAFAVNPLLRVINLNDNTFTEKGAVAMAETLKTLRQVEVINFGDCLVRSKGAVAIADAIRGGLPKLKELNLSFCEIKRDAALAVAEAMADKAELEKLDLNGPTAPWNPAPSPATVCCRRCTRSRLKASPIPWPGPVSWGGTRMN

SEQ ID NO: 840417 - protein, 94 aa, Homo sapiens
TAVHRDAVMATLEGPGQHALTKMSLAPKWPPHLENRPRGIHRPADPSFPAGPTAPWNPAPSPATVCCRRCTRSRLKASPIPWPGPVSWGGTRMN

SEQ ID NO: 840418 - protein, 552 aa, Homo sapiens
MASEDIAKLAETLAKTQVAGGQLSFKGKSLKLNTAEDAKDVIKEIEDFDSLEALRLEGNTVGVEAARVIAKALEKKSELKRCHWSDMFTGRLRTEIPPALISLGEGLITAGAQLVELDLSDNAFGPDGVQGFEALLKSSACFTLQELKLNNCGMGIGGGKILAAALTECHRKSSAQGKPLALKVFVAGRNRLENDGATALAEAFRVIGTLEEVHMPQNGINHPGITALAQAFAVNPLLRVINLNDNTFTEKGAVAMAETLKTLRQVEVINFGDCLVRSKGAVAIADAIRGGLPKLKELNLSFCEIKRDAALAVAEAMADKAELEKLDLNGNTLGEEGCEQLQEVLEGFNMAKVLASLSDDEDEEEEEEGEEEEEEAEEEEEEDEEEEEEEEEEEEEEPQQRGQGEKSATPSRKILDPNTGEPAPVLSSPPPADVSTFLAFPSPEKLLRLGPKSSVLIAQQTDTSDPEKVVSAFLKVSSVFKDEATVRMAVQDAVDALMQKAFNSSSFNSNTFLTRLLVHMGLLKSEDKVKAIANLYGPLMALNHMVQQDYSP

SEQ ID NO: 840419 - protein, 470 aa, Homo sapiens
MASEDIAKLAETLAKTQVAGGQLSFKGKSLKLNTAEDAKDVIKEIEDFDSLEALRLEGNTVGVEAARVIAKALEKKSELKRCHWSDMFTGRLRTEIPPALISLGEGLITAGAQLVELDLSDNAFGPDGVQGFEALLKSSACFTLQELKLNNCGMGIGGGKILAAALTECHRKSSAQGKPLALKVFVAGRNRLENDGATALAEAFRVIGTLEEVHMPQNGINHPGITALAQAFAVNPLLRVINLNDNTFTEKGAVAMAETLKTLRQVEVINFGDCLVRSKGAVAIADAIRGGLPKLKELNLSFCEIKRDAALAVAEAMADKAELEKLDLNGNTLGEEGCEQLQEVLEGFNMAKVLASLSDDEDEEEEEEGEEEEEEAEEEEEEDEEEEEEEEEEEEEEPQQRGQGEKSATPSRKILDPNTGEPAPVLSSHLLFLLFLIFLLLFFCFLFFLFSFLLLLLVLVITEGRQHLAM

SEQ ID NO: 840420 - protein, 109 aa, Homo sapiens
MASEDIAKLAETLAKTQVAGGQLSFKGKSLKLNTAEDAKDVIKEIEDFDSLEALRLEGNTVGVEAARVIAKALEKKSELKRCHWSDMFTGRLRTEIPPALISPGEGGVP

SEQ ID NO: 840421 - protein, 587 aa, Homo sapiens; identical to SEQ ID NO: 840405

SEQ ID NO: 840422 - protein, 141 aa, Homo sapiens
MDEVVARVSTPHELSLGIRRVQYGGSAVCMHTPSVHTTVLTAQPEEQRMPWVGLWGSDRGVVGRGQPWAPHRVDRQTPDCPGAGAAGTALAPDLVGLLLAAEMSSVTGLAGGGVLTTQSCSPVWGGRGRVPNVRAASGRCS

SEQ ID NO: 840423 - protein, 642 aa, Homo sapiens
MGLLRRPPIICGLYSRVAPAEPPPSRPTPAGAPGWRRCPWNRFCRSPGEPTSLVNMASEDIAKLAETLAKTQVAGGQLSFKGKSLKLNTAEDAKDVIKEIEDFDSLEALRLEGNTVGVEAARVIAKALEKKSELKRCHWSDMFTGRLRTEIPPALISLGEGLITAGAQLVELDLSDNAFGPDGVQGFEALLKSSACFTLQELKLNNCGMGIGGGKILAAALTECHRKSSAQGKPLALKVFVAGRNRLENDGATALAEAFRVIGTLEEVHMPQNGINHPGITALAQAFAVNPLLRVINLNDNTFTEKGAVAMAETLKTLRQVEVINFGDCLVRSKGAVAIADAIRGGLPKLKELNLSFCEIKRDAALAVAEAMADKAELEKLDLNGNTLGEEGCEQLQEVLEGFNMAKVLASLSDDEDEEEEEEGEEEEEEAEEEEEEDEEEEEEEEEEEEEEPQQRGQGEKSATPSRKILDPNTGEPAPVLSSPPPADVSTFLAFPSPEKLLRLGPKSSVLIAQQTDTSDPEKVVSAFLKVSSVFKDEATVRMAVQDAVDALMQKAFNSSSFNSNTFLTRLLVHMGLLKSEDKVKAIANLYGPLMALNHMVQQDYFPKALAPLLLAFVTKPNSALESCSFARHSLLQTLYKV

SEQ ID NO: 840424 - protein, 587 aa, Homo sapiens; identical to SEQ ID NO: 840405

SEQ ID NO: 840425 - protein, 587 aa, Homo sapiens; identical to SEQ ID NO: 840405

SEQ ID NO: 840426 - protein, 271 aa, Homo sapiens
MADKAELEKLDLNGNTLGEEGCEQLQEVLEGFNMAKVLASLSDDEDEEEEEEGEEEEEEAEEEEEEDEEEEEEEEEEEEEEPQQRGQGEKSATPSRKILDPNTGEPAPVLSSPPPADVSTFLAFPSPEKLLRLGPKSSVLIAQQTDTSDPEKVVSAFLKVSSVFKDEATVRMAVQDAVDALMQKAFNSSSFNSNTFLTRLLVHMGLLKSEDKVKAIANLYGPLMALNHMVQQDYFPKALAPLLLAFVTKPNSALESCSFARHSLLQTLYKV

SEQ ID NO: 840427 - protein, 358 aa, Homo sapiens [sequence omitted]

SEQ ID NO: 840428 - protein, 225 aa, Homo sapiens
DAWVDPRVRAQQEAEEEEEEDEEEEEEEEEEEEEEPQQRGQGEKSATPSRKILDPNTGEPAPVLSSPPPADVSTFLAFPSPEKLLRLGPKSSVLIAQQTDTSDPEKVVSAFLKVSSVFKDEATVRMAVQDAVDALMQKAFNSSSFNSNTFLTRLLVHMGLLKSEDKVKAIANLYGPLMALNHMVQQDYFPKALAPLLLAFVTKPNSALESCSFARHSLLQTLYKV

SEQ ID NO: 840429 - protein, 373 aa, Homo sapiens
MASEDIAKLAETLAKTQVAGGQLSFKGKSLKLNTAEDAKDVIKEIEDFDSLEALRLEGNTVGVEAARVIAKALEKKSELKRCHWSDMFTGRLRTEIPPALISLGEGLITAGAQLVELDLSDNAFGPDGVQGFEALLKSSACFTLQELKLNNCGMGIGGGKILAAALTECHRKSSAQGKPLALKVFVAGRNRLENDGATALAEAFRVIGTLEEVHMPQNGINHPGITALAQAFAVNPLLRVINLNDNTFTEKGAVAMAETLKTLRQVEVINFGDCLVRSKGAVAIADAIRGGLPKLKELNLSFCEIKRDAALAVAEAMADKAELEKLDLNGPTAPWNPAPSPATVCCRRCTRSRLKASPIPWPGPVSWGGTRMN

SEQ ID NO: 840430 - protein, 614 aa, Homo sapiens
MASEDIAKLAETLAKTQVAGGQLSFKGKSLKLNTAEDAKDVIKEIEDFDSLEALRLEGNTVGVEAARVIAKALEKKSELKRCHWSDMFTGRLRTEIPPALISLGEGLITAGAQLVELDLSDNAFGPDGVQGFEALLKSSACFTLQELKLNNCGMGIGGGKILAAALTECHRKSSAQGKPLALKVFVAGRNRLENDGATALAEAFRVIGTLEEVHMPQNGINHPGITALAQAFAVNPLLRVINLNDNTFTEKGAVAMAETLKTLRQVEVINFGDCLVRSKGAVAIADAIRGGLPKLKELNLSFCEIKRDAALAVAEAMADKAELEKLDLNGNTLGEEGCEQLQEVLEGFNMAKVLASLSDDEDEEEEEEGEEEEEEAEEEEEEDEEEEEEEEEEEEEEPQQRGQGEKSATPSRKILDPNTGEPAPVLSSPPPADVSTFLAFPSPEKLLRLGPKSSVLIAQQTDTSDPEKVVSAFLKVSSVFKDEATVRMAVQDAVDALMQKAFNSSSFNSNTFLTRLLVHMGLLKSEDKVKAIANLYGPLMALNHMVQQDYFPKALAPLLLAFVTKPNSALESCSFARHSLLQTLYKAGEGEAGSPMSELHLDAALKGPPGAGER

SEQ ID NO: 840431 - protein, 430 aa, Homo sapiens
MASEDIAKLAETLAKTQVAGGQLSFKGKSLKLNTAEDAKDVIKEIEDFDSLEALRLEGNTVGVEAARVIAKALEKKSELKRCHWSDMFTGRLRTEIPPALISLGEGLITAGAQLVELDLSDNAFGPDGVQGFEALLKSSACFTLQELKLNNCGMGIGGGKILAAALTECHRKSSAQGKPLALKVFVAGRNRLENDGATALAEAFRVIGTLEEVHMPQNGINHPGITALAQAFAVNPLLRVINLNDNTFTEKGAVAMAETLKTLRQVEVINFGDCLVRSKGAVAIADAIRGGLPKLKELNLSFCEIKRDAALAVAEAMADKAELEKLDLNGNTLGEEGCEQLQEVLEGFNMAKVLASLSDDEDEEEEEEGEEEEEEAEEEEEEDEEEEEEEEEEEEEEPQQRGQGEKSATPSRKILDPNTGVRIQQESSHL

SEQ ID NO: 840432 - protein, 211 aa, Homo sapiens
SRGSLKLLTEDSDLNTGEPAPVLSSPPPADVSTFLAFPSPEKLLRLGPKSSVLIAQQTDTSDPEKVVSAFLKVSSVFKDEATVRMAVQDAVDALMQKAFNSSSFNSNTFLTRLLVHMGLLKSEDKVKAIANLYGPLMALNHMVQQDYFPKALAPLLLAFVTKPNSALESCSFARHSLLQTLYKAGEGEAGSPMSELHLDAALKGPPGAGER

SEQ ID NO: 840433 - protein, 67 aa, Homo sapiens
PCVPCPPVRPPSRRTCSGALPLESVVAPEFGPLGRNCLAGPRVTGQLLTDYVGTPSVRDACIYEGRI

SEQ ID NO: 840434 - protein, 79 aa, Homo sapiens
RITAATHVHEASSRSHAIFTIHYTQAILENNLPSEMASKINLVDLAGSERADPSYCKDRIAEGANINKSLVTLGIVIST

SEQ ID NO: 840435 - protein, 87 aa, Homo sapiens
MGCVQVCVCMCAQVFEHVDGCTCGVCAWGVCTCVCAPRCMSVWMGARIEVRVGEVRLGAEVRLGAEVRLGAEVRLGAEVRLGAEAPG

SEQ ID NO: 840436 - protein, 115 aa, Homo sapiens
MGCVQVCVCMCAQVFEHVDGCTCGVCAWGVCTCVCAPRCMSVWMGARIECVNEMCAYVCVYVCPGVCVDGCVWDVCMGVCVCACVTRYMSGWVCVGCVHGVCARVCVCVPRCMSG

SEQ ID NO: 840437 - protein, 136 aa, Homo sapiens
MGNVSFSCPQPQTVPVTFLSSRSYLALPGNSGEDKVSVTFQFRTWNRAGHLLFGELQRGSGSFVLFLKDGKLKLSLFQAGQSPRNVTAGAGLNDGQWHSVSFSAKWSHMNVVVDDDTAVQPLVAVLIDSGDTYYFG

SEQ ID NO: 840438 - protein, 50 aa, Homo sapiens
MILGIPHQLISPRKCDYNSAAQCRSTSTLLPRIIEDAYHLFMYHDPGLPR

SEQ ID NO: 840439 - protein, 640 aa, Homo sapiens
MENQLAKSTEERTFQYQDSLPSLPVPSLEESLKKYLESVTRTCYQIRGLDPDAKRGFLDLTREGIQVKPFANQEEYKKTEEIVQKFQSGIGEKLHQKLLERAKGKRNWLEEWWLNVAYLDVRIPSQLNVNFAGPAAHFEHYWPPKEGTQLERGSITLWHNLNYWQLLRKEKVPVHKVGNTPLDMNQFRMLFSTCKVPGITRDSIMNYFRTESEGRSPNHIVVLCRGRAFVFDVIHEGCLVTPPELLRQLTYIHKKCHSEPDGPGIAALTSEERTRWAKAREYLIGLDPENLALLEKIQSSLLVYSMEDSSPHVTPEDYSEIIAAILIGDPTVRWGDKSYNLISFSNGVFGCNCDHAPFDAMIMVNISYYVDEKIFQNEGRWKGSEKVRDIPLPEELIFIVDEKVLNDINQAKAQYLREASDLQIAAYAFTSFGKKLTKNKMLHPDTFIQLALQLAYYRLHGHPGCCYETAMTRHFYHGRTETMRSCTVEAVRWCQSMQDPSVNLRERQQKMLQAFAKHNKMMKDCSAGKGFDRHLLGLLLIAKEEGLPVPELFTDPLFSKSGGGGNFVLSTSLVGYLRVQGVVVPMVHNGYGFFYHIRDDRFVVACSAWKSCPETDAEKLVQLTFCAFHDMIQLMNSTHL

SEQ ID NO: 840440 - protein, 612 aa, Homo sapiens
MENQLAKSTEERTFQYQDSLPSLPVPSLEESLKKYLESVKPFANQEEYKKTEEIVQKFQSGIGEKLHQKLLERAKGKRNWLEEWWLNVAYLDVRIPSQLNVNFAGPAAHFEHYWPPKEGTQLERGSITLWHNLNYWQLLRKEKVPVHKVGNTPLDMNQFRMLFSTCKVPGITRDSIMNYFRTESEGRSPNHIVVLCRGRAFVFDVIHEGCLVTPPELLRQLTYIHKKCHSEPDGPGIAALTSEERTRWAKAREYLIGLDPENLALLEKIQSSLLVYSMEDSSPHVTPEDYSEIIAAILIGDPTVRWGDKSYNLISFSNGVFGCNCDHAPFDAMIMVNISYYVDEKIFQNEGRWKGSEKVRDIPLPEELIFIVDEKVLNDINQAKAQYLREASDLQIAAYAFTSFGKKLTKNKMLHPDTFIQLALQLAYYRLHGHPGCCYETAMTRHFYHGRTETMRSCTVEAVRWCQSMQDPSVNLRERQQKMLQAFAKHNKMMKDCSAGKGFDRHLLGLLLIAKEEGLPVPELFTDPLFSKSGGGGNFVLSTSLVGYLRVQGVVVPMVHNGYGFFYHIRDDRFVVACSAWKSCPETDAEKLVQLTFCAFHDMIQLMNSTHL

SEQ ID NO: 840441 - protein, 228 aa, Homo sapiens
MENQLAKSTEERTFQYQDSLPSLPVPSLEESLKKYLESVKPFANQEEYKKTEEIVQKFQSGIGEKLHQKLLERAKGKRNWLEEWWLNVAYLDVRIPSQLNVNFAGPAAHFEHYWPPKEGTQLERGSITLWHNLNYWQLLRKEKVPVHKVGNTPLDMNQFRMLFSTCKVPGITRDSIMNYFRTESEGRSPNHIVVLCRGRAFVFDVIHEGCLVTPPELLRFSDYFLEFH

SEQ ID NO: 840442 - protein, 612 aa, Homo sapiens; identical to SEQ ID NO: 840440

SEQ ID NO: 840443 - protein, 397 aa, Homo sapiens
MENQLAKSTEERTFQYQDSLPSLPVPSLEESLKKYLESVKPFANQEEYKKTEEIVQKFQSGIGEKLHQKLLERAKGKRNWLEEWWLNVAYLDVRIPSQLNVNFAGPAAHFEHYWPPKEGTQLERGSITLWHNLNYWQLLRKEKVPVHKVGNTPLDMNQFRMLFSTCKVPGITRDSIMNYFRTESEGRSPNHIVVLCRGRAFVFDVIHEGCLVTPPELLRQLTYIHKKCHSEPDGPGIAALTSEERTRWAKAREYLIGLDPENLALLEKIQSSLLVYSMEDSSPHVTPEDYSEIIAAILIGDPTVRWGDKSYNLISFSNGVFGCNCDHAPFDAMIMVNISYYVDEKIFQNEGRWKGSEKVRDIPLPEELIFIVDEKVLNDINQAKAQYLREVYFSLFS

SEQ ID NO: 840444 - protein, 119 aa, Homo sapiens
MGPSRMMGHKWRWSRGPWEHRGPQSSPGVGKQLLRWVLRDEQASGAAEASILGRGTWRMQGQQDNWPRVHELLAEVWCPACGLGSKDEAGGVGSQTEKCLGRHAGSKSSAKVTGHHVRL

SEQ ID NO: 840445 - protein, 46 aa, Homo sapiens
GSFYVPAEPKLAFVIRVRGINGVSPKVQKVLQLLRLHQIFNGTLVK

SEQ ID NO: 840446 - protein, 76 aa, Homo sapiens
PSRSLGDAWCKSSSQCREMWVCKEKAGLCGPNRTDCEWAIPPRRGIKSNNVAAEPVWYHTLYWTYSSVKFLLLKEK

SEQ ID NO: 840447 - protein, 138 aa, Homo sapiens
MVPNPYTLLSSIPSSTTHYSILDVKDAFFTIPLHPLSQPLFAFTWTDADTHQSQQLYCHKASGTGLFTSAKLFLMIYFISTPLLLILFNILMTFYFVAPPLSLLNKISSCSFNIYSPKDIKYPPPKLKFLLHRLPALA

SEQ ID NO: 840448 - protein, 72 aa, Homo sapiens
SSLEVCGVRSHLGDRICPAADSGDVFRSGHEDRDGDHENKPSKAITTITAKLHELLTNFKSDTHCAHEDSIL

SEQ ID NO: 840449 - protein, 78 aa, Homo sapiens
KLLNHPCYLPLHQPYPNNHHLLADFNYKPNLTQSQSSPVIKRYPVLLRHHWLTAKALFVHIHPPPPQGGHMIAQAVPA

SEQ ID NO: 840450 - protein, 654 aa, Homo sapiens
MYKWAKPKICSEDLEGAVKLPASGVKTHCPPCNPGFFKTNNSTCQPCPYGSYSNGSDCTRCPAGTEPAVGFEYKWWNTLPTNMETTVLSGINFEYKGMTGWEVAGDHIYTAAGASDNDFMILTLVVPGFRPPQSVMADTENKEVARITFVFETLCSVNCELYFMVGVNSRTNTPVETWKGSKGKQSYTYIIEENTTTSFTWAFQRTTFHEASRKYTNDVAKIYSINVTNVMNGVASYCRPCALEASDVGSSCTSCPAGYYIDRDSGTCHSCPPNTILKAHQPYGVQACVPCGPGTKNNKIHSLCYNDCTFSRNTPTRTFNYNFSALANTVTLAGGPSFTSKGLKYFHHFTLSLCGNQGRKMSVCTDNVTDLRIPEGESGFSKSITAYVCQAVIIPPEVTGYKAGVSSQPVSLADRLIGVTTDMTLDGITSPAELFHLESLGIPDVIFFYRSNDVTQSCSSGRSTTIRVRCSPQKTVPGSLLLPGTCSDGTCDGCNFHFLWESAAACPLCSVADYHAIVSSCVAGIQKTTYVWREPKLCSGGISLPEQRVTICKTIDFWLKVGISAGTCTAILLTVLTCYFWKKNQKLEYKYSKLVMNATLKDCDLPAADSCAIMEGEDVEDDLIFTSKKSLFGKIKSFTSKQPAPVTISLSEDS

SEQ ID NO: 840451 - protein, 663 aa, Homo sapiens
MYKWAKPKICSEDLEGAVKLPASGVKTHCPPCNPGFFKTNNSTCQPCPYGSYSNGSDCTRCPAGTEPAVGFEYKWWNTLPTNMETTVLSGINFEYKGMTGWEVAGDHIYTAAGASDNDFMILTLVVPGFRPPQSVMADTENKEVARITFVFETLCSVNCELYFMVGVNSRTNTPVETWKGSKGKQSYTYIIEENTTTSFTWAFQRTTFHEASRKYTNDVAKIYSINVTNVMNGVASYCRPCALEASDVGSSCTSCPAGYYIDRDSGTCHSCPPNTILKAHQPYGVQACVPCGPGTKNNKIHSLCYNDCTFSRNTPTRTFNYNFSALANTVTLAGGPSFTSKGLKYFHHFTLSLCGNQGRKMSVCTDNVTDLRIPEGESGFSKSITAYVCQAVIIPPEVTGYKAGVSSQPVSLADRLIGVTTDMTLDGITSPAELFHLESLGIPDVIFFYRSNDVTQSCSSGRSTTIRVRCSPQKTVPGSLLLPGTCSDGTCDGCNFHFLWESAAACPLCSVADYHAIVSSCVAGIQKTTYVWREPKLCSGGISLPEQRVTICKTIDFWLKVGISAGTCTAILLTVLTCYFWKKNQKLEYKYSKLVMNATLKDCDLPAADSCAIMEGEDVEDDLIFTSKKSLFGKIKSFTSKRTPDGFDSVPLKTSSGGPDMDL

SEQ ID NO: 840452 - protein, 663 aa, Homo sapiens; identical to SEQ ID NO: 840451

SEQ ID NO: 840453 - protein, 594 aa, Homo sapiens
MYKWAKPKICSEDLEGAVKLPASGVKTHCPPCNPGFFKTNNSTCQPCPYGSYSNGSDCTRCPAGTEPAVGFEYKWWNTLPTNMETTVLSGINFEYKGMTGWEVAGDHIYTAAGASDNDFMILTLVVPGFRPPQSVMADTENKEVARITFVFETLCSVNCELYFMVGVNSRTNTPVETWKGSKGKQSYTYIIEENTTTSFTWAFQRTTFHEASRKYTNDVAKIYSINVTNVMNGVASYCRPCALEASDVGSSCTSCPAGYYIDRDSGTCHSCPPNTILKAHQPYGVQACVPCGPGTKNNKIHSLCYNDCTFSRNTPTRTFNYNFSALANTVTLAGGPSFTSKGLKYFHHFTLSLCGNQGRKMSVCTDNVTDLRIPEGESGFSKSITAYVCQAVIIPPEVTGYKAGVSSQPVSLADRLIGVTTDMTLDGITSPAELFHLESLGIPDVIFFYRSNDVTQSCSSGRSTTIRVRCSPQKTVPGSLLLPGTCSDGTCDGCNFHFLWESAAACPLCSVADYHAIVSSCVAGIQKTTYVWREPKLCSGGISLPEQRVTICKTIDFWLKVGISAGTCTAILLTVLTCYFWKKNQKYMLRYWSV

SEQ ID NO: 840454 - protein, 663 aa, Homo sapiens; identical to SEQ ID NO: 840451

SEQ ID NO: 840455 - protein, 691 aa, Homo sapiens
MYKWAKPKICSEDLEGAVKLPASGVKTHCPPCNPGFFKTNNSTCQPCPYGSYSNGSDCTRCPAGTEPAVGFEYKWWNTLPTNMETTVLSGINFEYKGMTGWEVAGDHIYTAAGASDNDFMILTLVVPGFRPPQSVMADTENKEVARITFVFETLCSVNCELYFMVGVNSRTNTPVETWKGSKGKQSYTYIIEENTTTSFTWAFQRTTFHEASRKYTNDVAKIYSINVTNVMNGVASYCRPCALEASDVGSSCTSCPAGYYIDRDSGTCHSCPPNTILKAHQPYGVQACVPCGPGTKNNKTGEKTATLGCRPSRPFLTSWPDPSLSPQIHSLCYNDCTFSRNTPTRTFNYNFSALANTVTLAGGPSFTSKGLKYFHHFTLSLCGNQGRKMSVCTDNVTDLRIPEGESGFSKSITAYVCQAVIIPPEVTGYKAGVSSQPVSLADRLIGVTTDMTLDGITSPAELFHLESLGIPDVIFFYRSNDVTQSCSSGRSTTIRVRCSPQKTVPGSLLLPGTCSDGTCDGCNFHFLWESAAACPLCSVADYHAIVSSCVAGIQKTTYVWREPKLCSGGISLPEQRVTICKTIDFWLKVGISAGTCTAILLTVLTCYFWKKNQKLEYKYSKLVMNATLKDCDLPAADSCAIMEGEDVEDDLIFTSKKSLFGKIKSFTSKRTPDGFDSVPLKTSSGGPDMDL

SEQ ID NO: 840456 - protein, 331 aa, Homo sapiens
MYKWAKPKICSEDLEGAVKLPASGVKTHCPPCNPGFFKTNNSTCQPCPYGSYSNGSDCTRCPAGTEPAVGFEYKWWNTLPTNMETTVLSGINFEYKGMTGWEVAGDHIYTAAGASDNDFMILTLVVPGFRPPQSVMADTENKEVARITFVFETLCSVNCELYFMVGVNSRTNTPVETWKGSKGKQSYTYIIEENTTTSFTWAFQRTTFHEASRKYTNDVAKIYSINVTNVMNGVASYCRPCALEASDVGSSCTSCPAGYYIDRDSGTCHSCPPNTILKAHQPYGVQACVPCGPGTKNNKITFGLRIDFYSKLNQDLLHFPFGITFVFADRT

SEQ ID NO: 840457 - protein, 104 aa, Homo sapiens
LCCNDSLNFHRYTDFRKYNFKDKLYLFFSITHGYSERLPFIDGVLPCHSGWSAVAQSLLTASLCLPGSSGSSASASWTAGIKGTRHQTSASWTAGITDHFLAFG

SEQ ID NO: 840458 - protein, 554 aa, Homo sapiens
MPLPWSLALPLLLSWVAGGFGNAASARHHGLLASARQPGVCHYGTKLACCYGWRRNSKGVCEATCEPGCKFGECVGPNKCRCFPGYTGKTCSQDVNECGMKPRPCQHRCVNTHGSYKCFCLSGHMLMPDATCVNSRTCAMINCQYSCEDTEEGPQCLCPSSGLRLAPNGRDCLDIDECASGKVICPYNRRCVNTFGSYYCKCHIGFELQYISGRYDCIDINECTMDSHTCSHHANCFNTQGSFKCKCKQGYKGNGLRCSAIPENSVKEVLRAPGTIKDRIKKLLAHKNSMKKKAKIKNVTPEPTRTPTPKVNLQPFNYEEIVSRGGNSHGGKKGNEEKMKEGLEDEKREEKALKNDIEERSLRGDVFFPKVNEAGEFGLILVQRKALTSKLEHKADLNISVDCSFNHGICDWKQDREDDFDWNPADRDNAIGFYMAVPALAGHKKDIGRLKLLLPDLQPQSNFCLLFDYRLAGDKVGKLRVFVKNSNNALAWEKTTSEDEKWKTGKIQLYQGTDATKSIIFEAERGKGKTGEIAVDGVLLVSGLCPDSLLSVDD

SEQ ID NO: 840459 - protein, 437 aa, Homo sapiens
MPLPWSLALPLLLSWVAGGFGNAASARHHGLLASARQPGVCHYGTKLACCYGWRRNSKGVCEATCEPGCKFGECVGPNKCRCFPGYTGKTCSQDVNECGMKPRPCQHRCVNTHGSYKCFCLSGHMLMPDATCVNSRTCAMINCQYSCEDTEEGPQCLCPSSGLRLAPNGRDCLDIDECASGKVICPYNRRCVNTFGSYYCKCHIGFELQYISGRYDCIDINECTMDSHTCSHHANCFNTQGSFKCKCKQGYKGNGLRCSAIPENSVKEVLRAPGTIKDRIKKLLAHKNSMKKKAKIKNVTPEPTRTPTPKVNLQPFNYEEIVSRGGNSHGGKKGNEEKMKEGLEDEKREEKALKNDIEERSLRGDVFFPKVNEAGEFGLILVQRKALTSKLEHKADLNISVDCSFNHGICDWKQDREDDFDWNPADRDNELYHIGSP

SEQ ID NO: 840460 - protein, 566 aa, Homo sapiens
MPLPWSLALPLLLSWVAGGFGNAASARHHGLLASARQPGVCHYGTKLACCYGWRRNSKGVCEATCEPGCKFGECVGPNKCRCFPGYTGKTCSQDVNECGMKPRPCQHRCVNTHGSYKCFCLSGHMLMPDATCVNSRTCAMINCQYSCEDTEEGPQCLCPSSGLRLAPNGRDCLDIDECASGKVICPYNRRCVNTFGSYYCKCHIGFELQYISGRYDCIDINECTMDSHTCSHHANCFNTQGSFKCKCKQGYKGNGLRCSAIPENSVKEVLRAPGTIKDRIKKLLAHKNSMKKKAKIKNVTPEPTRTPTPKVNLQPFNYEEIVSRGGNSHGGKKGNEEKMKEGLEDEKREEKALKNDIEERSLRGDVFFPKVNEAGEFGLILVQRKALTSKLEHKADLNISVDCSFNHGICDWKQDREDDFDWNPADRDNAIGFYMAVPALAGHKKDIGRLKLLLPDLQPQSNFCLLFDYRLAGDKVGKLRVFVKNSNNALAWEKTTSEDEKWKTGKIQLYQGTDATKSTCPQRAWPAITLEHSSAFIRGILRPRHLFLEFFSSRGNLDGGILKDHF

SEQ ID NO: 840461 - protein, 68 aa, Homo sapiens
RVSELGRCSEAPKLVGNISSCSYCVGDNHFCCKSRPVVSQYLRTPTSALPNYEPYPASIPSPTLPLAH

SEQ ID NO: 840462 - protein, 256 aa, Homo sapiens
MPPAQGYEFAAAKGPRDELGPSFPMASPPGLELKTLSNGPQAPRRSAPLGPVAPTREGVENACFSSEEHETHFQNPGNTRLGSSPSPPGGVSSLPRSQRDDLSLHSEEGPALEPVSRPVDYGFVSALVFLVSGILLVVTAYAIPREARVNPDTVTAREMERLEMYYARLGSHLDRCIIAGLGLLTVGGMLLSVLLMVSLCKGELYRRRTFVPGKGSRKTYGSINLRMRQLNGDGGQALVENEVVQVSETSHTLQRS

SEQ ID NO: 840463 - protein, 256 aa, Homo sapiens; identical to SEQ ID NO: 840462

SEQ ID NO: 840464 - protein, 344 aa, Homo sapiens
RPPPPPYSSARREQVRAPRQWLRAGPGRGRETGRARRWRPGPRPPGCAAGERPPQARPPQAYAGCRKADGHRRGRTLARRRPGALRPSVVRRGGRPGTAAKGPRDELGPSFPMASPPGLELKTLSNGPQAPRRSAPLGPVAPTREGVENACFSSEEHETHFQNPGNTRLGSSPSPPGGVSSLPRSQRDDLSLHSEEGPALEPVSRPVDYGFVSALVFLVSGILLVVTAYAIPREARVNPDTVTAREMERLEMYYARLGSHLDRCIIAGLGLLTVGGMLLSVLLMVSLCKGELYRRRTFVPGKGSRKTYGSINLRMRQLNGDGGQALVENEVVQVSETSHTLQRS

SEQ ID NO: 840465 - protein, 131 aa, Homo sapiens [sequence omitted]

SEQ ID NO: 840466 - protein, 365 aa, Homo sapiens
MNIMDFNVKKLAADAGTFLSRAVQFTEEKLGQAEKTELDAHLENLLSKAECTKIWTEKIMKQTEVLLQPNPNARIEEFVYEKLDRKAPSRINNPELLGQYMIDAGTEFGPGTAYGNALIKCGETQKRIGTADRELIQTSALNFLTPLRNFIEGDYKTIAKERKLLQNKRLDLDAAKTRLKKAKAAETRNSSEQELRITQSEFDRQAEITRLLLEGISSTHAHHLRCLNDFVEAQMTYYAQCYQYMLDLQKQLGSFPSNYLSNNNQTSVTPVPSVLPNAIGSSAMASTSGLVITSPSNLSDLKECSGSRKARVLYDYDAANSTELSLLADEVITVFSVVGMDSDWLMGERGNQKGKVPITYLELLN

SEQ ID NO: 840467 - protein, 365 aa, Homo sapiens; identical to SEQ ID NO: 840466

SEQ ID NO: 840468 - protein, 265 aa, Homo sapiens
MIDAGTEFGPGTAYGNALIKCGETQKRIGTADRELIQTSALNFLTPLRNFIEGDYKTIAKERKLLQNKRLDLDAAKTRLKKAKAAETRNSSEQELRITQSEFDRQAEITRLLLEGISSTHAHHLRCLNDFVEAQMTYYAQCYQYMLDLQKQLGSFPSNYLSNNNQTSVTPVPSVLPNAIGSSAMASTSGLVITSPSNLSDLKECSGSRKARVLYDYDAANSTELSLLADEVITVFSVVGMDSDWLMGERGNQKGKVPITYLELLN

SEQ ID NO: 840469 - protein, 131 aa, Homo sapiens [sequence omitted]

SEQ ID NO: 840470 - protein, 326 aa, Homo sapiens
MNIMDFNVKKLAADAGTFLSRAVQFTEEKLGQAEKTELDAHLENLLSKAECTKIWTEKIMKQTEVLLQPNPNARIEEFVYEKLDRKAPSRINNPELLGQYMIDAGTEFGPGTAYGNALIKCGETQKRIGTADRELIQTSALNFLTPLRNFIEGDYKTIAKERKLLQNKRLDLDAAKTRLKKAKAAETRNSSEQELRITQSEFDRQAEITRLLLEGISSTHAHHLRCLNDFVEAQMTYYAQCYQYMLDLQKQLGSFPSNYLSNNNQTSVTPVPSVLPNAIGFRLANGGKGKPEGQGANYLLRTAQLSRWTMERLPIMTLYLYTINSK

SEQ ID NO: 840471 - protein, 365 aa, Homo sapiens; identical to SEQ ID NO: 840466

SEQ ID NO: 840472 - protein, 202 aa, Homo sapiens
MNIMDFNVKKLAADAGTFLSRAVQFTEEKLGQAEKTELDAHLENLLSKAECTKIWTEKIMKQTEVLLQPNPNARIEEFVYEKLDRKAPSRINNPELLGQYMIDAGTEFGPGTAYGNALIKCGETQKRIGTADRELIQTSALNFLTPLRNFIEGDYKTIAKERKLLQNKRLDLDAAKTRLKKAKLANLKFICQNLNYLREFFR

SEQ ID NO: 840473 - protein, 195 aa, Homo sapiens
MNIMDFNVKKLAADAGTFLSRAVQFTEEKLGQAEKTELDAHLENLLSKAECTKIWTEKIMKQTEVLLQPNPNARIEEFVYEKLDRKAPSRINNPELLGQYMIDAGTEFGPGTAYGNALIKCGETQKRIGTADRELIQTSALNFLTPLRNFIEGDYKTIAKERKLLQNKRLDLDAAKTRLKKAKAAETRNSSGTRN

SEQ ID NO: 840474 - protein, 365 aa, Homo sapiens; identical to SEQ ID NO: 840466

SEQ ID NO: 840475 - protein, 386 aa, Homo sapiens
MNIMDFNVKKLAADAGTFLSRAVQFTEEKLGQAEKTELDAHLENLLSKAECTKIWTEKIMKQTEVLLQPNPNARIEEFVYEKLDRKAPSRINNPELLGQYMIDAGTEFGPGTAYGNALIKCGETQKRIGTADRELIQTSALNFLTPLRNFIEGDYKTIAKERKLLQNKRLDLDAAKTRLKKAKAAETRNSQLNSARLEGDNIMIWAEEVTKSEQELRITQSEFDRQAEITRLLLEGISSTHAHHLRCLNDFVEAQMTYYAQCYQYMLDLQKQLGSFPSNYLSNNNQTSVTPVPSVLPNAIGSSAMASTSGLVITSPSNLSDLKECSGSRKARVLYDYDAANSTELSLLADEVITVFSVVGMDSDWLMGERGNQKGKVPITYLELLN

SEQ ID NO: 840476 - protein, 266 aa, Homo sapiens
MEGLGRVTDTDDMRGERGTAGKEALALGAVFCEVDSELSHLWRTKMEAWVGKKKGIKTIAKERKLLQNKRLDLDAAKTRLKKAKAAETRNSSEQELRITQSEFDRQAEITRLLLEGISSTHAHHLRCLNDFVEAQMTYYAQCYQYMLDLQKQLGSFPSNYLSNNNQTSVTPVPSVLPNAIGSSAMASTSGLVITSPSNLSDLKECSGSRKARVLYDYDAANSTELSLLADEVITVFSVVGMDSDWLMGERGNQKGKVPITYLELLN

SEQ ID NO: 840477 - protein, 234 aa, Homo sapiens
MNIMDFNVKKLAADAGTFLSRAVQFTEEKLGQAEKTELDAHLENLLSKAECTKIWTEKIMKQTEVLLQPNPNARIEEFVYEKLDRKAPSRINNPELLGQYMIDAGTEFGPGTAYGNALIKCGETQKRIGTADRELIQTSALNFLTPLRNFIEGDYKTIAKERKLLQNKRLDLDAAKTRLKKAKAAETRNSSEQELRITQSEFDRQAEITRLLLEGISSTHAHHLRCLNDFVEPL

SEQ ID NO: 840478 - protein, 254 aa, Homo sapiens
MNIMDFNVKKLAADAGTFLSRAVQFTEEKLGQAEKTELDAHLENLLSKAECTKIWTEKIMKQTEVLLQPNPNARIEEFVYEKLDRKAPSRINNPELLGQYMIDAGTEFGPGTAYGNALIKCGETQKRIGTADRELIQTSALNFLTPLRNFIEGDYKTIAKERKLLQNKRLDLDAAKTRLKKAKAAETRNSSEQELRITQSEFDRQAEITRLLLEGISSTHAHHLRCLNDFVEAQMTYYAQCYQYMLDLQKQLGR

SEQ ID NO: 840479 - protein, 749 aa, Homo sapiens
GSASGPAGLTSVQSALKAPGLAGCFPSSQHLRGSYHHPSYRRGSRGFVKCPTEEALIYEPGALSPETMLRGSYDHDLATLSLWGYTAFSLHLQGSDSIQRPGPAPKSTPDPSLGQGDFSSFGTQQDTAAVRVSKRMLAGGVRSMPSPLLACWQPILLLVLGSVLSGSATGCPPRCECSAQDRAVLCHRKRFVAVPEGIPTETRLLDLGKNRIKTLNQDEFASFPHLEELELNENIVSAVEPGAFNNLFNLRTLGLRSNRLKLIPLGVFTGLSNLTKLDISENKIVILLDYMFQDLYNLKSLEVGDNDLVYISHRAFSGLNSLEQLTLEKCNLTSIPTEALSHLHGLIVLRLRHLNINAIRDYSFKRLYRLKVLEISHWPYLDTMTPNCLYGLNLTSLSITHCNLTAVPYLAVRHLVYLRFLNLSYNPISTIEGSMLHELLRLQEIQLVGGQLAVVEPYAFRGLNYLRVLNVSGNQLTTLEESVFHSVGNLETLILDSNPLACDCRLLWVFRRRWRLNFNRQQPTCATPEFVQGKEFKDFPDVLLPNYFTCRRARIRDRKAQQVFVDEGHTVQFVCRADGDPPPAILWLSPRKHLVSAKSNGRLTVFPDGTLEVRYAQVQDNGTYLCIAANAGGNDSMPAHLHVRSYSPDWPHQPNKTFAFISNQPGEGEANSTRATVPFPFDIKTLIIATTMGFISFLGVVLFCLVLLFLWSRGKGNTKHNIEIEYVPRKSDAGISSADAPRKFNMKMI

SEQ ID NO: 840480 - protein, 764 aa, Homo sapiens
ADYTEIFSLIEADRSFRAVMYSGFKLCSFLSLNSQIKGSLPSPPCAGACDLDCNDGGSYDHDLATLSLWGYTAFSLHLQGSDSIQRPGPAPKSTPDPSLGQGDFSSFGTQQDTAASQVHAGTATDRLADPRPPEASLFASQRHLTQVSKRMLAGGVRSMPSPLLACWQPILLLVLGSVLSGSATGCPPRCECSAQDRAVLCHRKRFVAVPEGIPTETRLLDLGKNRIKTLNQDEFASFPHLEELELNENIVSAVEPGAFNNLFNLRTLGLRSNRLKLIPLGVFTGLSNLTKLDISENKIVILLDYMFQDLYNLKSLEVGDNDLVYISHRAFSGLNSLEQLTLEKCNLTSIPTEALSHLHGLIVLRLRHLNINAIRDYSFKRLYRLKVLEISHWPYLDTMTPNCLYGLNLTSLSITHCNLTAVPYLAVRHLVYLRFLNLSYNPISTIEGSMLHELLRLQEIQLVGGQLAVVEPYAFRGLNYLRVLNVSGNQLTTLEESVFHSVGNLETLILDSNPLACDCRLLWVFRRRWRLNFNRQQPTCATPEFVQGKEFKDFPDVLLPNYFTCRRARIRDRKAQQVFVDEGHTVQFVCRADGDPPPAILWLSPRKHLVSAKSNGRLTVFPDGTLEVRYAQVQDNGTYLCIAANAGGNDSMPAHLHVRSYSPDWPHQPNKTFAFISNQPGEGEANSTRATVPFPFDIKTLIIATTMGFISFLGVVLFCLVLLFLWSRGKGNTKHNIEIEYVPRKSDAGISSADAPRKFNMKMI

SEQ ID NO: 840481 - protein, 646 aa, Homo sapiens
PGWYAPEVWDPEPRPRLRLGSRPRGADRRTASPARARGLPGGGVGGGGNGGGGWAGAGAWSGRLERHAIGDRAERTEGAPEMQVSKRMLAGGVRSMPSPLLACWQPILLLVLGSVLSGSATGCPPRCECSAQDRAVLCHRKRFVAVPEGIPTETRLLDLGKNRIKTLNQDEFASFPHLEELELNENIVSAVEPGAFNNLFNLRTLGLRSNRLKLIPLGVFTGLSNLTKLDISENKIVILLDYMFQDLYNLKSLEVGDNDLVYISHRAFSGLNSLEQLTLEKCNLTSIPTEALSHLHGLIVLRLRHLNINAIRDYSFKRLYRLKVLEISHWPYLDTMTPNCLYGLNLTSLSITHCNLTAVPYLAVRHLVYLRFLNLSYNPISTIEGSMLHELLRLQEIQLVGGQLAVVEPYAFRGLNYLRVLNVSGNQLTTLEESVFHSVGNLETLILDSNPLACDCRLLWVFRRRWRLNFNRQQPTCATPDILWLSPRKHLVSAKSNGRLTVFPDGTLEVRYAQVQDNGTYLCIAANAGGNDSMPAHLHVRSYSPDWPHQPNKTFAFISNQPGEGEANSTRATVPFPFDIKTLIIATTMGFISFLGVVLFCLVLLFLWSRGKGNTKHNIEIEYVPRKSDAGISSADAPRKFNMKMI

SEQ ID NO: 840482 - protein, 634 aa, Homo sapiens
PGWYAPEVWDPEPRPRLRLGSRPRGADRRTASPARARGLPGGGVGGGGNGGGGWAGAGAWSGRLERHAIGDRAERTEGAPEMQVSKRMLAGGVRSMPSPLLACWQPILLLVLGSVLSGSATGCPPRCECSAQDRAVLCHRKRFVAVPEGIPTETRLLDLGKNRIKTLNQDEFASFPHLEELELNENIVSAVEPGAFNNLFNLRTLGLRSNRLKLIPLGVFTGLSNLTKLDISENKIVILLDYMFQDLYNLKSLEVGDNDLVYISHRAFSGLNSLEQLTLEKCNLTSIPTEALSHLHGLIVLRLRHLNINAIRDYSFKRLYRLKVLEISHWPYLDTMTPNCLYGLNLTSLSITHCNLTAVPYLAVRHLVYLRFLNLSYNPISTIEGSMLHELLRLQEIQLVGGQLAVVEPYAFRGLNYLRVLNVSGNQLTTLEESVFHSVGNLETLILDSNPLACDCRLLWVFRRRWRLNFNRQQPTCATPEFVQGKEFKDFPDVLLPNYFTCRRARIRDRKAQQVFVDEGHTVQFVCRADGDPPPAILWLSPRKHLVSAKSNGRLTVFPDGTLEVRYAQVQDNGTYLCIAANAGGNDSMPAHLHVRSYSPDWPHQPNKTFAFISNQPGEGEANSTRATVPFPST

SEQ ID NO: 840483 - protein, 701 aa, Homo sapiens
PGWYAPEVWDPEPRPRLRLGSRPRGADRRTASPARARGLPGGGVGGGGNGGGGWAGAGAWSGRLERHAIGDRAERTEGAPEMQVSKRMLAGGVRSMPSPLLACWQPILLLVLGSVLSGSATGCPPRCECSAQDRAVLCHRKRFVAVPEGIPTETRLLDLGKNRIKTLNQDEFASFPHLEELELNENIVSAVEPGAFNNLFNLRTLGLRSNRLKLIPLGVFTGLSNLTKLDISENKIVILLDYMFQDLYNLKSLEVGDNDLVYISHRAFSGLNSLEQLTLEKCNLTSIPTEALSHLHGLIVLRLRHLNINAIRDYSFKRLYRLKVLEISHWPYLDTMTPNCLYGLNLTSLSITHCNLTAVPYLAVRHLVYLRFLNLSYNPISTIEGSMLHELLRLQEIQLVGGQLAVVEPYAFRGLNYLRVLNVSGNQLTTLEESVFHSVGNLETLILDSNPLACDCRLLWVFRRRWRLNFNRQQPTCATPEFVQGKEFKDFPDVLLPNYFTCRRARIRDRKAQQVFVDEGHTVQFVCRADGDPPPAILWLSPRKHLVSAKSNGRLTVFPDGTLEVRYAQVQDNGTYLCIAANAGGNDSMPAHLHVRSYSPDWPHQPNKTFAFISNQPGEGEANSTRATVPFPFDIKTLIIATTMGFISFLGVVLFCLVLLFLWSRGKGNTKHNIEIEYVPRKSDAGISSADAPRKFNMKMI

SEQ ID NO: 840484 - protein, 699 aa, Homo sapiens
PGWYAPEVWDPEPRPRLRLGSRPRGADRRTASPARARGLPGGGVGGGGNGGGGWAGAGAWSGRLERHAIGDRAERTEGAPEMQVSKRMLAGGVRSMPSPLLACWQPILLLVLGSVLSGSATGCPPRCECSAQDRAVLCHRKRFVAVPEGIPTETRLLDLGKNRIKTLNQDEFASFPHLEELELNENIVSAVEPGAFNNLFNLRTLGLRSNRLKLIPLGVFTGLSNLTKLDISENKIVILLDYMFQDLYNLKSLEVGDNDLVYISHRAFSGLNSLEQLTLEKCNLTSIPTEALSHLHGLIVLRLRHLNINAIRDYSFKRLYRLKVLEISHWPYLDTMTPNCLYGLNLTSLSITHCNLTAVPYLAVRHLVYLRFLNLSYNPISTIEGSMLHELLRLQEIQLVGGQLAVVEPYAFRGLNYLRVLNVSGNQLTTLEESVFHSVGNLETLILDSNPLACDCRLLWVFRRRWRLNFNRQQPTCATPEFVQGKEFKDFPDVLLPNYFTCRRARIRDRKAQQVFVDEGHTVQFVCRADGDPPPAILWLSPRKHLVSAKSNGRLTVFPDGTLEVRYAQVQDNGTYLCIAANAGGNDSMPAHLHVRSYSPDWPHQPNKTFAFISNQPGEGEANSTRATVPFPFDIKTLIIATTMGFISFLGVVLFCLVLLFLWSRGKGNTKHNIEIEYLPSFYQDLRSPDLGTPPTQGH

SEQ ID NO: 840485 - protein, 435 aa, Homo sapiens
MMKRQLHRMRQLAQTGSLGRTPETAEFLGEDLLQVEQRLEPAKRAAHNIHKRLQACLQGQSGADMDKRVKKLPLMALSTTMAESFKELDPDSSMGKALEMSCAIQNQLARILAEFEMTLERDVLQPLSRLSEEELPAILKHKKSLQKLVSDWNTLKSRLSQATKNSGSSQGLGGSPGSHSHTTMANKVETLKEEEEELKRKVEQCRDEYLADLYHFVTKEDSYANYFIRLLEIQADYHRRSLSSLDTALAELRENHGQADHSPSMTATHFPRVYGVSLATHLQELGREIALPIEACVMMLLSEGMKEEGLFRLAAGASVLKRLKQTMASDPHSLEEFCSDPHAVAGALKSYLRELPEPLMTFDLYDDWMRAASLKEPGARLQALQEVCSRLPPENLSNLRYLMKFLARLAEEQEVNKMTPSNIAIVLGPTLAVAT

SEQ ID NO: 840486 - protein, 701 aa, Homo sapiens
MMKRQLHRMRQLAQTGSLGRTPETAEFLGEDLLQVEQRLEPAKRAAHNIHKRLQACLQGQSGADMDKRVKKLPLMALSTTMAESFKELDPDSSMGKALEMSCAIQNQLARILAEFEMTLERDVLQPLSRLSEEELPAILKHKKSLQKLVSDWNTLKSRLSQATKNSGSSQGLGGSPGSHSHTTMANKVETLKEEEEELKRKVEQCRDEYLADLYHFVTKEDSYANYFIRLLEIQADYHRRSLSSLDTALAELRENHGQADHSPSMTATHFPRVYGVSLATHLQELGREIALPIEACVMMLLSEGMKEEGLFRLAAGASVLKRLKQTMASDPHSLEEFCSDPHAVAGALKSYLRELPEPLMTFDLYDDWMRAASLKEPGARLQALQEVCSRLPPENLSNLRYLMKFLARLAEEQEVNKMTPSNIAIVLGPNLLWPPEKEGDQAQLDAASVSSIQVVGVVEALIQSADTLFPGDINFNVSGLFSAVTLQDTVSDRLASEELPSTAVPTPATTPAPAPAPAPAPAPALASAATKERTESEVPPRPASPKVTRSPPETAAPVEDMARRTKRPAPARPTMPPPQVSGSRSSPPAPPLPPGSGSPGTPQALPRRLVGSSLRAPTVPPPLPPTPPQPARRQSRRSPASPSPASPGPASPSPVSLSNPAQVDLGAATAEGGAPEAISGVPTPPAIPPQPRPRSLASETN

SEQ ID NO: 840487 - protein, 574 aa, Homo sapiens
KLRLVEAGGESAEDKKSLQKLVSDWNTLKSRLSQATKNSGSSQGLGGSPGSHSHTTMANKVETLKEEEEELKRKVEQCRDEYLADLYHFVTKEDSYANYFIRLLEIQADYHRRSLSSLDTALAELRENHGQADHSPSMTATHFPRVYGVSLATHLQELGREIALPIEACVMMLLSEGMKEEGLFRLAAGASVLKRLKQTMASDPHSLEEFCSDPHAVAGALKSYLRELPEPLMTFDLYDDWMRAASLKEPGARLQALQEVCSRLPPENLSNLRYLMKFLARLAEEQEVNKMTPSNIAIVLGPNLLWPPEKEGDQAQLDAASVSSIQVVGVVEALIQSADTLFPGDINFNVSGLFSAVTLQDTVSDRLASEELPSTAVPTPATTPAPAPAPAPAPAPALASAATKERTESEVPPRPASPKVTRSPPETAAPVEDMARRTKRPAPARPTMPPPQVSGSRSSPPAPPLPPGSGSPGTPQALPRRLVGSSLRAPTVPPPLPPTPPQPARRQSRRSPASPSPASPGPASPSPVSLSNPAQVDLGAATAEGGAPEAISGVPTPPAIPPQPRPRSLASETN

SEQ ID NO: 840488 - protein, 701 aa, Homo sapiens; identical to SEQ ID NO: 840486

SEQ ID NO: 840489 - protein, 190 aa, Homo sapiens
MANKVETLKEEEEELKRKVEQCRDEYLADLYHFVTKEDSYANYFIRLLEIQADYHRRSLSSLDTALAELRENHGQADHSPSMTATHFPRVYGVSLATHLQELGREIALPIEACVMMLLSEGMKEEGLFRLAAGASVLKRLKQTMASDPHSLEEFCSDPHAVAGALKSYLRELPEPLMTFDLYDDWMRAAS

SEQ ID NO: 840490 - protein, 207 aa, Homo sapiens
MASDPHSLEEFCSDPHAVAGALKSYLRELPEPLMTFDLYDDWMRAASLKEPGARLQALQEVCSRLPPENLSNLRYLMKFLARLAEEQEVNKMTPSNIAIVLGPNLLWPPEKEGDQAQLDAASVSSIQVVGVVEALIQSADTLFPGDINFNVSGLFSAVTLQDTVSDRLASEELPSTAVPTPATTPAPAPAPAPAPAPALASAATKER

SEQ ID NO: 840491 - protein, 518 aa, Homo sapiens
MANKVETLKEEEEELKRKVEQCRDEYLADLYHFVTKEDSYANYFIRLLEIQADYHRRSLSSLDTALAELRENHGQADHSPSMTATHFPRVYGVSLATHLQELGREIALPIEACVMMLLSEGMKEEGLFRLAAGASVLKRLKQTMASDPHSLEEFCSDPHAVAGALKSYLRELPEPLMTFDLYDDWMRAASLKEPGARLQALQEVCSRLPPENLSNLRYLMKFLARLAEEQEVNKMTPSNIAIVLGPNLLWPPEKEGDQAQLDAASVSSIQVVGVVEALIQSADTLFPGDINFNVSGLFSAVTLQDTVSDRLASEELPSTAVPTPATTPAPAPAPAPAPAPALASAATKERTESEVPPRPASPKVTRSPPETAAPVEDMARRTKRPAPARPTMPPPQVSGSRSSPPAPPLPPGSGSPGTPQALPRRLVGSSLRAPTVPPPLPPTPPQPARRQSRRSPASPSPASPGPASPSPVSLSNPAQVDLGAATAEGGAPEAISGVPTPPAIPPQPRPRSLASETN

SEQ ID NO: 840492 - protein, 616 aa, Homo sapiens
MMKRQLHRMRQLAQTGSLGRTPETAEFLGEDLLQVEQRLEPAKRAAHNIHKRLQACLQGQSGADMDKRVKKLPLMALSTTMAESFKELDPDSSMGKALEMSCAIQNQLARILAEFEMTLERDVLQPLSRLSEEELPAILKHKKSLQKLVSDWNTLKSRLSQATKNSGSSQGLGGSPGSHSHTTMANKVETLKEEEEELKRKVEQCRDEYLADLYHFVTKEDSYANYFIRLLEIQADYHRRSLSSLDTALAELRENHGQADHSPSMTATHFPRVYGVSLATHLQELGREIALPIEACVMMLLSEGMKEEGLFRLAAGASVLKRLKQTMASDPHSLEEFCSDPHAVAGALKSYLRELPEPLMTFDLYDDWMRAASLKEPGARLQALQEVCSRLPPENLSNLRYLMKFLARLAEEQEVNKMTPSNIAIVLGPNLLWPPEKEGDQAQLDAASVSSIQVVGVVEALIQSADTLFPGDINFNVSGLFSAVTLQDTVSDRLASEELPSTAVPTPATTPAPAPAPAPAPAPALASAATKERTESEVPPRPASPKVTRSPPETAAPVEDMARRTKAPGASPGPPCPPHARSPSRVRSCRGLRKACASGRAGTQEEEEIIRTRWRK

SEQ ID NO: 840493 - protein, 270 aa, Homo sapiens
MMKRQLHRMRQLAQTGSLGRTPETAEFLGEDLLQVEQRLEPAKRAAHNIHKRLQACLQGQSGADMDKRVKKLPLMALSTTMAESFKELDPDSSMGKALEMSCAIQNQLARILAEFEMTLERDVLQPLSRLSEEELPAILKHKKSLQKLVSDWNTLKSRLSQATKNSGSSQGLGGSPGSHSHTTMANKVETLKEEEEELKRKVEQCRDEYLADLYHFVTKEDSYANYFIRLLEIQADYHRRSLSSLDTALAELRENHGQAGGDIGPAIPHP

SEQ ID NO: 840494 - protein, 167 aa, Homo sapiens
RRAKSLDSRTTKPSVTPDLLNFKKGWLTKQYEDSQWKKHWFVLADQSLRYYRDSVAEEAADLDGEIDLSACYDVTEYPVQRNYGFQIHTKEGEFTPSAMTSGIRRNWIQTIMKHVHPTTAPDVTSWLPEEKNKSSCSFETCPRPTEKQEAEPGEPDPEQKRSRTWER

SEQ ID NO: 840495 - protein, 634 aa, Homo sapiens [sequence omitted]

SEQ ID NO: 840496 - protein, 466 aa, Homo sapiens
MRGPNSGTEKGRLVIPEKQGFDFLCMPVFHPRFKREFIQEPAKNRPGPQTRSDLLLSGRDWNTLIVGKLSPWIRPDSKVEKIRRNSEALEVQFIITGTNHHSEKEFCSYLQYLEYLSQNRPPPNAYELFAKGYEDYLQSPLQPLMDNLESQTYEVFEKDPIKYSQYQQAIYKCLLDRVPEEEKDTNVQVLMVLGAGRGPLVNASLRAAKQADRRIKLYAVEKNPNAVVTLENWQFEEWGSQVTVVSSDMREWVAPEKADIIVSELLGSFADNELSPECLDGAQHFLKDDGVSIPGEYTSFLAPISSSKLYNEVRACREKDRDPEAQFEMPYVVRLHNFHQLSAPQPCFTFSHPNRDPMIDNNRYCTLEFPVEVNTVLHGFAGYFETVLYQDITLSIRPETHSPGMFSWFPILFPIKQPITVREGQTICVRFWRCSNSKKVWYEWAVTAPVCSAIHNPTGRSYTIGL

SEQ ID NO: 840497 - protein, 356 aa, Homo sapiens
MPYVVRLHNFHQLSAPQPCFTFSHPNRDPMIDNNRYCTLEFPVEVNTVLHGFAGYFETVLYQHFLKDDGVSIPGEYTSFLAPISSSKLYNEVRACREKDRDPGGTNHHSEKEFCSYLQYLEYLSQNRPPPNAYELFAKGYEDYLQSPLQPLMDNLESQTYEVFEKDPIKYSQYQQAIYKCLLDRVPEEEKDTNVQVLMVLGAGRGPLVNASLRAAKQADRRIKLYAVEKNPNAVVTLENWQFEEWGSQVTVVSSDMREWVAPEKADIIVSELLGSFADNELSPECLDGAQHFLKVFSWFPILFPIKQPITVREGQTICVRFWRCSNSKKVWYEWAVTAPVCSAIHNPTGRSYTIGL

SEQ ID NO: 840498 - protein, 634 aa, Homo sapiens [sequence omitted]

SEQ ID NO: 840499 - protein, 531 aa, Homo sapiens
MLQELNFGAYLGLPAFLLPLNQEDNTNLARVLTNHIHTGHHSSMFWMRVPLVAPEDLRDDIIENAPTTHTEEYSGEEKTWMWWHNFRTLCDYSKRIAVALEIGADLPSNHVIDRWLGEPIKAAILPTSIFLTNKKGFPVLSKMHQRLIFRLLKLEVQFIITGTNHHSEKEFCSYLQYLEYLSQNRPPPNAYELFAKGYEDYLQSPLQPLMDNLESQTYEVFEKDPIKYSQYQQAIYKCLLDRVPEEEKDTNVQVLMVLGAGRGPLVNASLRAAKQADRRIKLYAVEKNPNAVVTLENWQFEEWGSQVTVVSSDMREWVAPEKADIIVSELLGSFADNELSPECLDGAQHFLKDDGVSIPGEYTSFLAPISSSKLYNEVRACREKDRDPEAQFEMPYVVRLHNFHQLSAPQPCFTFSHPNRDPMIDNNRYCTLEFPVEVNTVLHGFAGYFETVLYQDITLSIRPETHSPGMFSWFPILFPIKQPITVREGQTICVRFWRCSNSKKVWYEWAVTAPVCSAIHNPTGRSYTIGL

SEQ ID NO: 840500 - protein, 620 aa, Homo sapiens
MRGPNSGTEKGRLVIPEKQGFDFLCMPVFHPRFKREFIQEPAKNRPGPQTRSDLLLSGRDWNTLIVGKLSPWIRPDSKVEKIRRNSEAAMLQELNFGAYLGLPAFLLPLNQEDNTNLARVLTNHIHTGHHSSMFWMRVPLVAPEDLRDDIIENAPTTHTEEYSGEEKTWMWWHNFRTLCDYSKRIAVALEIGADLPSNHVIDRWLGEPIKAAILPTSIFLTNKKGFPVLSKMHQRLIFRLLKLEVQFIITGTNHHSEKEFCSYLQYLEYLSQNRPPPNAYELFAKGYEDYLQSPLQPLMDNLESQTYEVFEKDPIKYSQYQQAIYKCLLDRVPEEEKDTNVQVLMVLGAGRGPLVNASLRAAKQADRRIKLYAVEKNPNAVVTLENWQFEEWGSQVTVVSSDMREWVAPEKADIIVSELLGSFADNELSPECLDGAQHFLKDDGVSIPGEYTSFLAPISSSKLYNEVRACREKDRDPEAQFEMPYVVRLHNFHQLSAPQPCFTFSHPNRDPMIDNNRYCTLEFPVEVNTVLHGFAGYFETVLYQDITLSIRPETHSPGMFSWFPILFPIKQPITVREGQTICVRFWRCSNSKKVWYEWAVTAPVCSAIHNPTGRSYTIGL

SEQ ID NO: 840501 - protein, 703 aa, Homo sapiens
MAVGGAGGSRVSSGRDLNCVPEIADTLGAVAKQGFDFLCMPVFHPRFKREFIQEPAKNRPGPQTRSDLLLSGRDWNTLIVGKLSPWIRPDSKVEKIRRNSEAAMLQELNFGAYLGLPAFLLPLNQEDNTNLARVLTNHIHTGHHSSMFWMRVPLVAPEDLRDDIIENAPTTHTEEYSGEEKTWMWWHNFRTLCDYSKRIAVGESMRILGWVWLLLPPVNKNQEFHIYIQFCYFPSVSDWLSLKEVNRFAQRSKEGFLAWQWLTVFLLPHVALEIGADLPSNHVIDRWLGEPIKAAILPTSIFLTNKKGFPVLSKMHQRLIFRLLKLEVQFIITGTNHHSEKEFCSYLQYLEYLSQNRPPPNAYELFAKGYEDYLQSPLQPLMDNLESQTYEVFEKDPIKYSQYQQAIYKCLLDRVPEEEKDTNVQVLMVLGAGRGPLVNASLRAAKQADRRIKLYAVEKNPNAVVTLENWQFEEWGSQVTVVSSDMREWVAPEKADIIVSELLGSFADNELSPECLDGAQHFLKDDGVSIPGEYTSFLAPISSSKLYNEVRACREKDRDPEAQFEMPYVVRLHNFHQLSAPQPCFTFSHPNRDPMIDNNRYCTLEFPVEVNTVLHGFAGYFETVLYQDITLSIRPETHSPGMFSWFPILFPIKQPITVREGQTICVRFWRCSNSKKVWYEWAVTAPVCSAIHNPTGRSYTIGL

SEQ ID NO: 840502 - protein, 468 aa, Homo sapiens
MAVGGAGGSRVSSGRDLNCVPEIADTLGAVAKQGFDFLCMPVFHPRFKREFIQEPAKNRPGPQTRSDLLLSGRDWNTLIVGKLSPWIRPDSKVEKIRRNSEAAMLQELNFGAYLGLPAFLLPLNQEDNTNLARVLTNHIHTGHHSSMFWMRVPLVAPEDLRDDIIENAPTTHTEEYSGEEKTWMWWHNFRTLCDYSKRIAVALEIGADLPSNHVIDRWLGEPIKAAILPTSIFLTNKKGFPVLSKMHQRLIFRLLKLEVQFIITGTNHHSEKEFCSYLQYLEYLSQNRPPPNAYELFAKGYEDYLQSPLQPLMDNLESQTYEVFEKDPIKYSQYQQAIYKCLLDRVPEEEKDTNVQVLMVLGAGRGPLVNASLRAAKQADRRIKLYAVEKNPNAVVTLENWQFEEWGSQVTVVPSLPPSCTMRSEPVGRRTVTLRPSLRCLMWYGCTTSTSSLHPSPVSPSAIPTEIL

SEQ ID NO: 840503 - protein, 576 aa, Homo sapiens
MRGPNSGTEKGRLVIPEKQGFDFLCMPVFHPRFKREFIQEPAKNRPGPQTRSDLLLSGRAFLLPLNQEDNTNLARVLTNHIHTGHHSSMFWMRVPLVAPEDLRDDIIENAPTTHTEEYSGEEKTWMWWHNFRTLCDYSKRIAVALEIGADLPSNHVIDRWLGEPIKAAILPTSIFLTNKKGFPVLSKMHQRLIFRLLKLEVQFIITGTNHHSEKEFCSYLQYLEYLSQNRPPPNAYELFAKGYEDYLQSPLQPLMDNLESQTYEVFEKDPIKYSQYQQAIYKCLLDRVPEEEKDTNVQVLMVLGAGRGPLVNASLRAAKQADRRIKLYAVEKNPNAVVTLENWQFEEWGSQVTVVSSDMREWVAPEKADIIVSELLGSFADNELSPECLDGAQHFLKDDGVSIPGEYTSFLAPISSSKLYNEVRACREKDRDPEAQFEMPYVVRLHNFHQLSAPQPCFTFSHPNRDPMIDNNRYCTLEFPVEVNTVLHGFAGYFETVLYQDITLSIRPETHSPGMFSWFPILFPIKQPITVREGQTICVRFWRCSNSKKVWYEWAVTAPVCSAIHNPTGRSYTIGL

SEQ ID NO: 840504 - protein, 593 aa, Homo sapiens
MAVGGAGGSRVSSGRDLNCVPEIADTLGAVAKQGFDFLCMPVFHPRFKREFIQEPAKNRPGPQTRSDLLLSGRDWNTLIVGKLSPWIRPDSKVEKIRRNSEAAMLQELNFGAYLGLPAFLLPLNQEDNTNLARVLTNHIHTGHHSSMFWMRVPLVAPEDLRDDIIENAPTTHTEEYSGEEKTWMWWHNFRTLCDYSKRIAVALEIGADLPSNHVIDRWLGEPIKAAILPTSIFLTNKKGFPVLSKMHQRLIFRLLKLEVQFIITGTNHHSEKEFCSYLQYLEYLSQNRPPPNAYELFAKGYEDYLQSPLQPLMDNLESQTYEVFEKDPIKYSQYQQAIYKCLLDRVPEEEKDTNVQVLMVLGAGRGPLVNASLRAAKQADRRIKLYAVEKNPNAVVTLENWQFEEWGSQVTVVSSDMREWVAPEKADIIVSELLGSFADNELSPECLDGAQHFLKDDGVSIPGEYTSFLAPISSSKLYNEVRACREKDRDPEAQFEMPYVVRLHNFHQLSAPQPCFTFSHPNRDPMIDNNRYCTLEFPVEVNTVLHGFAGYFETVLYQDITLSIRPETHSPGMFSWFPILFPIKPRRCGMSGL

SEQ ID NO: 840505 - protein, 634 aa, Homo sapiens [sequence omitted]

SEQ ID NO: 840506 - protein, 634 aa, Homo sapiens [sequence omitted]

SEQ ID NO: 840507 - protein, 659 aa, Homo sapiens
MAVGGAGGSRVSSGRDLNCVPEIADTLGAVAKQGFDFLCMPVFHPRFKREFIQEPAKNRPGPQTRSDLLLSGRDWNTLIVGKLSPWIRPDSKVEKIRRNSEAAMLQELNFGAYLGLPAFLLPLNQEDNTNLARVLTNHIHTGHHSSMFWMRVPLVAPEDLRDDIIENAPTTHTEEYSGEEKTWMWWHNFRTLCDYSKRIAVALEIGADLPSNHVIDRWLGEPIKAAILPTSIFLTNKKGFPVLSKMHQRLIFRLLKLEVQFIITGTNHHSEKEFCSYLQYLEYLSQNRPPPNAYELFAKGYEDYLQSPLQPLMDNLESQTYEVFEKDPIKYSQYQQAIYKCLLDRVPEEEKDTNVQVLMVLGAGRGPLVNASLRAAKQADRRIKLYAVEKNPNAVVTLENWQFEEWGSQVTVVSSDMREWVAPEKADIIVSELLGSFADNELSPECLDGAQHFLKDDGVSIPGEYTSFLAPISSSKLYNEVRACREKDRDPEAQFEMPYVVRLHNFHQLSAPQPCFTFSHPNRDPMIDNNRYCTLEFPVEVNTVLHGFAGYFETVLYQDITLSIRPETHSPGMFSWFPILFPIKQPITVREGQTICVRFWRCSNWLKPPIYEDLRPGGEELVLDLKLRTQPQELPGISLRTWGLNGFSAFFCSCFDGFV

SEQ ID NO: 840508 - protein, 578 aa, Homo sapiens
MAVGGAGGSRVSSGRDLNCVPEIADTLGAVAKQGFDFLCMPVFHPRFKREFIQEPAKNRPGPQTRSDLLLSGRDWNTLIVGKLSPWIRPDSKVEKIRRNSEAAMLQELNFGAYLGLPAFLLPLNQEDNTNLARVLTNHIHTGHHSSMFWMRVPLVAPEDLRDDIIENAPTTHTEEYSGEEKTWMWWHNFRTLCDYSKRIAVALEIGADLPSNHVIDRWLGEPIKAAILPTSIFLTNKKGFPVLSKMHQRLIFRLLKLEVQFIITGTNHHSEKEFCSYLQYLEYLSQNRPPPNAYELFAKGYEDYLQSPLQPLMDNLESQTYEVFEKDPIKYSQYQQAIYKCLLDRVPEEEKDTNVQVLMVLGAGRGPLVNASLRAAKQADRRIKLYAVEKNPNAVVTLENWQFEEWGSQVTVVSSDMREWVAPEKADIIVSELLGSFADNELSPECLDGAQHFLKDDGVSIPGEYTSFLAPISSSKLYNEVRACREKDRDPEAQFEMPYVVRLHNFHQLSAPQPCFTFSHPNRDPMIDNNRYCTLEFPVEVNTVLHGFAGYFETVLYQDITLSIRPETHSPGTAHNGT

SEQ ID NO: 840509 - protein, 592 aa, Homo sapiens
MAVGGAGGSRVSSGRDLNCVPEIADTLGAVAKQGFDFLCMPVFHPRFKREFIQEPAKNRPGPQTRSDLLLSGRDWNTLIVGKLSPWIRPDSKVEKIRRNSEAAMLQELNFGAYLGLPAFLLPLNQEDNTNLARVLTNHIHTGHHSSMFWMRVPLVAPEDLRDDIIENAPTTHTEEYSGEEKTWMWWHNFRTLCDYSKRIAVALEIGADLPSNHVIDRWLGEPIKAAILPTSIFLTNKKGFPVLSKMHQRLIFRLLKLEVQFIITGTNHHSEKEFCSYLQYLEYLSQNRPPPNAYELFAKGYEDYLQSPLQPLMDNLESQTYEVFEKDPIKYSQYQQAIYKCLLDRVPEEEKDTNVQVLMVLGAGRGPLVNASLRAAKQADRRIKLYAVEKNPNAVVTLENWQFEEWGSQVTVVSSDMREWVAPEKADIIVSELLGSFADNELSPECLDGAQHFLKDDGVSIPGEYTSFLAPISSSKLYNEVRACREKDRDPEAQFEMPYVVRLHNFHQLSAPQPCFTFSHPNRDPMIDNNRYCTLEFPVEVNTVLHGFAGYFETVLYQDITLSIRPETHSPGMFSWFPILFPIKVGTAFKTL

SEQ ID NO: 840510 - protein, 218 aa, Homo sapiens
MREWVAPEKADIIVSELLGSFADNELSPECLDGAQHFLKDDGVSIPGEYTSFLAPISSSKLYNEVRACREKDRDPEAQFEMPYVVRLHNFHQLSAPQPCFTFSHPNRDPMIDNNRYCTLEFPVEVNTVLHGFAGYFETVLYQDITLSIRPETHSPGMFSWFPILFPIKQPITVREGQTICVRFWRCSNSKKVWYEWAVTAPVCSAIHNPTGRSYTIGL

SEQ ID NO: 840511 - protein, 151 aa, Homo sapiens
MSGTGFLYSSVLVRGSKSSFSDLLLCAVVENLLSQKLEEPEDEPLVHLRKNRKSLLIGQENASGENGYFETVLYQDITLSIRPETHSPGMFSWFPILFPIKQPITVREGQTICVRFWRCSNSKKVWYEWAVTAPVCSAIHNPTGRSYTIGL

SEQ ID NO: 840512 - protein, 104 aa, Homo sapiens
MAAMAVGGAGGSRVSSGRDLNCVPEIADTLGAVAKQGFDFLCMPVFHPRFKREFIQEPAKNRPGPQTRSDLLLSGRGRDHPICPLIIRGNNNFCFIGALILLLF

SEQ ID NO: 840513 - protein, 634 aa, Homo sapiens [sequence omitted]

SEQ ID NO: 840514 - protein, 595 aa, Homo sapiens [sequence omitted]

SEQ ID NO: 840515 - protein, 644 aa, Homo sapiens
MAVGGAGGSRVSSGRDLNCVPEIADTLGAVAKQGFDFLCMPVFHPRFKREFIQEPAKNRPGPQTRSDLLLSGRVFVFLGWGSADWNTLIVGKLSPWIRPDSKVEKIRRNSEAAMLQELNFGAYLGLPAFLLPLNQEDNTNLARVLTNHIHTGHHSSMFWMRVPLVAPEDLRDDIIENAPTTHTEEYSGEEKTWMWWHNFRTLCDYSKRIAVALEIGADLPSNHVIDRWLGEPIKAAILPTSIFLTNKKGFPVLSKMHQRLIFRLLKLEVQFIITGTNHHSEKEFCSYLQYLEYLSQNRPPPNAYELFAKGYEDYLQSPLQPLMDNLESQTYEVFEKDPIKYSQYQQAIYKCLLDRVPEEEKDTNVQVLMVLGAGRGPLVNASLRAAKQADRRIKLYAVEKNPNAVVTLENWQFEEWGSQVTVVSSDMREWVAPEKADIIVSELLGSFADNELSPECLDGAQHFLKDDGVSIPGEYTSFLAPISSSKLYNEVRACREKDRDPEAQFEMPYVVRLHNFHQLSAPQPCFTFSHPNRDPMIDNNRYCTLEFPVEVNTVLHGFAGYFETVLYQDITLSIRPETHSPGMFSWFPILFPIKQPITVREGQTICVRFWRCSNSKKVWYEWAVTAPVCSAIHNPTGRSYTIGL

SEQ ID NO: 840516 - protein, 590 aa, Homo sapiens
MAVGGAGGSRVSSGRDLNCVPEIADTLGAVAKQGFDFLCMPVFHPRFKREFIQEPAKNRPGPQTRSDLLLSGRAFLLPLNQEDNTNLARVLTNHIHTGHHSSMFWMRVPLVAPEDLRDDIIENAPTTHTEEYSGEEKTWMWWHNFRTLCDYSKRIAVALEIGADLPSNHVIDRWLGEPIKAAILPTSIFLTNKKGFPVLSKMHQRLIFRLLKLEVQFIITGTNHHSEKEFCSYLQYLEYLSQNRPPPNAYELFAKGYEDYLQSPLQPLMDNLESQTYEVFEKDPIKYSQYQQAIYKCLLDRVPEEEKDTNVQVLMVLGAGRGPLVNASLRAAKQADRRIKLYAVEKNPNAVVTLENWQFEEWGSQVTVVSSDMREWVAPEKADIIVSELLGSFADNELSPECLDGAQHFLKDDGVSIPGEYTSFLAPISSSKLYNEVRACREKDRDPEAQFEMPYVVRLHNFHQLSAPQPCFTFSHPNRDPMIDNNRYCTLEFPVEVNTVLHGFAGYFETVLYQDITLSIRPETHSPGMFSWFPILFPIKQPITVREGQTICVRFWRCSNSKKVWYEWAVTAPVCSAIHNPTGRSYTIGL

SEQ ID NO: 840517 - protein, 389 aa, Homo sapiens [sequence omitted]

SEQ ID NO: 840518 - protein, 389 aa, Homo sapiens [sequence omitted]

SEQ ID NO: 840519 - protein, 480 aa, Homo sapiens
MAVGGAGGSRVSSGRDLNCVPEIADTLGAVAKQGFDFLCMPVFHPRFKREFIQEPAKNRPGPQTRSDLLLSGRDWNTLIVGKLSPWIRPDSKVEKIRRNSEALEVQFIITGTNHHSEKEFCSYLQYLEYLSQNRPPPNAYELFAKGYEDYLQSPLQPLMDNLESQTYEVFEKDPIKYSQYQQAIYKCLLDRVPEEEKDTNVQVLMVLGAGRGPLVNASLRAAKQADRRIKLYAVEKNPNAVVTLENWQFEEWGSQVTVVSSDMREWVAPEKADIIVSELLGSFADNELSPECLDGAQHFLKDDGVSIPGEYTSFLAPISSSKLYNEVRACREKDRDPEAQFEMPYVVRLHNFHQLSAPQPCFTFSHPNRDPMIDNNRYCTLEFPVEVNTVLHGFAGYFETVLYQDITLSIRPETHSPGMFSWFPILFPIKQPITVREGQTICVRFWRCSNSKKVWYEWAVTAPVCSAIHNPTGRSYTIGL

SEQ ID NO: 840520 - protein, 659 aa, Homo sapiens; identical to SEQ ID NO: 840507

SEQ ID NO: 840521 - protein, 595 aa, Homo sapiens
MAVGGAGGSRVSSGRDLNCVPEIADTLGAVAKQGFDFLCMPVFHPRFKREFIQEPAKNRPGPQTRSDLLLSGRDWNTLIVGKLSPWIRPDSKVEKIRRNSEAAMLQELNFGAYLGLPAFLLPLNQEDNTNLARVLTNHIHTGHHSSMFWMRVPLVAPEDLRDDIIENAPTTHTEEYSGEEKTWMWWHNFRTLCDYSKRIAVALEIGADLPSNHVIDRWLGEPIKAAILPTSIFLTNKKGFPVLSKMHQRLIFRLLKLEVQFIITGTNHHSEKEFCSYLQYLEYLSQNRPPPNAYELFAKGYEDYLQSPLQPLMDNLESQTYEVFEKDPIKYSQYQQAIYKCLLDRVPEEEKDTNVQVLMVLGAGRGPLVNASLRAAKQADRRIKLYAVEKNPNAVVTLENWQFEEWGSQVTVVSSDMREWVAPEKADIIVSELLGSFADNELSPECLDGAQHFLKDDGVSIPGEYTSFLAPISSSKLYNEVRACREKDRDPEAQFEMPYVVRLHNFHQLSAPQPCFTFSHPNRDPMIDNNRYCTLEFPVEVNTVLHGFAGYFETVLYQDITLSIRPETHSPGMFSWFPILFPIKNPTGRSYTIGL

SEQ ID NO: 840522 - protein, 138 aa, Homo sapiens [sequence omitted]

SEQ ID NO: 840523 - protein, 261 aa, Homo sapiens
MAVGGAGGSRVSSGRDLNCVPEIADTLGAVAKQGFDFLCMPVFHPRFKREFIQEPAKNRPGPQTRSDLLLSGRDWNTLIVGKLSPWIRPDSKVEKIRRNSEAAMLQELNFGAYLGLPAFLLPLNQEDNTNLARVLTNHIHTGHHSSMFWMRVPLVAPEDLRDDIIENAPTTHTEEYSGEEKTWMWWHNFRTLCDYSKRIAVALEIGADLPSNHVIDRWLGEPIKAAILPTSIFLTNKKGFPVLSKMHQRLIFRLLKPCYRS

SEQ ID NO: 840524 - protein, 187 aa, Homo sapiens
MERQEESLSARPALETEGLRFLHTTVGSLLATYGWYIVFSCILLYVVFQKLSARLRALRQRQLDRAAAAVEPDVVVKRQEALAAARLKMQEELNAQVEKHKEKLKQLEEEKRRQKIEMWDSMQEGKSYKGNAKKPQEEDSPGPSTSSVLKRKSDRKPLRGGGYNPLSGEGGGACSWRPGRRGPSSGG

SEQ ID NO: 840525 - protein, 169 aa, Homo sapiens
MERQEESLSARPALETEGLRFLHTTVGSLLATYGWYIVFSCILLYVVFQKLSARLRALRQRQLDRAAAAVEPDVVVKRQEALAAARLKMQEELNAQVEKHKEKLKQLEEEKRRQKIEMWDSMQEGSTSSVLKRKSDRKPLRGGGYNPLSGEGGGACSWRPGRRGPSSGG

SEQ ID NO: 840526 - protein, 187 aa, Homo sapiens; identical to SEQ ID NO: 840524

SEQ ID NO: 840527 - protein, 171 aa, Homo sapiens
PLLRRAAMMVGSLLATYGWYIVFSCILLYVVFQKLSARLRALRQRQLDRAAAAVEPDVVVKRQEALAAARLKMQEELNAQVEKHKEKLKQLEEEKRRQKIEMWDSMQEGKSYKGNAKKPQEEDSPGPSTSSVLKRKSDRKPLRGGGYNPLSGEGGGACSWRPGRRGPSSGG

SEQ ID NO: 840528 - protein, 187 aa, Homo sapiens; identical to SEQ ID NO: 840524

SEQ ID NO: 840529 - protein, 234 aa, Homo sapiens
PLLRRAAMMGGSSAAAPGAGAWEAWERSGVGAYADLGQQARTLRGGFSGAALPWAARLSLVCASLFCEPSPSLGSLLATYGWYIVFSCILLYVVFQKLSARLRALRQRQLDRAAAAVEPDVVVKRQEALAAARLKMQEELNAQVEKHKEKLKQLEEEKRRQKIEMWDSMQEGKSYKGNAKKPQEEDSPGPSTSSVLKRKSDRKPLRGGGYNPLSGEGGGACSWRPGRRGPSSGG

SEQ ID NO: 840530 - protein, 187 aa, Homo sapiens; identical to SEQ ID NO: 840524

SEQ ID NO: 840531 - protein, 187 aa, Homo sapiens
MERQEESLSARPALETEGLRFLHTTVGSLLATYGWYIVFSCILLYVVFQKLSARLRALRQRQLDRAAAAVEPDVVVKRQEALAAARLKMQEELNAQVEKHKEKLKQLEEEKRRQKIEMWDSMQEGKSYKGNAKKPQEEDSPGPSTSSVLKRKSDRKPLRGGGYNPLSGEGGGACSWRPGLSLLTLAR

SEQ ID NO: 840532 - protein, 187 aa, Homo sapiens; identical to SEQ ID NO: 840524

SEQ ID NO: 840533 - protein, 114 aa, Homo sapiens
MERQEESLSARPALETEGLRFLHTTVGSLLATYGWYIVFSCILLYVVFQKLSARLRALRQRQLDRAAAAVEPDVVVKRQEALAAARLKMQEELNAQVEKHKEKLKQLEEEKRRL

SEQ ID NO: 840534 - protein, 1594 aa, Homo sapiens
LPAPPPPPPPPLLPHLPPCRRRRVMSDSLWTALSNFSMPSFPGGSMFRRTKSCRTSNRKSLILTSTSPTLPRPHSPLPGHLGSSPLDSPRNFSPNTPAHFSFASSRRADGRRWSLASLPSSGYGTNTPSSTVSSSCSSQERLHQLPYQPTVDELHFLSKHFGSTESITDEDGGRRSPAVRPRSRSLSPGRSPSSYDNEIVMMNHVYKERFPKATAQMEEKLRDFTRAYEPDSVLPLADGVLSFIHHQIIELARDCLTKSRDGLITTVYFYELQENLEKLLQDAYERSESLEVAFVTQLVKKLLIIISRPARLLECLEFNPEEFYHLLEAAEGHAKEGHLVKTDIPRYIIRQLGLTRDPFPDVVHLEEQDSGGSNTPEQDDLSEGRSSKAKKPPGENDFDTIKLISNGAYGAVYLVRHRDTRQRFAMKKINKQNLILRNQIQQAFVERDILTFAENPFVVGMFCSFETRRHLCMVMEYVEGGDCATLLKNIGALPVEMARMYFAETVLALEYLHNYGIVHRDLKPDNLLITSMGHIKLTDFGLSKMGLMSLTTNLYEGHIEKDAREFLDKQVCGTPEYIAPEVILRQGYGKPVDWWAMGIILYEFLVGCVPFFGDTPEELFGQVISDDILWPEGDEALPTEAQLLISSLLQTNPLVRLGAGGAFEVKQHSFFRDLDWTGLLRQKAEFIPHLESEDDTSYFDTRSDRYHHVNSYDEDDTTEEEPVEIRQFSSCSPRFSKVYSSMEQLSQHEPKTPVAAAGSSKREPSTKGPEEKVAGKREGLGGLTLREKTWRGGSPEIKRFSASEASFLEGEASPPLGARRRFSALLEPSRFSAPQEDEDEARLRRPPRPSSDPAGSLDARAPKEETQGEGTSSAGDSEATDRPRPGDLCPPSKDGDASGPRATNDLVLRRARHQQMSGDVAVEKRPSRTGGKVIKSASATALSVMIPAVDPHGSSPLASPMSPRSLSSNPSSRDSSPSRDYSPAVSGLRSPITIQRSGKKYGFTLRAIRVYMGDTDVYSVHHIVWHVEEGGPAQEAGLCAGDLITHVNGEPVHGMVHPEVVELILKSGNKVAVTTTPFENTSIRIGPARRSSYKAKMARRNKRPSAKEGQESKKRSSLFRKITKQSNLLHTSRSLSSLNRSLSSSDSLPGSPTHGLPARSPTHSYRSTPDSAYLGASSQSSSPASSTPNSPASSASHHIRPSTLHGLSPKLHRQYRSARCKSAGNIPLSPLAHTPSPTQASPPPLPGHTVGSSHTTQSFPAKLHSSPPVVRPRPKSAEPPRSPLLKRVQSAEKLGASLSADKKGALRKHSLEVGHPDFRKDFHGELALHSLAESDGETPPVEGLGAPRQVAVRRLGRQESPLSLGADPLLPEGASRPPVSSKEKESPGGAEACTPPRATTPGGRTLERDVGCTRHQSVQTEDGTGGMARAVAKAALSPVQEHETGRRSSSGEAGTPLVPIVVEPARPGAKAVVPQPLGADSKGLQEPAPLAPSVPEAPRGRERWVLEVVEERTTLSGPRSKPASPKLSPEPQTPSLAPAKCSAPSSAVTPVPPASLLGSGTKPQVGLTSRCPAEAVPPAGLTKKGVSSPAPPGP

SEQ ID NO: 840535 - protein, 134 aa, Homo sapiens
SCWGAHGGSDPGPAPGPQSSCSSQERLHQLPYQPTVDELHFLSKHFGSTESITDEDGGRRSPAVRPRSRSLSPGRSPSSYDNEIVMMNHVYKERFPKVRWDPRRSRGDQAACTLARLIPARPLAASVRSAGSWR

SEQ ID NO: 840536 - protein, 1583 aa, Homo sapiens
AATSLLPPRAEVAAAAAMDDSGLIRRRRLQKDLPLPRKSSSCRTSNRKSLILTSTSPTLPRPHSPLPGHLGSSPLDSPRNFSPNTPAHFSFASSRRADGRRWSLASLPSSGYGTNTPSSTVSSSCSSQERLHQLPYQPTVDELHFLSKHFGSTESITDEDGGRRSPAVRPRSRSLSPGRSPSSYDNEIVMMNHVYKERFPKATAQMEEKLRDFTRAYEPDSVLPLADGVLSFIHHQIIELARDCLTKSRDGLITTVYFYELQENLEKLLQDAYERSESLEVAFVTQLVKKLLIIISRPARLLECLEFNPEEFYHLLEAAEGHAKEGHLVKTDIPRYIIRQLGLTRDPFPDVVHLEEQDSGGSNTPEQDDLSEGRSSKAKKPPGENDFDTIKLISNGAYGAVYLVRHRDTRQRFAMKKINKQNLILRNQIQQAFVERDILTFAENPFVVGMFCSFETRRHLCMVMEYVEGGDCATLLKNIGALPVEMARMYFAETVLALEYLHNYGIVHRDLKPDNLLITSMGHIKLTDFGLSKMGLMSLTTNLYEGHIEKDAREFLDKQVCGTPEYIAPEVILRQGYGKPVDWWAMGIILYEFLVGCVPFFGDTPEELFGQVISDDILWPEGDEALPTEAQLLISSLLQTNPLVRLGAGGAFEVKQHSFFRDLDWTGLLRQKAEFIPHLESEDDTSYFDTRSDRYHHVNSYDEDDTTEEEPVEIRQFSSCSPRFSKVYSSMEQLSQHEPKTPVAAAGSSKREPSTKGPEEKVAGKREGLGGLTLREKTWRGGSPEIKRFSASEASFLEGEASPPLGARRRFSALLEPSRFSAPQEDEDEARLRRPPRPSSDPAGSLDARAPKEETQGEGTSSAGDSEATDRPRPGDLCPPSKDGDASGPRATNDLVLRRARHQQMSGDVAVEKRPSRTGGKVIKSASATALSVMIPAVDPHGSSPLASPMSPRSLSSNPSSRDSSPSRDYSPAVSGLRSPITIQRSGKKYGFTLRAIRVYMGDTDVYSVHHIVWHVEEGGPAQEAGLCAGDLITHVNGEPVHGMVHPEVVELILKSGNKVAVTTTPFENTSIRIGPARRSSYKAKMARRNKRPSAKEGQESKKRSSLFRKITKQSNLLHTSRSLSSLNRSLSSSDSLPGSPTHGLPARSPTHSYRSTPDSAYLGASSQSSSPASSTPNSPASSASHHIRPSTLHGLSPKLHRQYRSARCKSAGNIPLSPLAHTPSPTQASPPPLPGHTVGSSHTTQSFPAKLHSSPPVVRPRPKSAEPPRSPLLKRVQSAEKLGASLSADKKGALRKHSLEVGHPDFRKDFHGELALHSLAESDGETPPVEGLGAPRQVAVRRLGRQESPLSLGADPLLPEGASRPPVSSKEKESPGGAEACTPPRATTPGGRTLERDVGCTRHQSVQTEDGTGGMARAVAKAALSPVQEHETGRRSSSGEAGTPLVPIVVEPARPGAKAVVPQPLGADSKGLQEPAPLAPSVPEAPRGRERWVLEVVEERTTLSGPRSKPASPKLSPEPQTPSLAPAKCSAPSSAVTPVPPASLLGSGTKPQVGLTSRCPAEAVPPAGLTKKGVSSPAPPGP

SEQ ID NO: 840537 - protein, 1640 aa, Homo sapiens
LPAPPPPPPPPLLPHLPPCRRRRVMSDSLWTALSNFSMPSFPGGSMFRRTKSCRTSNRKSLILTSTSPTLPRPHSPLPGHLGSSPLDSPRNFSPNTPAHFSFASSRRADGRRWSLASLPSSGYGTNTPSSTVSSSCSSQERLHQLPYQPTVDELHFLSKHFGSTESITDEDGGRRSPAVRPRSRSLSPGRSPSSYDNEIVMMNHVYKERFPKATAQMEEKLRDFTRAYEPDSVLPLADGVLSFIHHQIIELARDCLTKSRDGLITTVYFYELQENLEKLLQDAYERSESLEVAFVTQLVKKLLIIISRPARLLECLEFNPEEFYHLLEAAEGHAKEGHLVKTDIPRYIIRQLGLTRDPFPDVVHLEEQDSGGSNTPEQDDLSEGRSSKAKKPPGENDFDTIKLISNGAYGAVYLVRHRDTRQRFAMKKINKQNLILRNQIQQAFVERDILTFAENPFVVGMFCSFETRRHLCMVMEYVEGGDCATLLKNIGALPVEMARMYFAETVLALEYLHNYGIVHRDLKPDNLLITSMGHIKLTDFGLSKMGLMSLTTNLYEGHIEKDAREFLDKQVCVRAWGSLRVELTLQDLGNPGPGGGHSSPLRALLWLGRGLTACPQVCGTPEYIAPEVILRQGYGKPVDWWAMGIILYEFLVGCVPFFGDTPEELFGQVISDDILWPEGDEALPTEAQLLISSLLQTNPLVRLGAGGAFEVKQHSFFRDLDWTGLLRQKAEFIPHLESEDDTSYFDTRSDRYHHVNSYDEDDTTEEEPVEIRQFSSCSPRFSKVYSSMEQLSQHEPKTPVAAAGSSKREPSTKGPEEKVAGKREGLGGLTLREKTWRGGSPEIKRFSASEASFLEGEASPPLGARRRFSALLEPSRFSAPQEDEDEARLRRPPRPSSDPAGSLDARAPKEETQGEGTSSAGDSEATDRPRPGDLCPPSKDGDASGPRATNDLVLRRARHQQMSGDVAVEKRPSRTGGKVIKSASATALSVMIPAVDPHGSSPLASPMSPRSLSSNPSSRDSSPSRDYSPAVSGLRSPITIQRSGKKYGFTLRAIRVYMGDTDVYSVHHIVWHVEEGGPAQEAGLCAGDLITHVNGEPVHGMVHPEVVELILKSGNKVAVTTTPFENTSIRIGPARRSSYKAKMARRNKRPSAKEGQESKKRSSLFRKITKQSNLLHTSRSLSSLNRSLSSSDSLPGSPTHGLPARSPTHSYRSTPDSAYLGASSQSSSPASSTPNSPASSASHHIRPSTLHGLSPKLHRQYRSARCKSAGNIPLSPLAHTPSPTQASPPPLPGHTVGSSHTTQSFPAKLHSSPPVVRPRPKSAEPPRSPLLKRVQSAEKLGASLSADKKGALRKHSLEVGHPDFRKDFHGELALHSLAESDGETPPVEGLGAPRQVAVRRLGRQESPLSLGADPLLPEGASRPPVSSKEKESPGGAEACTPPRATTPGGRTLERDVGCTRHQSVQTEDGTGGMARAVAKAALSPVQEHETGRRSSSGEAGTPLVPIVVEPARPGAKAVVPQPLGADSKGLQEPAPLAPSVPEAPRGRERWVLEVVEERTTLSGPRSKPASPKLSPEPQTPSLAPAKCSAPSSAVTPVPPASLLGSGTKPQVGLTSRCPAEAVPPAGLTKKGVSSPAPPGP

SEQ ID NO: 840538 - protein, 386 aa, Homo sapiens
LPAPPPPPPPPLLPHLPPCRRRRVMSDSLWTALSNFSMPSFPGGSMFRRTKSCRTSNRKSLILTSTSPTLPRPHSPLPGHLGSSPLDSPRNFSPNTPAHFSFASSRRADGRRWSLASLPSSGYGTNTPSSTVSSSCSSQERLHQLPYQPTVDELHFLSKHFGSTESITDEDGGRRSPAVRPRSRSLSPGRSPSSYDNEIVMMNHVYKERFPKATAQMEEKLRDFTRAYEPDSVLPLADGVLSFIHHQIIELARDCLTKSRDGLITTVYFYELQENLEKLLQDAYERSESLEVAFVTQLVKKLLIIISRPARLLECLEFNPEEFYHLLEAAEGHAKEGHLVKTDIPRYIIRQLGLTRDPFPDVVHLEEQDSGGSNTPEQDDLSEVME

SEQ ID NO: 840539 - protein, 182 aa, Homo sapiens
VGYGDHPLRVPGGLCALLRRHTRGAIWTGHQWYVAWQCTGAECGVHGEMDRLRVPGISKATPQRIACTQEVKAAVSHDRATALQLGDTVRSCVQTTTTTKTAPKFRFVLQMTSCGPRGMRPYLRRPNSSYPASCRPTLWSGLGQVSPPCRGAEGPLIESRPPKPQAQPVLWPRGGRHGGRGW

SEQ ID NO: 840540 - protein, 119 aa, Homo sapiens
LQLGDTVRSCVQTTTTTKTAPKFRFVLQMTSCGPRGMRPYLRRPNSSYPASCRPTLWSGLGQVSPPCRGAEGPLIESRPPKPQAQPVLWPRGGRHGGRGWAAGLAISCGWNPFRPRRRF

SEQ ID NO: 840541 - protein, 267 aa, Homo sapiens
MSGDVAVEKRPSRTGGKVIKSASATALSVMIPAVDPHGSSPLASPMSPRSLSSNPSSRDSSPSRDYSPAVSGLRSPITIQRSGKKYGFTLRAIRVYMGDTDVYSVHHIVWHVEEGGPAQEAGLCAGDLITHVNGEPVHGMVHPEVVELILKSGNKVAVTTTPFENTSIRIGPARRSSYKAKMARRNKRPSAKEGQESKKRSSLFRKITKQSNLLHTSRSLSSLNRSLSSSDSLPGSPTHGLPARSPTHSYRSTPDSAYLGITSCTCA

SEQ ID NO: 840542 - protein, 1392 aa, Homo sapiens
PRAPPPSLPQATAQMEEKLRDFTRAYEPDSVLPLADGVLSFIHHQIIELARDCLTKSRDGLITTVYFYELQENLEKLLQDAYERSESLEVAFVTQLVKKLLIIISRPARLLECLEFNPEEFYHLLEAAEGHAKEGHLVKTDIPRYIIRQLGLTRDPFPDVVHLEEQDSGGSNTPEQDDLSEGRSSKAKKPPGENDFDTIKLISNGAYGAVYLVRHRDTRQRFAMKKINKQNLILRNQIQQAFVERDILTFAENPFVVGMFCSFETRRHLCMVMEYVEGGDCATLLKNIGALPVEMARMYFAETVLALEYLHNYGIVHRDLKPDNLLITSMGHIKLTDFGLSKMGLMSLTTNLYEGHIEKDAREFLDKQVCGTPEYIAPEVILRQGYGKPVDWWAMGIILYEFLVGCVPFFGDTPEELFGQVISDDILWPEGDEALPTEAQLLISSLLQTNPLVRLGAGGAFEVKQHSFFRDLDWTGLLRQKAEFIPHLESEDDTSYFDTRSDRYHHVNSYDEDDTTEEEPVEIRQFSSCSPRFSKVYSSMEQLSQHEPKTPVAAAGSSKREPSTKGPEEKVAGKREGLGGLTLREKTWRGGSPEIKRFSASEASFLEGEASPPLGARRRFSALLEPSRFSAPQEDEDEARLRRPPRPSSDPAGSLDARAPKEETQGEGTSSAGDSEATDRPRPGDLCPPSKDGDASGPRATNDLVLRRARHQQMSGDVAVEKRPSRTGGKVIKSASATALSVMIPAVDPHGSSPLASPMSPRSLSSNPSSRDSSPSRDYSPAVSGLRSPITIQRSGKKYGFTLRAIRVYMGDTDVYSVHHIVWHVEEGGPAQEAGLCAGDLITHVNGEPVHGMVHPEVVELILKSGNKVAVTTTPFENTSIRIGPARRSSYKAKMARRNKRPSAKEGQESKKRSSLFRKITKQSNLLHTSRSLSSLNRSLSSSDSLPGSPTHGLPARSPTHSYRSTPDSAYLGASSQSSSPASSTPNSPASSASHHIRPSTLHGLSPKLHRQYRSARCKSAGNIPLSPLAHTPSPTQASPPPLPGHTVGSSHTTQSFPAKLHSSPPVVRPRPKSAEPPRSPLLKRVQSAEKLGASLSADKKGALRKHSLEVGHPDFRKDFHGELALHSLAESDGETPPVEGLGAPRQVAVRRLGRQESPLSLGADPLLPEGASRPPVSSKEKESPGGAEACTPPRATTPGGRTLERDVGCTRHQSVQTEDGTGGMARAVAKAALSPVQEHETGRRSSSGEAGTPLVPIVVEPARPGAKAVVPQPLGADSKGLQEPAPLAPSVPEAPRGRERWVLEVVEERTTLSGPRSKPASPKLSPEPQTPSLAPAKCSAPSSAVTPVPPASLLGSGTKPQVGLTSRCPAEAVPPAGLTKKGVSSPAPPGP

SEQ ID NO: 840543 - protein, 503 aa, Homo sapiens
LPAPPPPPPPPLLPHLPPCRRRRVMSDSLWTALSNFSMPSFPGGSMFRRTKSCRTSNRKSLILTSTSPTLPRPHSPLPGHLGSSPLDSPRNFSPNTPAHFSFASSRRADGRRWSLASLPSSGYGTNTPSSTVSSSCSSQERLHQLPYQPTVDELHFLSKHFGSTESITDEDGGRRSPAVRPRSRSLSPGRSPSSYDNEIVMMNHVYKERFPKATAQMEEKLRDFTRAYEPDSVLPLADGVLSFIHHQIIELARDCLTKSRDGLITTVYFYELQENLEKLLQDAYERSESLEVAFVTQLVKKLLIIISRPARLLECLEFNPEEFYHLLEAAEGHAKEGHLVKTDIPRYIIRQLGLTRDPFPDVVHLEEQDSGGSNTPEQDDLSEGRSSKAKKPPGENDFDTIKLISNGAYGAVYLVRHRDTRQRFAMKKINKQNLILRNQIQQAFVERDILTFAENPFVVGMFCSFETRRHLCMVMEYVEGVAACGAAGKMGPCSLVRAAGWPA

SEQ ID NO: 840544 - protein, 44 aa, Homo sapiens
MRRNPVPSVTAHTRSPARSDRYHHVNSYDEDDTTEEEPVEIRQF

SEQ ID NO: 840545 - protein, 128 aa, Homo sapiens
IVFIHKGDSEFLEFLNIFPQVSVKFLKSLPYHTQFPEALPLHLLLCLANRVVMSQKLLTTLVRLSSQASSFLRMRPFSTTQEIKTLFLTRQGYIYSIFKRNNPSGSHANRLNSFITRISPTGPTPAQL

SEQ ID NO: 840546 - protein, 131 aa, Homo sapiens
AAPAFVPKEWGWGSCTCICALRVGMGKLHLHLCPKSGDGEATPAFVPKEWAWGSYTCICALRVGMGKPKLERKQPPVPGLQNEMWGPERDLWVGKYHPHKEDRNEMRVLSVTCGWVNATHTRRRVLRVPGH

SEQ ID NO: 840547 - protein, 124 aa, Homo sapiens
MVATSLSFMILQVNWAQLLSPAARDTDRNCNLQGLGWLECLAPWQGQLEGWALLRWLDLFPLLINSWHFLHVASPHSLDSSIAILDVWQLSSQKCKSSFQTSIIGPESAYFLFCHILFIKMSHR

SEQ ID NO: 840548 - protein, 132 aa, Homo sapiens [sequence omitted]

SEQ ID NO: 840549 - protein, 533 aa, Homo sapiens
MGEKAVPLLRRRRVKRSCPSCGSELGVEEKRGKGNPISIQLFPPELVEHIISFLPVRDLVALGQTCRYFHEVCDGEGVWRRICRRLSPRLQDQDTKGLYFQAFGGRRRCLSKSVAPLLAHGYRRFLPTKDHVFILDYVGTLFFLKNALVSTLGQMQWKRACRYVVLCRGAKDFASDPRCDTVYRKYLYVLATREPQEVVGTTSSRACDCVEVYLQSSGQRVFKMTFHHSMTFKQIVLVGQETQRALLLLTEEGKIYSLVVNETQLDQPRSYTVQLALRKVSHYLPHLRVACMTSNQSSTLYVTDPILCSGYNHLGLVDEFGRIFMQGNNRYGQLGTGDKMDRGEPTQGTLAVCPQVCYLQRPITLWCGLNHSLVLSQSSEFSKELLGCGCGAGGRLPGWPKGSASFVKLQVKVPLCACALCATRECLYILSSHDIEQHAPYRHLPASRVVGTPEPSLGARAPQDPGGMAQACEEYLSQIHSCQTLQDRTEKMKEIVGWMPLMAAQKDFFWEALDMLQRAEGGGGGVGPPAPET

SEQ ID NO: 840550 - protein, 275 aa, Homo sapiens
MTSNQSSTLYVTDQGGVYFEVHTPGVYRDLFGTLQAFDPLDQQMPLALSLPAKILFCALGYNHLGLVDEFGRIFMQGNNRYGQLGTGDKMDRGEPTQVCYLQRPITLWCGLNHSLVLSQSSEFSKELLGCGCGAGGRLPGWPKGSASFVKLQVKVPLCACALCATRECLYILSSHDIEQHAPYRHLPASRVVGTPEPSLGARAPQDPGGMAQACEEYLSQIHSCQTLQDRTEKMKEIVGWMPLMAAQKDFFWEALDMLQRAEGGGGGVGPPAPET

SEQ ID NO: 840551 - protein, 580 aa, Homo sapiens
MGEKAVPLLRRRRVKRSCPSCGSELGVEEKRGKGNPISIQLFPPELVEHIISFLPVRDLVALGQTCRYFHEVCDGEGVWRRICRRLSPRLQDQGSGVRPWKRAAILNYTKGLYFQAFGGRRRCLSKSVAPLLAHGYRRFLPTKDHVFILDYVGTLFFLKNALVSTLGQMQWKRACRYVVLCRGAKDFASDPRCDTVYRKYLYVLATREPQEVVGTTSSRACDCVEVYLQSSGQRVFKMTFHHSMTFKQIVLVGQETQRALLLLTEEGKIYSLVVNETQLDQPRSYTVQLALRKVSHYLPHLRVACMTSNQSSTLYVTDQGGVYFEVHTPGVYRDLFGTLQAFDPLDQQMPLALSLPAKILFCALGYNHLGLVDEFGRIFMQGNNRYGQLGTGDKMDRGEPTQVCYLQRPITLWCGLNHSLVLSQSSEFSKELLGCGCGAGGRLPGWPKGSASFVKLQVKVPLCACALCATRECLYILSSHDIEQHAPYRHLPASRVVGTPEPSLGARAPQDPGGMAQACEEYLSQIHSCQTLQDRTEKMKEIVGWMPLMAAQKDFFWEALDMLQRAEGGGGGVGPPAPET

SEQ ID NO: 840552 - protein, 591 aa, Homo sapiens
MVRGSQRRKLQKFTRLCGREEGLRVKRSCPSCGSELGVEEKRGKGNPISIQLFPPELVEHIISFLPVRDLVALGQTCRYFHEVCDGEGVWRRICRRLSPRLQDQGSGVRPWKRAAILNYTKGLYFQAFGGRRRCLSKSVAPLLAHGYRRFLPTKDHVFILDYVGTLFFLKNALVSTLGQMQWKRACRYVVLCRGAKDFASDPRCDTVYRKYLYVLATREPQEVVGTTSSRACDCVEVYLQSSGQRVFKMTFHHSMTFKQIVLVGQETQRALLLLTEEGKIYSLVVNETQLDQPRSYTVQLALRKVSHYLPHLRVACMTSNQSSTLYVTDQGGVYFEVHTPGVYRDLFGTLQAFDPLDQQMPLALSLPAKILFCALGYNHLGLVDEFGRIFMQGNNRYGQLGTGDKMDRGEPTQVCYLQRPITLWCGLNHSLVLSQSSEFSKELLGCGCGAGGRLPGWPKGSASFVKLQVKVPLCACALCATRECLYILSSHDIEQHAPYRHLPASRVVGTPEPSLGARAPQDPGGMAQACEEYLSQIHSCQTLQDRTEKMKEIVGWMPLMAAQKDFFWEALDMLQRAEGGGGGVGPPAPET

SEQ ID NO: 840553 - protein, 111 aa, Homo sapiens
ISGVSCNLCDNCFSLVSTTKAEPRISRGEGKMIWFLKLTWFFIFKKSRHCNASLVFNSKLKREMVALLLCMAESAQTVAQYQTCGSTAGNPAWPGICSKGCWESLPQQPMG

SEQ ID NO: 840554 - protein, 45 aa, Homo sapiens
MSEAVVDTSSVITTKDFKEKLWRRQKVEETPMLTGTLMRKMGSRR

SEQ ID NO: 840555 - protein, 154 aa, Homo sapiens
LQREAPLASGNHSGTRVSSVASPMDHGRTLHPCHCRGADFLPFLRNLGMLPSYHAYWEEGLEFYIRPLGFSAFFLQTRFRRSPNVTHSQITSHQAKSASSWAEGLGRSNYWARREGDFQVLRMQSGQAWWLTGYPQILREKLPAPRHLVGDELG

SEQ ID NO: 840556 - protein, 727 aa, Homo sapiens
MQACMAVYDIPDLLGGNGCLGSVVFSESFLTSQILVKEKDGTVTTETSSVVLTAAVPRFCSWLVEDNEVKLSEKTQQAVRGDESFLGTYLTGGEGAYLYSSNLQSWPEEGNVHFFSSGLLFSHCRHGSIIISKDHMNSISFYDGDSTSTVAALLIDFKSSLLPHLPVHFHGSSNFLMIALFPKSKIYQAFYSEVFSLWKQQDNSGISLKVIQEDGLSVEQKRLHSSAQKLFSALSQPAGEKRSSLKLLSAKLPELDWFLQHFAISSISQEPVMRTHLPVLLQQAEINTTHRIESDKVIISIVTGLPGCHASELCAFLVTLHKECGRWMVYRQIMDSSECFHAAHFQRYLSSALEAQQNRSARQSAYIRKKTRLLVVLQGYTDVIDVVQALQTHPDSNVKASFTIGAITACVEPMSCYMEHRFLFPKCLDQCSQGLVSNVVFTSHTTEQRHPLLVQLQSLIRAANPAAAFILAENGIVTRNEDIELILSENSFSSPEMLRSRYLMYPGWYEGKLNAGSVYPLMVQICVWFGRPLEKTRFVAKCKAIQSSIKPSPFSGNIYHILGKVKFSDSERTMEVCYNTLANSLSIMPVLEGPTPPPDSKSVSQDSSGQQECYLVFIGCSLKEDSIKDWLRQSAKQKPQRKALKTRGMLTQQEIRSIHVKRHLEPLPAGYFYNGTQFVNFFGDKTDFHPLMDQFMNDYVEEANREIEKYNQELEQQEYHDLFELKP

SEQ ID NO: 840557 - protein, 165 aa, Homo sapiens [sequence omitted]

SEQ ID NO: 840558 - protein, 916 aa, Homo sapiens
MEGCLGQELFSNHMFLTSLSSPNRQPFVLFGNHSTRENLNAGNFNFPSEGHLVRSTGPGGSFAKHMVAQCVSPKGPLACSRTYLFGATHVPYLGGDSKLPKKTEQIRLLSQIYAAVIEAVLAGIACYAKTSSLTKAKEVAEQTLGSGLDSFELIPFKAALRSKMTFHIHAVNNQGRIVPLDSEDSLSFVKTACMAVYDIPDLLGGNGCLGSVVFSESFLTSQILVKEKDGTVTTETSSVVLTAAVPRFCSWLVEDNEVKLSEKTQQAVRGDESFLGTYLTGGEGAYLYSSNLQSWPEEGNVHFFSSGLLFSHCRHGSIIISKDHMNSISFYDGDSTSTVAALLIDFKSSLLPHLPVHFHGSSNFLMIALFPKSKIYQAFYSEVFSLWKQQDNSGISLKVIQEDGLSVEQKRLHSSAQKLFSALSQPAGEKRSSLKLLSAKLPELDWFLQHFAISSISQEPVMRTHLPVLLQQAEINTTHRIESDKVIISIVTGLPGCHASELCAFLVTLHKECGRWMVYRQIMDSSECFHAAHFQRYLSSALEAQQNRSARQSAYIRKKTRLLVVLQGYTDVIDVVQALQTHPDSNVKASFTIGAITACVEPMSCYMEHRFLFPKCLDQCSQGLVSNVVFTSHTTEQRHPLLVQLQSLIRAANPAAAFILAENGIVTRNEDIELILSENSFSSPEMLRSRYLMYPGWYEGKLNAGSVYPLMVQICVWFGRPLEKTRFVAKCKAIQSSIKPSPFSGNIYHILGKVKFSDSERTMEVCYNTLANSLSIMPVLEGPTPPPDSKSVSQDSSGQQECYLVFIGCSLKEDSIKDWLRQSAKQKPQRKALKTRGMLTQQEIRSIHVKRHLEPLPAGYFYNGTQFVNFFGDKTDFHPLMDQFMNDYVEEANREIEKYNQELEQQEYHDLFELKP

SEQ ID NO: 840559 - protein, 232 aa, Homo sapiens
MEGCLGQELFSNHMFLTSLSSPNRQPFVLFGNHSTRENLNAGNFNFPSEGHLVRSTGPGGSFAKHMVAQCVSPKGPLACSRTYLFGATHVPYLGGDSKLPKKTEQIRLLSQIYAAVIEAVLAGIACYAKTSSLTKAKEVAEQTLGSGLDSFELIPFKAALRSKMTFHIHAVNNQGRIVPLDSEDSLSFVKTACMAVYDIPDLLGGNGCLGSVVFSESFLTSQILVKEKGKYM

SEQ ID NO: 840560 - protein, 916 aa, Homo sapiens; identical to SEQ ID NO: 840558

SEQ ID NO: 840561 - protein, 576 aa, Homo sapiens
MDYNATTPLEPEVIQAMTKAMWEAWGNPSSPYSAGRKAKDIINAARESLAKMIGGKPQDIIFTSGGTESNNLVIHSVVKHFHANRTSKGHTGGHHSPVKGAKPHFITSSVEHDSIRLPLEHLVEEQVAAVTLSLVSKVSGQAEVDDILAAVRPTTRLVTIMLANNETGIVMPVPEISQRIKALNQERVAAGLPPILVHTDAAQALGKQRVDVEDLGVDFLTIVGHKFYGPRIGALYIRGLGEFTPLYPMLFGGGQERNFRPGTENTPMIAGLGKAAELVTQNCEAYEAHMRDVRDYLEERLEAEFGQKRIHLNSQFPGTQRLPNTCNFSIRGPRLQGHVVLAQCRVLMASVGAACHSDHGDQPSPVLLSYGVPFDVARNALRLSVGRSTTRAEVDLVVQDLKQAVAQLEDQASTGAAFPTPLLGSPWQGTGLSLQFPPEGCARMTVSCPLCILSWSASECAPPVSFPGPLQSSQGPGHQRRIGLPTWDRPHRTAHIGPPTWDRPHGTAHMGPPTWDRPHGSAHMGPPTWDRPHGTAHIEPSSSGEAETLSFIHPPHWELGTPVVSALSWKVFLSGR

SEQ ID NO: 840562 - protein, 916 aa, Homo sapiens; identical to SEQ ID NO: 840558

SEQ ID NO: 840563 - protein, 513 aa, Homo sapiens
MEGCLGQELFSNHMFLTSLSSPNRQPFVLFGNHSTRENLNAGNFNFPSEGHLVRSTGPGGSFAKHMVAQCVSPKGPLACSRTYLFGATHVPYLGGDSKLPKKTEQIRLLSQIYAAVIEAVLAGIACYAKTSSLTKAKEVAEQTLGSGLDSFELIPFKAALRSKMTFHIHAVNNQGRIVPLDSEDSLSFVKTACMAVYDIPDLLGGNGCLGSVVFSESFLTSQILVKEKDGTVTTETSSVVLTAAVPRFCSWLVEDNEVKLSEKTQQAVRGDESFLGTYLTGGEGAYLYSSNLQSWPEEGNVHFFSSGLLFSHCRHGSIIISKDHMNSISFYDGDSTSTVAALLIDFKSSLLPHLPVHFHGSSNFLMIALFPKSKIYQAFYSEVFSLWKQQDNSGISLKVIQEDGLSVEQKRLHSSAQKLFSALSQPAGEKRSSLKLLSAKLPELDWFLQHFAISSISQEPVMRTHLPVLLQQAEINTTHRIESDKVEELTRYAGNSQEDDLESLPLNLLCQLT

SEQ ID NO: 840564 - protein, 128 aa, Homo sapiens
VCVGREGEGSPPPQAGAGWSEGPSAGPEQQPQPQSKSSARFPMHTMGITVPRMRLAGVTGKLRAVRLIHLIQGKNRSLAPAPGRGGVLDRGRSNSVLRAHPQIAFLREAGTNDAAGRPWICSFLRAGA

SEQ ID NO: 840565 - protein, 123 aa, Homo sapiens
AVTLLFRGPPLGPSPCVMCSPVLCSPVCPHLGFLSHVRVRVSPAGAGLLLFVCGIAPSRRFRCLSPGGSPLVLPPLPLVLVMPRSGAPVAPSSGVVSSVFFARFALGAQECCLVGVGLFVFVL

SEQ ID NO: 840566 - protein, 285 aa, Homo sapiens
SQLREFVPLNSMAYSSSNSDIEDDSSKSNSNLSLSVGYFPCEDTPCEDTTSWEDAPSKGPSIHFLPPVQGAWGTERIGRRMKRQDQIQDEPEQFCKLSIFLAWDVDIGSDNTDSRANRLLNGDNLWIDKLPKERTKLSVGKLNNLVQEFQIFLENLKDDDAVFPETAQQDFQLSSGSPPEMVQMISQATASQRTSAPEISSILSEQPEKDDTPSHTQAQCCLNFGWAFSWLRQRILPSLLRRDHPVNATKSPHRSAPTKRLFHKTIDFNIQKIMNEDEHIIKTDF

SEQ ID NO: 840567 - protein, 86 aa, Homo sapiens
MVPSHIDAGSASSSPLTQMLTFFGNTLTNTPRNNTLHSSIKLTLHNNHIHGGIYQVSCFGVPRRRVCLGESGTLPRYAQQLWRPHG

SEQ ID NO: 840568 - protein, 109 aa, Homo sapiens
PYSKGDIQGVWWEQRGRNAPLAWRMGPVSLLSRNVEDSLHTAEGTLVKDTVCAKTQRRERQGLSHTIGEYGEIARDAFIPHISMECQLMPGTGNRNRRHIPPFKEFRDW

SEQ ID NO: 840569 - protein, 579 aa, Homo sapiens
MSTASAASSSSSSSAGEMIEAPSQVLNFEEIDYKEIEVEEVVGRGAFGVVCKAKWRAKDVAIKQIESESERKAFIVELRQLSRVNHPNIVKLYGACLNPVCLVMEYAEGGSLYNVLHGAEPLPYYTAAHAMSWCLQCSQGVAYLHSMQPKALIHRDLKPPNLLLVAGGTVLKICDFGTACDIQTHMTNNKGSAAWMAPEVFEGSNYSEKCDVFSWGIILWEVITRRKPFDEIGGPAFRIMWAVHNGTRPPLIKNLPKPIESLMTRCWSKDPSQRPSMEEIVKIMTHLMRYFPGADEPLQYPCQYSDEGQSNSATSTGSFMDIASTNTSNKSDTNMEQVPATNDTIKRLESKLLKNQAKQQSESGRLSLGASRGSSVESLPPTSEGKRMSADMSEIEARIAATTGNGQPRRRSIQDLTVTGTEPGQVSSRSSSPSVRMITTSGPTSEKPTRSHPWTPDDSTDTNGSDNSIPMAYLTLDHQLQPLAPCPNSKESMAVFEQHCKMAQEYMKVQTEIALLLQRKQELVAELDQDEKDQQNTSRLVQEHKKLLDENKSLSTYYQQCKKQLEVIRSQQQKRQGTS

SEQ ID NO: 840570 - protein, 606 aa, Homo sapiens
MSTASAASSSSSSSAGEMIEAPSQVLNFEEIDYKEIEVEEVVGRGAFGVVCKAKWRAKDVAIKQIESESERKAFIVELRQLSRVNHPNIVKLYGACLNPVCLVMEYAEGGSLYNVLHGAEPLPYYTAAHAMSWCLQCSQGVAYLHSMQPKALIHRDLKPPNLLLVAGGTVLKICDFGTACDIQTHMTNNKGSAAWMAPEVFEGSNYSEKCDVFSWGIILWEVITRRKPFDEIGGPAFRIMWAVHNGTRPPLIKNLPKPIESLMTRCWSKDPSQRPSMEEIVKIMTHLMRYFPGADEPLQYPCQYSDEGQSNSATSTGSFMDIASTNTSNKSDTNMEQVPATNDTIKRLESKLLKNQAKQQSESGRLSLGASRGSSVESLPPTSEGKRMSADMSEIEARIAATTAYSKPKRGHRKTASFGNILDVPEIVISGNGQPRRRSIQDLTVTGTEPGQVSSRSSSPSVRMITTSGPTSEKPTRSHPWTPDDSTDTNGSDNSIPMAYLTLDHQLQPLAPCPNSKESMAVFEQHCKMAQEYMKVQTEIALLLQRKQELVAELDQDEKDQQNTSRLVQEHKKLLDENKSLSTYYQQCKKQLEVIRSQQQKRQGTS

SEQ ID NO: 840571 - protein, 606 aa, Homo sapiens; identical to SEQ ID NO: 840570

SEQ ID NO: 840572 - protein, 290 aa, Homo sapiens
MSTASAASSSSSSSAGEMIEAPSQVLNFEEIDYKEIEVEEVVGRGAFGVVCKAKWRAKDVAIKQIESESERKAFIVELRQLSRVNHPNIVKLYGACLNPVCLVMEYAEGGSLYNVLHGAEPLPYYTAAHAMSWCLQCSQGVAYLHSMQPKALIHRDLKPPNLLLVAGGTVLKICDFGTACDIQTHMTNNKGSAAWMAPEVFEGSNYSEKCDVFSWGIILWEVITRRKPFDEIGGPAFRIMWAVHNGTRPPLIKNLPKPIESLMTRCWSKDPSQRPSMEEIVKIMTHLMRV

SEQ ID NO: 840573 - protein, 491 aa, Homo sapiens
MSTASAASSSSSSSAGEMIEAPSQVLNFEEIDYKEIEVEEVVGRGAFGVVCKAKWRAKDVAIKQIESESERKAFIVELRQLSRVNHPNIVKLYGACLNPVCLVMEYAEGGSLYNVLHGAEPLPYYTAAHAMSWCLQCSQGVAYLHSMQPKALIHRDLKPPNLLLVAGGTVLKICDFGTACDIQTHMTNNKGSAAWMAPEVFEGSNYSEKCDVFSWGIILWEVITRRKPFDEIGGPAFRIMWAVHNGTRPPLIKNLPKPIESLMTRCWSKDPSQRPSMEEIVKIMTHLMRYFPGADEPLQYPCQYSDEGQSNSATSTGSFMDIASTNTSNKSDTNMEQVPATNDTIKRLESKLLKNQAKQQSESGRLSLGASRGSSVESLPPTSEGKRMSADMSEIEARIAATTGNGQPRRRSIQDLTVTGTEPGQVSSRSSSPSVRMITTSGPTSEKPTRSHPWTPDDSTDTNGSDNSIPMAYLTLDHQLQARTSCRTGPG

SEQ ID NO: 840574 - protein, 476 aa, Homo sapiens
MSWCLQCSQGVAYLHSMQPKALIHRDLKPPNLLLVAGGTVLKICDFGTACDIQTHMTNNKGSAAWMAPEVFEGSNYSEKCDVFSWGIILWEVITRRKPFDEIGGPAFRIMWAVHNGTRPPLIKNLPKPIESLMTRCWSKDPSQRPSMEEIVKIMTHLMRYFPGADEPLQYPCQYSDEGQSNSATSTGSFMDIASTNTSNKSDTNMEQVPATNDTIKRLESKLLKNQAKQQSESGRLSLGASRGSSVESLPPTSEGKRMSADMSEIEARIAATTAYSKPKRGHRKTASFGNILDVPEIVISGNGQPRRRSIQDLTVTGTEPGQVSSRSSSPSVRMITTSGPTSEKPTRSHPWTPDDSTDTNGSDNSIPMAYLTLDHQLQPLAPCPNSKESMAVFEQHCKMAQEYMKVQTEIALLLQRKQELVAELDQDEKDQQNTSRLVQEHKKLLDENKSLSTYYQQCKKQLEVIRSQQQKRQGTS

SEQ ID NO: 840575 - protein, 215 aa, Homo sapiens
MSEIEARIAATTAYSKPKRGHRKTASFGNILDVPEIVISGNGQPRRRSIQDLTVTGTEPGQVSSRSSSPSVRMITTSGPTSEKPTRSHPWTPDDSTDTNGSDNSIPMAYLTLDHQLQPLAPCPNSKESMAVFEQHCKMAQEYMKVQTEIALLLQRKQELVAELDQDEKDQQNTSRLVQEHKKLLDENKSLSTYYQQCKKQLEVIRSQQQKRQGTS

SEQ ID NO: 840576 - protein, 606 aa, Homo sapiens; identical to SEQ ID NO: 840570

SEQ ID NO: 840577 - protein, 606 aa, Homo sapiens; identical to SEQ ID NO: 840570

SEQ ID NO: 840578 - protein, 606 aa, Homo sapiens; identical to SEQ ID NO: 840570

SEQ ID NO: 840579 - protein, 440 aa, Homo sapiens
MSTASAASSSSSSSAGEMIEAPSQVLNFEEIDYKEIEVEEVVGRGAFGVVCKAKWRAKDVAIKQIESESERKAFIVELRQLSRVNHPNIVKLYGACLNPVCLVMEYAEGGSLYNVLHGAEPLPYYTAAHAMSWCLQCSQGVAYLHSMQPKALIHRDLKPPNLLLVAGGTVLKICDFGTACDIQTHMTNNKGSAAWMAPEVFEGSNYSEKCDVFSWGIILWEVITRRKPFDEIGGPAFRIMWAVHNGTRPPLIKNLPKPIESLMTRCWSKDPSQRPSMEEIVKIMTHLMRYFPGADEPLQYPCQYSDEGQSNSATSTGSFMDIASTNTSNKSDTNMEQVPATNDTIKRLESKLLSGSSVESLPPTSEGKRMSADMSEIEARIAATTAYSKPKRGHRKTASFGNILDVPEIVISGNGQPRRRSIQDLTVTGTEPGQVRQHSN

SEQ ID NO: 840580 - protein, 520 aa, Homo sapiens
MCSDSACIHIVSFVICNKVLFSLCLSFAVLHGAEPLPYYTAAHAMSWCLQCSQGVAYLHSMQPKALIHRDLKPPNLLLVAGGTVLKICDFGTACDIQTHMTNNKGSAAWMAPEVFEGSNYSEKCDVFSWGIILWEVITRRKPFDEIGGPAFRIMWAVHNGTRPPLIKNLPKPIESLMTRCWSKDPSQRPSMEEIVKIMTHLMRYFPGADEPLQYPCQYSDEGQSNSATSTGSFMDIASTNTSNKSDTNMEQVPATNDTIKRLESKLLKNQAKQQSESGRLSLGASRGSSVESLPPTSEGKRMSADMSEIEARIAATTAYSKPKRGHRKTASFGNILDVPEIVISGNGQPRRRSIQDLTVTGTEPGQVSSRSSSPSVRMITTSGPTSEKPTRSHPWTPDDSTDTNGSDNSIPMAYLTLDHQLQPLAPCPNSKESMAVFEQHCKMAQEYMKVQTEIALLLQRKQELVAELDQDEKDQQNTSRLVQEHKKLLDENKSLSTYYQQCKKQLEVIRSQQQKRQGTS

SEQ ID NO: 840581 - protein, 491 aa, Homo sapiens; identical to SEQ ID NO: 840573

SEQ ID NO: 840582 - protein, 518 aa, Homo sapiens
MSTASAASSSSSSSAGEMIEAPSQVLNFEEIDYKEIEVEEVVGRGAFGVVCKAKWRAKDVAIKQIESESERKAFIVELRQLSRVNHPNIVKLYGACLNPVCLVMEYAEGGSLYNVLHGAEPLPYYTAAHAMSWCLQCSQGVAYLHSMQPKALIHRDLKPPNLLLVAGGTVLKICDFGTACDIQTHMTNNKGSAAWMAPEVFEGSNYSEKCDVFSWGIILWEVITRRKPFDEIGGPAFRIMWAVHNGTRPPLIKNLPKPIESLMTRCWSKDPSQRPSMEEIVKIMTHLMRYFPGADEPLQYPCQYSDEGQSNSATSTGSFMDIASTNTSNKSDTNMEQVPATNDTIKRLESKLLKNQAKQQSESGRLSLGASRGSSVESLPPTSEGKRMSADMSEIEARIAATTAYSKPKRGHRKTASFGNILDVPEIVISGNGQPRRRSIQDLTVTGTEPGQVSSRSSSPSVRMITTSGPTSEKPTRSHPWTPDDSTDTNGSDNSIPMAYLTLDHQLQARTSCRTGPG

SEQ ID NO: 840583 - protein, 421 aa, Homo sapiens
MTNNKGSAAWMAPEVFEGSNYSEKCDVFSWGIILWEVITRRKPFDEIGGPAFRIMWAVHNGTRPPLIKNLPKPIESLMTRCWSKDPSQRPSMEEIVKIMTHLMRYFPGADEPLQYPCQYSDEGQSNSATSTGSFMDIASTNTSNKSDTNMEQVPATNDTIKRLESKLLKNQAKQQSESGRLSLGASRGSSVESLPPTSEGKRMSADMSEIEARIAATTAYSKPKRGHRKTASFGNILDVPEIVISGNGQPRRRSIQDLTVTGTEPGQVSSRSSSPSVRMITTSGPTSEKPTRSHPWTPDDSTDTNGSDNSIPMAYLTLDHQLQPLAPCPNSKESMAVFEQHCKMAQEYMKVQTEIALLLQRKQELVAELDQDEKDQQNTSRLVQEHKKLLDENKSLSTYYQQCKKQLEVIRSQQQKRQGTS

SEQ ID NO: 840584 - protein, 606 aa, Homo sapiens; identical to SEQ ID NO: 840570

SEQ ID NO: 840585 - protein, 606 aa, Homo sapiens; identical to SEQ ID NO: 840570

SEQ ID NO: 840586 - protein, 472 aa, Homo sapiens
MSTASAASSSSSSSAGEMIEAPSQVLNFEEIDYKEIEVEEVVGRGAFGVVCKAKWRAKDVAIKQIESESERKAFIVELRQLSRVNHPNIVKLYGACLNPVCLVMEYAEGGSLYNVLHGAEPLPYYTAAHAMSWCLQCSQGVAYLHSMQPKALIHRDLKPPNLLLVAGGTVLKICDFGTACDIQTHMTNNKGSAAWMAPEVFEGSNYSEKCDVFSWGIILWEVITRRKPFDEIGGPAFRIMWAVHNGTRPPLIKNLPKPIESLMTRCWSKDPSQRPSMEEIVKIMTHLMRYFPGADEPLQYPCQYSDEGQSNSATSTGSFMDIASTNTSNKSDTNMEQVPATNDTIKRLESKLLKNQAKQQSESGRLSLGASRGSSVESLPPTSEGKRMSADMSEIEARIAATTAYSKPKRGHRKTASFGNILDVPEIVISGIIDHLSWSNSCGTGIMIPGTCKMLLAPIFTRHENGYLACSN

SEQ ID NO: 840587 - protein, 215 aa, Homo sapiens
LKSNRIPLPEKEYSGWYQDPLTRIGAQDLFDYITEKGPLGEGPSRCFFGQVVAAIQHCHSRGVVHRDIKDENILIDLRRGCAKLIDFGSGALLHDEPYTDFDGTRVYSPPEWISRHQYHALPATVWSLGILLYDMVCGDIPFERDQEILEAELHFPAHVSPDCCALIRRCLAPKPSSRPSLEEILLDPWMQTPAEDVPLNPSKGGPAPLAWSLLP

SEQ ID NO: 840588 - protein, 153 aa, Homo sapiens
ALGLARAANLNAAPSAGASGPPVSLLSTLAPPSPGSPAALPRASTPCGLSGFSGLNLRSATSMLTKPLQGPPAPPGTPTPPPGGKDREAFEAEYRLGPLLGKGGFGTVFAGHRLTDRLQVSVMRVLGGSGACGGGGGPGPGMLVDRGVSLQSV

SEQ ID NO: 840589 - protein, 86 aa, Homo sapiens
DYITEKGPLGEGPSRCFFGQVVAAIQHCHSRGVVHRDIKDENILIDLRRGCAKLIDFGSGALLHDEPYTDFDGKASLNLPGGIVFT

SEQ ID NO: 840590 - protein, 373 aa, Homo sapiens
ALGLARAANLNAAPSAGASGPPVSLLSTLAPPSPGSPAALPRASTPCGLSGFSGLNLRSATSMLTKPLQGPPAPPGTPTPPPGGKDREAFEAEYRLGPLLGKGGFGTVFAGHRLTDRLQVAIKVIPRNRVLGWSPLSDSVTCPLEVALLWKVGAGGGHPGVIRLLDWFETQEGFMLVLERPLPAQDLFDYITEKGPLGEGPSRCFFGQVVAAIQHCHSRGVVHRDIKDENILIDLRRGCAKLIDFGSGALLHDEPYTDFDGTRVYSPPEWISRHQYHALPATVWSLGILLYDMVCGDIPFERDQEILEAELHFPAHVSPDCCALIRRCLAPKPSSRPSLEEILLDPWMQTPAEDVPLNPSKGGPAPLAWSLLP

SEQ ID NO: 840591 - protein, 373 aa, Homo sapiens; identical to SEQ ID NO: 840590

SEQ ID NO: 840592 - protein, 86 aa, Homo sapiens
IFPLCFLAYRLLCPNPPVPGPQTFFPTLTGRDPAGPLDANTSRGCTPQPLQRRPCPFGLVLATLSLAWPGLAPNGQKSHPMAMSQG

SEQ ID NO: 840593 - protein, 191 aa, Homo sapiens
RAANLNAAPSAGASGPPVSLLSTLAPPSPGSPAALPRASTPCGLSGFSGLNLRSATSMLTKPLQGPPAPPGTPTPPPGEYILPYCNQTGWAGMMGCSAGGGSRGWAQHAATLTSSPPPAYGGKDREAFEAEYRLGPLLGKGGFGTVFAGHRLTDRLQVSVMRVLGGSGACGGGGGPGPGMLVDRGVSLQSV

SEQ ID NO: 840594 - protein, 47 aa, Homo sapiens
CQKEEQAHFEKYTDVGNCEYYPKKSLKGSHPHRVTSRTCHCKSLVLI

SEQ ID NO: 840595 - protein, 76 aa, Homo sapiens
GYFSERENGYPMAQTQNSPSSPNFDYRAVQFGCRFRCTHMSYISVDYSQVQMLILNSTLTFFLATQVHWFSSTERP

SEQ ID NO: 840596 - protein, 119 aa, Homo sapiens
CVYGCVFVCVCVCMCILCVCLNGCVFVCVCVCVVLRTPHISWQWTARTLLDPHGQGKPAEPLFSPRHPTSANGELEGRGLSQQQKLQKDFPRLTWTVVRTQPSLSSLSLAPHTGAVCRG

SEQ ID NO: 840597 - protein, 72 aa, Homo sapiens
EGKDTCSNTNNNFTSPLLKKSQKARSCKEPGASSQQPKPKKSRLRWEALREYSSVTETEAWRKKSMPPESGL

SEQ ID NO: 840598 - protein, 289 aa, Homo sapiens
IVGRQLNSAPGKMEAAETEAEAAALEVLAEVAGILEPVGLQEEAELPAKILVEFVVDSQKKDKLLCSQLQVADFLQNILAQEDTAKGLDPLASEDTSRQKAIAAKEQWKELKATYREHVEAIKIGLTKALTQMEEAQRKRTQLREAFEQLQAKKQMAMEKRRAVQNQWQLQQEKHLQHLAEVSAEVRERKTGTQQELDGVFQKLGNLKQQAEQERDKLQRYQTFLQLLYTLQGKLLFPEAEAEAENLPDDKPQQPTRPQEQSTGDTMGRDPGVSFKAVGLQPAGDVNLP

SEQ ID NO: 840599 - protein, 289 aa, Homo sapiens; identical to SEQ ID NO: 840598

SEQ ID NO: 840600 - protein, 289 aa, Homo sapiens; identical to SEQ ID NO: 840598

SEQ ID NO: 840601 - protein, 289 aa, Homo sapiens; identical to SEQ ID NO: 840598

SEQ ID NO: 840602 - protein, 289 aa, Homo sapiens; identical to SEQ ID NO: 840598

SEQ ID NO: 840603 - protein, 157 aa, Homo sapiens [sequence omitted]

SEQ ID NO: 840604 - protein, 242 aa, Homo sapiens
IVGRQLNSAPGKMEAAETEAEAAALEVLAEVAGILEPVGLQEEAELPAKILVEFVVDSQKKDKLLCSQLQVADFLQNILAQEDTAKGLDPLASEDTSRQKAIAAKEQWKELKATYREHVEAIKIGLTKALTQMEEAQRKRTQLREAFEQLQAKKQMAMEKRRAVQNQWQLQQEKHLQHLAEVSAEGKLLFPEAEAEAENLPDDKPQQPTRPQEQSTGDTMGRDPGVSFKAVGLQPAGDVNLP

SEQ ID NO: 840605 - protein, 242 aa, Homo sapiens; identical to SEQ ID NO: 840604

SEQ ID NO: 840606 - protein, 110 aa, Homo sapiens
MEEAQRKRTQLREAFEQLQAKKQMAMEKRRAVQNQWQLQQEKHLQHLAEVSAEGKLLFPEAEAEAENLPDDKPQQPTRPQEQSTGDTMGRDPGVSFKAVGLQPAGDVNLP

SEQ ID NO: 840607 - protein, 289 aa, Homo sapiens; identical to SEQ ID NO: 840598

SEQ ID NO: 840608 - protein, 289 aa, Homo sapiens; identical to SEQ ID NO: 840598

SEQ ID NO: 840609 - protein, 157 aa, Homo sapiens [sequence omitted]

SEQ ID NO: 840610 - protein, 214 aa, Homo sapiens
NTGPSQDLAEAGSQKQEQKQEAGQKAIAAKEQWKELKATYREHVEAIKIGLTKALTQMEEAQRKRTQLREAFEQLQAKKQMAMEKRRAVQNQWQLQQEKHLQHLAEVSAEVRERKTGTQQELDGVFQKLGNLKQQAEQERDKLQRYQTFLQLLYTLQGKLLFPEAEAEAENLPDDKPQQPTRPQEQSTGDTMGRDPGVSFKAVGLQPAGDVNLP

SEQ ID NO: 840611 - protein, 273 aa, Homo sapiens
IVGRQLNSAPGKMEAAETEAEAAALEVLAEVAGILEPVGLQEEAELPAKILVEFVVDSQKKDKLLCSQLQVADFLQNILAQEDTAKGLDPLASEDTSRQKAIAAKEQWKELKATYREHVEAIKIGLTKALTQMEEAQRKRTQLREAFEQLQAKKQMAMEKRRAVQNQWQLQQEKHLQHLAEVSAEVRERKTGTQQELDGVFQKLGNLKQQAEQERDKLQRVSCCSLRLRLRQRIFQMINPSSRLDPRSRVQETPWGETLVCPSRLLVYNLLEM

SEQ ID NO: 840612 - protein, 239 aa, Homo sapiens
IVGRQLNSAPGKMEAAETEAEAAALEVLAEVAGILEPVGLQEEAELPAKILVEFVVDSQKKDKLLCSQLQVADFLQNILAQEDTAKGLDPLASEDTSRQKAIAAKEQWKELKATYREHVEAIKIGLTKALTQMEEAQRKRTQLREAFEQLQAKKQMAMEKRRAVQNQWQLQQEKHLQHLAEVSAEVRERKTGTQQELDGVFQKLGNLKLSPPRANPCLLPQASDFPHLPTIITGKTVNS

SEQ ID NO: 840613 - protein, 89 aa, Homo sapiens
MAKGDPKKPNGKMSAYAFFVQTCREERKKKYQEVPVNFAEFSKKCSRRWKTMSRKEKSKFDKLAKVDKVRYDREMKDYGPAKGGKKKKD

SEQ ID NO: 840614 - protein, 102 aa, Homo sapiens
LQTHTYFISQMGSKTRYEDGKEQLAFHTHIPGSRNHFTFPNTSVPDLSLCAALHSTYLPNVFQHFRPWDQVETAPPFQRQAPLSMHSSPNRNLVSPLVLLQL

SEQ ID NO: 840615 - protein, 52 aa, Homo sapiens
CEALEESSSCGRECFRPSRETSNIRIRGSHSAPSARYILQLTQGGVHPLEKT

SEQ ID NO: 840616 - protein, 37 aa, Homo sapiens
EAQSALPPSLALVGISPKPESPTGHTWTSLLHTTLPL

SEQ ID NO: 840617 - protein, 253 aa, Homo sapiens
LSLGLLVADFGAMVNNPHLSDVQFQTDSGEVLYAHKFVLYARCPLLIQYVNNEGFSAVEDGVLTQRVLLGDVSTEAARTFLHYLYTADTGLPPGLSSELSSLAHRFGVSELVHLCEQVPIATDSEGKPWEEKEAENCESRAENFQELLRSMWADEEEEAETLLKSKDHEEDQENVNEAEMEEIYEFAATQRKLLQEERAAGAGEDADWLEGGSPVSGQLLAGVQVQKQWDKVEEMEPLEPGRDEAATTWEKMG

SEQ ID NO: 840618 - protein, 69 aa, Homo sapiens
CGCHHRGGGSPRMLLITHRAWGSPTTEGGPGDAKSCAFHRLGSRAPTAAGCRSVFVYMPSPGGSPAFIS

SEQ ID NO: 840619 - protein, 33 aa, Homo sapiens
YTEKNMGYLIYIWGSGDVSWKSSLKYFEIYVKT

SEQ ID NO: 840620 - protein, 68 aa, Homo sapiens
MKLQTLMDWEEAHEKNRKNKRKAEALVAALQTCRVQDPPGTSTDCYLLPVLKPGHFKKNCPSHKKKPP

SEQ ID NO: 840621 - protein, 129 aa, Homo sapiens
KSCRSRKTQSNPASQVTFPLLCCPTGPPPCDIQKLKLLNLSKLSILFCTCGPVSPLEPQFSDMCNERINYRLKGLHADTHRYKHIHTTHRVTHRHAHNTQKYTKRYSSRRATQTHIVRSPRLNEENCEA

SEQ ID NO: 840622 - protein, 32 aa, Homo sapiens
GNSNRALLDTYYVPAPSTSRNNSKSIYLLNTY

SEQ ID NO: 840623 - protein, 82 aa, Homo sapiens
FNLFFKVFLDKVRHLITWKVTAERNKKRNCTYSKISPTSSSAAPVTGRSSPLTNKKRNPTGGEHTITAGTRLRGFPLHGKQD

SEQ ID NO: 840624 - protein, 126 aa, Homo sapiens
QFPSLLSLSPAPFTLKRARCGALVNRPHSAPSTPQHSGIVKAFGLSETDGTVATSCWSVVSIWILKIGLVIKMWPFNSLPGNILYMHREKFRDAGSTTRARDPSGTIVNIPGETNQEFPGGEGTGL

SEQ ID NO: 840625 - protein, 1834 aa, Homo sapiens
MSAGGRDEERRKLADIIHHWNANRLDLFEISQPTEDLEFHGVMRFYFQDKAAGNFATKCIRVSSTATTQDVIETLAEKFRPDMRMLSSPKYSLYEVHVSGERRLDIDEKPLVVQLNWNKDDREGRFVLKNENDAIPPKAQSNGPEKQEKEGVIQNFKRTLSKKEKKEKKKREKEALRQASDKDDRPFQGEDVENSRLAAEVYKDMPETSFTRTISNPEVVMKRRRQQKLEKRMQEFRSSDGRPDSGGTLRIYADSLKPNIPYKTILLSTTDPADFAVAEALEKYGLEKENPKDYCIARVMLPPGAQHSDEKGAKEIILDDDECPLQIFREWPSDKGILVFQLKRRPPDHIPKKTKKHLEGKTPKGKERADGSGYGSTLPPEKLPYLVELSPGRRNHFAYYNYHTYEDGSDSRDKPKLYRLQLSVTEVGTEKLDDNSIQLFGPGIQPHHCDLTNMDGVVTVTPRSMDAETYVEGQRISETTMLQSGMKVQFGASHVFKFVDPSQDHALAKRSVDGGLMVKGPRHKPGIVQETTFDLGGDIHSGTALPTSKSTTRLDSDRVSSASSTAERGMVKPMIRVEQQPDYRRQESRTQDASGPELILPASIEFRESSEDSFLSAIINYTNSSTVHFKLSPTYVLYMACRYVLSNQYRPDISPTERTHKVIAVVNKMVSMMEGVIQKQKNIAGALAFWMANASELLNFIKQDRDLSRITLDAQDVLAHLVQMAFKYLVHCLQSELNNYMPAFLDDPEENSLQRPKIDDVLHTLTGAMSLLRRCRVNAALTIQLFSQLFHFINMWLFNRLVTDPDSGLCSHYWGAIIRQQLGHIEAWAEKQGLELAADCHLSRIVQATTLLTMDKYAPDDIPNINSTCFKLNSLQLQALLQNYHCAPDEPFIPTDLIENVVTVAENTADELARSDGREVQLEEDPDLQLPFLLPEDGYSCDVVRNIPNGLQEFLDPLCQRGFCRLIPHTRSPGTWTIYFEGADYESHLLRENTELAQPLRKEPEIITVTLKKQNGMGLSIVAAKGAGQDKLGIYVKSVVKGGAADVDGRLAAGDQLLSVDGRSLVGLSQERAAELMTRTSSVVTLEVAKQGAIYHGLATLLNQPSPMMQRISDRRGSGKPRPKSEGFELYNNSTQNGSPESPQLPWAEYSEPKKLPGDDRLMKNRADHRSSPNVANQPPSPGGKSAYASGTTAKITSVSTGNLCTEEQTPPPRPEAYPIPTQTYTREYFTFPASKSQDRMAPPQNQWPNYEEKPHMHTDSNHSSIAIQRVTRSQEELREDKAYQLERHRIEAAMDRKSDSDMWINQSSSLDSSTSSQEHLNHSSKSVTPASTLTKSGPGRWKTPAAIPATPVAVSQPIRTDLPPPPPPPPVHYAGDFDGMSMDLPLPPPPSANQIGLPSAQVAAAERRKREEHQRWYEKEKARLEEERERKRREQERKLGQMRTQSLNPAPFSPLTAQQMKPEKPSTLQRPQETVIRELQPQQQPRTIERRDLQYITVSKEELSSGDSLSPDPWKRDAKEKLEKQQQMHIVDMLSKEIQELQSKPDRSAEESDRLRKLMLEWQFQKRLQESKQKDEDDEEEEDDDVDTMLIMQRLEAERRARTAMPAISVLDLLQDEERRRQQQLEEMRKREAEDRARQEEERRRQEEERTKRDAEEKRRQEEGYYSRLEAERRRQHDEAARRLLEPEAPGLCRPPLPRDYEPPSPSPAPGAPPPPPQRNASYLKTQVLSPDSLFTAKFVAYNEEEEEEDCSLAGPNSYPGSTGAAVGAHDACRDAKEKRSKSQDADSPGSSGAPENLTFKERQRLFSQGQDVSNKVKASRKLTELENELNTK

SEQ ID NO: 840626 - protein, 1595 aa, Homo sapiens
MTCVRCSVDIETVLSMSKSQFPYKTFRSSTTDPADCAVAAARQKSGSYLENPCGYCIARVMLPPGAQHSDEKGAKEIILDDDECPLQIFREWPSDKGILVFQLKRRPPDHIPKKTKKHLEGKTPKGKERADGSGYGSTLPPEKLPYLVELSPGRRNHFAYYNYHTYEDGSDSRDKPKLYRLQLSVTEVGTEKLDDNSIQLFGPGIQPHHCDLTNMDGVVTVTPRSMDAETYVEGQRISETTMLQSGMKVQFGASHVFKFVDPSQDHALAKRSVDGGLMVKGPRHKPGIVQETTFDLGGDIHSGTALPTSKSTTRLDSDRVSSASSTAERGMVKPMIRVEQQPDYRRQESRTQDASGPELILPASIEFRESSEDSFLSAIINYTNSSTVHFKLSPTYVLYMACRYVLSNQYRPDISPTERTHKVIAVVNKMVSMMEGVIQKQKNIAGALAFWMANASELLNFIKQDRDLSRITLDAQDVLAHLVQMAFKYLVHCLQSELNNYMPAFLDDPEENSLQRPKIDDVLHTLTGAMSLLRRCRVNAALTIQLFSQLFHFINMWLFNRLVTDPDSGLCSHYWGAIIRQQLGHIEAWAEKQGLELAADCHLSRIVQATTLLTMDKYAPDDIPNINSTCFKLNSLQLQALLQNYHCAPDEPFIPTDLIENVVTVAENTADELARSDGREVQLEEDPDLQLPFLLPEDGYSCDVVRNIPNGLQEFLDPLCQRGFCRLIPHTRSPGTWTIYFEGADYESHLLRENTELAQPLRKEPEIITVTLKKQNGMGLSIVAAKGAGQDKLGIYVKSVVKGGAADVDGRLAAGDQLLSVDGRSLVGLSQERAAELMTRTSSVVTLEVAKQGAIYHGLATLLNQPSPMMQRISDRRGSGKPRPKSEGFELYNNSTQNGSPESPQLPWAEYSEPKKLPGDDRLMKNRADHRSSPNVANQPPSPGGKSAYASGTTAKITSVSTGNLCTEEQTPPPRPEAYPIPTQTYTREYFTFPASKSQDRMAPPQNQWPNYEEKPHMHTDSNHSSIAIQRVTRSQEELREDKAYQLERHRIEAAMDRKSDSDMWINQSSSLDSSTSSQEHLNHSSKSVTPASTLTKSGPGRWKTPAAIPATPVAVSQPIRTDLPPPPPPPPVHYAGDFDGMSMDLPLPPPPSANQIGLPSAQVAAAERRKREEHQRWYEKEKARLEEERERKRREQERKLGQMRTQSLNPAPFSPLTAQQMKPEKPSTLQRPQETVIRELQPQQQPRTIERRDLQYITVSKEELSSGDSLSPDPWKRDAKEKLEKQQQMHIVDMLSKEIQELQSKPDRSAEESDRLRKLMLEWQFQKRLQESKQKDEDDEEEEDDDVDTMLIMQRLEAERRARTAMPAISVLDLLQDEERRRQQQLEEMRKREAEDRARQEEERRRQEEERTKRDAEEKRRQEEGYYSRLEAERRRQHDEAARRLLEPEAPGLCRPPLPRDYEPPSPSPAPGAPPPPPQRNASYLKTQVLSPDSLFTAKFVAYNEEEEEEDCSLAGPNSYPGSTGAAVGAHDACRDAKEKRSKSQDADSPGSSGAPENLTFKERQRLFSQGQDVSNKVKASRKLTELENELNTK

SEQ ID NO: 840627 - protein, 1890 aa, Homo sapiens
MSAGGRDEERRKLADIIHHWNANRLDLFEISQPTEDLEFHGVMRFYFQDKAAGNFATKCIRVSSTATTQDVIETLAEKFRPDMRMLSSPKYSLYEVHVSGERRLDIDEKPLVVQLNWNKDDREGRFVLKNENDAIPPKAQSNGPEKQEKEGVIQNFKRTLSKKEKKEKKKREKEALRQASDKDDRPFQGEDVENSRLAAEVYKDMPETSFTRTISNPEVVMKRRRQQKLEKRMQEFRSSDGRPDSGGTLRIYADSLKPNIPYKTILLSTTDPADFAVAEALEKYGLEKENPKDYCIARVMLPPGAQHSDEKGAKEIILDDDECPLQIFREWPSDKGILVFQLKRRPPDHIPKKTKKHLEGKTPKGKERADGSGYGSTLPPEKLPYLVELSPDGSDSRDKPKLYRLQLSVTEVGTEKLDDNSIQLFGPGIQPHHCDLTNMDGVVTVTPRSMDAETYVEGQRISETTMLQSGMKVQFGASHVFKFVDPSQDHALAKRSVDGGLMVKGPRHKPGIVQETTFDLGGDIHSGTALPTSKSTTRLDSDRVSSASSTAERGMVKPMIRVEQQPDYRRQESRTQDASGPELILPASIEFRESSEDSFLSAIINYTNSSTVHFKLSPTYVLYMACRYVLSNQYRPDISPTERTHKVIAVVNKMVSMMEGVIQEVCSVYKKQKNIAGALAFWMANASELLNFIKQDRDLSRITLDAQDVLAHLVQMAFKYLVHCLQSELNNYMPAFLDDPEENSLQRPKIDDVLHTLTGAMSLLRRCRVNAALTIQLFSQLFHFINMWLFNRLVTDPDSGLCSHYWGAIIRQQLGHIEAWAEKQGLELAADCHLSRIVQATTLLTMDKYAPDDIPNINSTCFKLNSLQLQALLQNYHCAPDEPFIPTDLIENVVTVAENTADELARSDGREVQLEEDPDLQLPFLLPEDGYSCDVVRNIPNGLQEFLDPLCQRGFCRLIPHTRSPGTWTIYFEGADYESHLLRENTELAQPLRKEPEIITVTLKKQNGMGLSIVAAKGAGQDKLGIYVKSVVKGGAADVDGRLAAGDQLLSVDGRSLVGLSQERAAELMTRTSSVVTLEVAKQGAIYHGLATLLNQPSPMMQRISDRRGSGKPRPKSEGFELYNNSTQNGSPESPQLPWAEYSEPKKLPGDDRLMKNRADHRSSPNVANQPPSPGGKSAYASGTTAKITSVSTGNLCTEEQTPPPRPEAYPIPTQTYTREYFTFPASKSQDRMAPPQNQWPNYEEKPHMHTDSNHSSIAIQRVTRSQEELREDKAYQLERHRIEAAMDRKSDSDMWINQSSSLDSSTSSQEHLNHSSKSVTPASTLTKSGPGRWKTPAAIPATPVAVSQPIRTDLPPPPPPPPVHYAGDFDGMSMDLPLPPPPSANQIGLPSAQVAAAERRKREEHQRWYEKEKARLEEERERKRREQERKLGQMRTQSLNPAPFSPLTAQQMKPEKPSTLQRPQETVIRELQPQQQPRTIERRDLQYITVSKEELSSGDSLSPDPWKRDAKEKLEKQQQMHIVDMLSKEIQELQSKPDRSAEESDRLRKLMLEWQFQKRLQESKQKDEDDEEEEDDDVDTMLIMQRLEAERRARLQDEERRRQQQLEEMRKREAEDRARQEEERRRQEEERTKRDAEEKRRQEEGYYSRLEAERRRQHDEAARRLLEPEAPGLCRPPLPRDYEPPSPSPAPGAPPPPPQRNASYLKTQVLSPDSLFTAKFVAYNEEEEEEDCSLAGQDKYSSTRKSHGDLLPAPLKPRPPPCQPRPASDGVFLSNSFQPPSAKANSTAHKKGQPLPPPKKSSSYHPSHCKGPNSYPGSTGAAVGAHDACRDAKEKRSKSQDADSPGSSGAPENLTFKERQRLFSQGQDVSNKVKASRKLTELENELNTK

SEQ ID NO: 840628 - protein, 1883 aa, Homo sapiens [sequence omitted]

SEQ ID NO: 840629 - protein, 804 aa, Homo sapiens
SVSGLGYHVNLLTWSPHFSDRRGSGKPRPKSEGFELYNNSTQNGSPESPQLPWAEYSEPKKLPGDDRLMKNRADHRSSPNVANQPPSPGGKSAYASGTTAKITSVSTGNLCTEEQTPPPRPEAYPIPTQTYTREYFTFPASKSQDRMAPPQNQWPNYEEKPHMHTDSNHSSIAIQRVTRSQEELREDKAYQLERHRIEAAMDRKSDSDMWINQSSSLDSSTSSQEHLNHSSKSVTPASTLTKSGPGRWKTPAAIPATPVAVSQPIRTDLPPPPPPPPVHYAGDFDGMSMDLPLPPPPSANQIGLPSAQVAAAERRKREEHQRWYEKEKARLEEERERKRREQERKLGQMRTQSLNPAPFSPLTAQQMKPEKPSTLQRPQETVIRELQPQQQPRTIERRDLQYITVSKEELSSGDSLSPDPWKRDAKEKLEKQQQMHIVDMLSKEIQELQSKPDRSAEESDRLRKLMLEWQFQKRLQESKQKDEDDEEEEDDDVDTMLIMQRLEAERRARLQDEERRRQQQLEEMRKREAEDRARQEEERRRQEEERTKRDAEEKRRQEEGYYSRLEAERRRQHDEAARRLLEPEAPGLCRPPLPRDYEPPSPSPAPGAPPPPPQRNASYLKTQVLSPDSLFTAKFVAYNEEEEEEDCSLAGQDKYSSTRKSHGDLLPAPLKPRPPPCQPRPASDGVFLSNSFQPPSAKANSTAHKKGQPLPPPKKSSSYHPSHCKGPNSYPGSTGAAVGAHDACRDAKEKRSKSQDADSPGSSGAPENLTFKERQRLFSQGQDVSNKVKASRKLTELENELNTK

SEQ ID NO: 840630 - protein, 604 aa, Homo sapiens [sequence omitted]

SEQ ID NO: 840631 - protein, 129 aa, Homo sapiens
MTLVVRLLSLLLPTRVPSDTSAKANSTAHKKGQPLPPPKKSSSYHPSHCKGPNSYPGSTGAAVGAHDACRDAKEKRSKSQDADSPGSSGAPENLTFKERQRLFSQGQDVSNKVKASRKLTELENELNTK

SEQ ID NO: 840632 - protein, 1883 aa, Homo sapiens [sequence omitted]

SEQ ID NO: 840633 - protein, 1817 aa, Homo sapiens
MSAGGRDEERRKLADIIHHWNANRLDLFEISQPTEDLEFHGVMRFYFQDKAAGNFATKCIRVSSTATTQDVIETLAEKFRPDMRMLSSPKYSLYEVHVSGERRLDIDEKPLVVQLNWNKDDREGRFVLKNENDAIPPKAQSNGPEKQEKEGVIQNFKRTLSKKEKKEKKKREKEALRQASDKDDRPFQGEDVENSRLAAEVYKDMPETSFTRTISNPEVVMKRRRQQKLEKRMQEFRSSDGRPDSGGTLRIYADSLKPNIPYKTILLSTTDPADFAVAEALEKYGLEKENPKDYCIARVMLPPGAQHSDEKGAKEIILDDDECPLQIFREWPSDKGILVFQLKRRPPDHIPKKTKKHLEGKTPKGKERADGSGYGSTLPPEKLPYLVELSPDGSDSRDKPKLYRLQLSVTEVGTEKLDDNSIQLFGPGIQPHHCDLTNMDGVVTVTPRSMDAETYVEGQRISETTMLQSGMKVQFGASHVFKFVDPSQDHALAKRSVDGGLMVKGPRHKPGIVQETTFDLGGDIHSGTALPTSKSTTRLDSDRVSSASSTAERGMVKPMIRVEQQPDYRRQESRTQDASGPELILPASIEFRESSEDSFLSAIINYTNSSTVHFKLSPTYVLYMACRYVLSNQYRPDISPTERTHKVIAVVNKMVSMMEGVIQKQKNIAGALAFWMANASELLNFIKQDRDLSRITLDAQDVLAHLVQMAFKYLVHCLQSELNNYMPAFLDDPEENSLQRPKIDDVLHTLTGAMSLLRRCRVNAALTIQLFSQLFHFINMWLFNRLVTDPDSGLCSHYWGAIIRQQLGHIEAWAEKQGLELAADCHLSRIVQATTLLTMDKYAPDDIPNINSTCFKLNSLQLQALLQNYHCAPDEPFIPTDLIENVVTVAENTADELARSDGREVQLEEDPDLQLPFLLPEDGYSCDVVRNIPNGLQEFLDPLCQRGFCRLIPHTRSPGTWTIYFEGADYESHLLRENTELAQPLRKEPEIITVTLKKQNGMGLSIVAAKGAGQDKLGIYVKSVVKGGAADVDGRLAAGDQLLSVDGRSLVGLSQERAAELMTRTSSVVTLEVAKQGAIYHGLATLLNQPSPMMQRISDRRGSGKPRPKSEGFELYNNSTQNGSPESPQLPWAEYSEPKKLPGDDRLMKNRADHRSSPNVANQPPSPGGKSAYASGTTAKITSVSTGNLCTEEQTPPPRPEAYPIPTQTYTREYFTFPASKSQDRMAPPQNQWPNYEEKPHMHTDSNHSSIAIQRVTRSQEELREDKAYQLERHRIEAAMDRKSDSDMWINQSSSLDSSTSSQEHLNHSSKSVTPASTLTKSGPGRWKTPAAIPATPVAVSQPIRTDLPPPPPPPPVHYAGDFDGMSMDLPLPPPPSANQIGLPSAQVAAAERRKREEHQRWYEKEKARLEEERERKRREQERKLGQMRTQSLNPAPFSPLTAQQMKPEKPSTLQRPQETVIRELQPQQQPRTIERRDLQYITVSKEELSSGDSLSPDPWKRDAKEKLEKQQQMHIVDMLSKEIQELQSKPDRSAEESDRLRKLMLEWQFQKRLQESKQKDEDDEEEEDDDVDTMLIMQRLEAERRARLQDEERRRQQQLEEMRKREAEDRARQEEERRRQEEERTKRDAEEKRRQEEGYYSRLEAERRRQHDEAARRLLEPEAPGLCRPPLPRDYEPPSPSPAPGAPPPPPQRNASYLKTQVLSPDSLFTAKFVAYNEEEEEEDCSLAGQDKYSSTRKSHGDLLPAPLKPRPPPCQPRPASDGVFLSNSFQPPSAKANSTAHKKGQPLPPPKKSSSYHPSHCKGRGKRVTNQLSLS

SEQ ID NO: 840634 - protein, 1613 aa, Homo sapiens
MSAGGRDEERRKLADIIHHWNANRLDLFEISQPTEDLEFHGVMRFYFQDKAAGNFATKCIRVSSTATTQDVIETLAEKFRPDMRMLSSPKYSLYEVHVSGERRLDIDEKPLVVQLNWNKDDREGRFVLKNENDAIPPKAQSNGPEKQEKEGVIQNFKRTLSKKEKKEKKKREKEALRQASDKDDRPFQGEDVENSRLAAEVYKDMPETSFTRTISNPEVVMKRRRQQKLEKRMQEFRSSDGRPDSGGTLRIYADSLKPNIPYKTILLSTTDPADFAVAEALEKYGLEKENPKDYCIARVMLPPGAQHSDEKGAKEIILDDDECPLQIFREWPSDKGILVFQLKRRPPDHIPKKTKKHLEGKTPKGKERADGSGYGSTLPPEKLPYLVELSPDGSDSRDKPKLYRLQLSVTEVGTEKLDDNSIQLFGPGIQPHHCDLTNMDGVVTVTPRSMDAETYVEGQRISETTMLQSGMKVQFGASHVFKFVDPSQDHALAKRSVDGGLMVKGPRHKPGIVQETTFDLGGDIHSGTALPTSKSTTRLDSDRVSSASSTAERGMVKPMIRVEQQPDYRRQESRTQDASGPELILPASIEFRESSEDSFLSAIINYTNSSTVHFKLSPTYVLYMACRYVLSNQYRPDISPTERTHKVIAVVNKMVSMMEGVIQKQKNIAGALAFWMANASELLNFIKQDRDLSRITLDAQDVLAHLVQMAFKYLVHCLQSELNNYMPAFLDDPEENSLQRPKIDDVLHTLTGAMSLLRRCRVNAALTIQLFSQLFHFINMWLFNRLVTDPDSGLCSHYWGAIIRQQLGHIEAWAEKQGLELAADCHLSRIVQATTLLTMDKYAPDDIPNINSTCFKLNSLQLQALLQNYHCAPDEPFIPTDLIENVVTVAENTADELARSDGREVQLEEDPDLQLPFLLPEDGYSCDVVRNIPNGLQEFLDPLCQRGFCRLIPHTRSPGTWTIYFEGADYESHLLRENTELAQPLRKEPEIITVTLKKQNGMGLSIVAAKGAGQDKLGIYVKSVVKGGAADVDGRLAAGDQLLSVDGRSLVGLSQERAAELMTRTSSVVTLEVAKQGAIYHGLATLLNQPSPMMQRISDRRGSGKPRPKSEGFELYNNSTQNGSPESPQLPWAEYSEPKKLPGDDRLMKNRADHRSSPNVANQPPSPGGKSAYASGTTAKITSVSTGNLCTEEQTPPPRPEAYPIPTQTYTREYFTFPASKSQDRMAPPQNQWPNYEEKPHMHTDSNHSSIAIQRVTRSQEELREDKAYQLERHRIEAAMDRKSDSDMWINQSSSLDSSTSSQEHLNHSSKSVTPASTLTKSGPGRWKTPAAIPATPVAVSQPIRTDLPPPPPPPPVHYAGDFDGMSMDLPLPPPPSANQIGLPSAQVAAAERRKREEHQRWYEKEKARLEEERERKRREQERKLGQMRTQSLNPAPFSPLTAQQMKPEKPSTLQRPQETVIRELQPQQQPRTIERRDLQYITVSKEELSSGDSLSPDPWKRDAKEKLEKQQQMHIVDMLSKEIQELQSKPDRSAEESDRLRKLMLEWQFQKRLQESKQKDEDDEEEEDDDVDTMLIMQRLEAERRARTAMPAISVLDLVCSCFFPFGTFFLS

SEQ ID NO: 840635 - protein, 988 aa, Homo sapiens
MSAGGRDEERRKLADIIHHWNANRLDLFEISQPTEDLEFHGVMRFYFQDKAAGNFATKCIRVSSTATTQDVIETLAEKFRPDMRMLSSPKYSLYEVHVSGERRLDIDEKPLVVQLNWNKDDREGRFVLKNENDAIPPKAQSNGPEKQEKEGVIQNFKRTLSKKEKKEKKKREKEALRQASDKDDRPFQGEDVENSRLAAEVYKDMPETSFTRTISNPEVVMKRRRQQKLEKRMQEFRSSDGRPDSGGTLRIYADSLKPNIPYKTILLSTTDPADFAVAEALEKYGLEKENPKDYCIARVMLPPGAQHSDEKGAKEIILDDDECPLQIFREWPSDKGILVFQLKRRPPDHIPKKTKKHLEGKTPKGKERADGSGYGSTLPPEKLPYLVELSPDGSDSRDKPKLYRLQLSVTEVGTEKLDDNSIQLFGPGIQPHHCDLTNMDGVVTVTPRSMDAETYVEGQRISETTMLQSGMKVQFGASHVFKFVDPSQDHALAKRSVDGGLMVKGPRHKPGIVQETTFDLGGDIHSGTALPTSKSTTRLDSDRVSSASSTAERGMVKPMIRVEQQPDYRRQESRTQDASGPELILPASIEFRESSEDSFLSAIINYTNSSTVHFKLSPTYVLYMACRYVLSNQYRPDISPTERTHKVIAVVNKMVSMMEGVIQKQKNIAGALAFWMANASELLNFIKQDRDLSRITLDAQDVLAHLVQMAFKYLVHCLQSELNNYMPAFLDDPEENSLQRPKIDDVLHTLTGAMSLLRRCRVNAALTIQLFSQLFHFINMWLFNRLVTDPDSGLCSHYWGAIIRQQLGHIEAWAEKQGLELAADCHLSRIVQATTLLTMDKYAPDDIPNINSTCFKLNSLQLQALLQNYHCAPDEPFIPTDLIENVVTVAENTADELARSDGREVQLEEDPDLQLPFLLPEDGYSCDVVRNIPNGLQEFLDPLCQRGFCRLIPHTRSPGTWTIYFEGADYESHLLRENTELASILRVP

SEQ ID NO: 840636 - protein, 674 aa, Homo sapiens
MSAGGRDEERRKLADIIHHWNANRLDLFEISQPTEDLEFHGVMRFYFQDKAAGNFATKCIRVSSTATTQDVIETLAEKFRPDMRMLSSPKYSLYEVHVSGERRLDIDEKPLVVQLNWNKDDREGRFVLKNENDAIPPKAQSNGPEKQEKEGVIQNFKRTLSKKEKKEKKKREKEALRQASDKDDRPFQGEDVENSRLAAEVYKDMPETSFTRTISNPEVVMKRRRQQKLEKRMQEFRSSDGRPDSGGTLRIYADSLKPNIPYKTILLSTTDPADFAVAEALEKYGLEKENPKDYCIARVMLPPGAQHSDEKGAKEIILDDDECPLQIFREWPSDKGILVFQLKRRPPDHIPKKTKKHLEGKTPKGKERADGSGYGSTLPPEKLPYLVELSPDGSDSRDKPKLYRLQLSVTEVGTEKLDDNSIQLFGPGIQPHHCDLTNMDGVVTVTPRSMDAETYVEGQRISETTMLQSGMKVQFGASHVFKFVDPSQDHALAKRSVDGGLMVKGPRHKPGIVQETTFDLGGDIHSGTALPTSKSTTRLDSDRVSSASSTAERGMVKPMIRVEQQPDYRRQESRTQDASGPELILPASIEFRESSEDSFLSAIINYTNSSTVHFKLSPTYVLYMACRYVLSNQYRPDISPTERTHKVIAVVNKMVSMMEGVIQVRSSRPAMLLQ

SEQ ID NO: 840637 - protein, 113 aa, Homo sapiens
MSAGGRDEERRKLADIIHHWNANRLDLFEISQPTEDLEFHGVMRFYFQDKAAGNFATKCIRVSSTATTQDVIETLAEKFRPDMRMLSSPKYSLYEVHVSGGQCIQEGFARGMT

SEQ ID NO: 840638 - protein, 1612 aa, Homo sapiens
MSAGGRDEERRKLADIIHHWNANRLDLFEISQPTEDLEFHGVMRFYFQDKAAGNFATKCIRVSSTATTQDVIETLAEKFRPDMRMLSSPKYSLYEVHVSGERRLDIDEKPLVVQLNWNKDDREGRFVLKNENDAIPPKAQSNGPEKQEKEGVIQNFKRTLSKKEKKEKKKREKEALRQASDKDDRPFQGEDVENSRLAAEVYKDMPETSFTRTISNPEVVMKRRRQQKLEKRMQEFRSSDGRPDSGGTLRIYADSLKPNIPYKTILLSTTDPADFAVAEALEKYGLEKENPKDYCIARVMLPPGAQHSDEKGAKEIILDDDECPLQIFREWPSDKGILVFQLKRRPPDHIPKKTKKHLEGKTPKGKERADGSGYGSTLPPEKLPYLVELSPDGSDSRDKPKLYRLQLSVTEVGTEKLDDNSIQLFGPGIQPHHCDLTNMDGVVTVTPRSMDAETYVEGQRISETTMLQSGMKVQFGASHVFKFVDPSQDHALAKRSVDGGLMVKGPRHKPGIVQETTFDLGGDIHSGTALPTSKSTTRLDSDRVSSASSTAERGMVKPMIRVEQQPDYRRQESRTQDASGPELILPASIEFRESSEDSFLSAIINYTNSSTVHFKLSPTYVLYMACRYVLSNQYRPDISPTERTHKVIAVVNKMVSMMEGVIQKQKNIAGALAFWMANASELLNFIKQDRDLSRITLDAQDVLAHLVQMAFKYLVHCLQSELNNYMPAFLDDPEENSLQRPKIDDVLHTLTGAMSLLRRCRVNAALTIQLFSQLFHFINMWLFNRLVTDPDSGLCSHYWGAIIRQQLGHIEAWAEKQGLELAADCHLSRIVQATTLLTMDKYAPDDIPNINSTCFKLNSLQLQALLQNYHCAPDEPFIPTDLIENVVTVAENTADELARSDGREVQLEEDPDLQLPFLLPEDGYSCDVVRNIPNGLQEFLDPLCQRGFCRLIPHTRSPGTWTIYFEGADYESHLLRENTELAQPLRKEPEIITVTLKKQNGMGLSIVAAKGAGQDKLGIYVKSVVKGGAADVDGRLAAGDQLLSVDGRSLVGLSQERAAELMTRTSSVVTLEVAKQGAIYHGLATLLNQPSPMMQRISDRRGSGKPRPKSEGFELYNNSTQNGSPESPQLPWAEYSEPKKLPGDDRLMKNRADHRSSPNVANQPPSPGGKSAYASGTTAKITSVSTGNLCTEEQTPPPRPEAYPIPTQTYTREYFTFPASKSQDRMAPPQNQWPNYEEKPHMHTDSNHSSIAIQRVTRSQEELREDKAYQLERHRIEAAMDRKSDSDMWINQSSSLDSSTSSQEHLNHSSKSVTPASTLTKSGPGRWKTPAAIPATPVAVSQPIRTDLPPPPPPPPVHYAGDFDGMSMDLPLPPPPSANQIGLPSAQVAAAERRKREEHQRWYEKEKARLEEERERKRREQERKLGQMRTQSLNPAPFSPLTAQQMKPEKPSTLQRPQETVIRELQPQQQPRTIERRDLQYITVSKEELSSGDSLSPDPWKRDAKEKLEKQQQMHIVDMLSKEIQELQSKPDRSAEESDRLRKLMLEWQFQKRLQESKQKDEDDEEEEDDDVDTMLIMQRLEAERRARVKGGVLWLCPSVVPILASACFPWG

SEQ ID NO: 840639 - protein, 1870 aa, Homo sapiens
PTPGLLNRPNPLLALPPVRPHGPQDKDQAVESAQAEDYSQLPGEDHILEHLPARLNEGAHLRDGRRGGEAGWKEREERDRFYFQDKAAGNFATKCIRVSSTATTQDVIETLAEKFRPDMRMLSSPKYSLYEVHVSGERRLDIDEKPLVVQLNWNKDDREGRFVLKNENDAIPPKAQSNGPEKQEKEGVIQNFKRTLSKKEKKEKKKREKEALRQASDKDDRPFQGEDVENSRLAAEVYKDMPETSFTRTISNPEVVMKRRRQQKLEKRMQEFRSSDGRPDSGGTLRIYADSLKPNIPYKTILLSTTDPADFAVAEALEKYGLEKENPKDYCIARVMLPPGAQHSDEKGAKEIILDDDECPLQIFREWPSDKGILVFQLKRRPPDHIPKKTKKHLEGKTPKGKERADGSGYGSTLPPEKLPYLVELSPGRRNHFAYYNYHTYEDGSDSRDKPKLYRLQLSVTEVGTEKLDDNSIQLFGPGIQPHHCDLTNMDGVVTVTPRSMDAETYVEGQRISETTMLQSGMKVQFGASHVFKFVDPSQDHALAKRSVDGGLMVKGPRHKPGIVQETTFDLGGDIHSGTALPTSKSTTRLDSDRVSSASSTAERGMVKPMIRVEQQPDYRRQESRTQDASGPELILPASIEFRESSEDSFLSAIINYTNSSTVHFKLSPTYVLYMACRYVLSNQYRPDISPTERTHKVIAVVNKMVSMMEGVIQKQKNIAGALAFWMANASELLNFIKQDRDLSRITLDAQDVLAHLVQMAFKYLVHCLQSELNNYMPAFLDDPEENSLQRPKIDDVLHTLTGAMSLLRRCRVNAALTIQLFSQLFHFINMWLFNRLVTDPDSGLCSHYWGAIIRQQLGHIEAWAEKQGLELAADCHLSRIVQATTLLTMDKYAPDDIPNINSTCFKLNSLQLQALLQNYHCAPDEPFIPTDLIENVVTVAENTADELARSDGREVQLEEDPDLQLPFLLPEDGYSCDVVRNIPNGLQEFLDPLCQRGFCRLIPHTRSPGTWTIYFEGADYESHLLRENTELAQPLRKEPEIITVTLKKQNGMGLSIVAAKGAGQDKLGIYVKSVVKGGAADVDGRLAAGDQLLSVDGRSLVGLSQERAAELMTRTSSVVTLEVAKQGAIYHGLATLLNQPSPMMQRISDRRGSGKPRPKSEGFELYNNSTQNGSPESPQLPWAEYSEPKKLPGDDRLMKNRADHRSSPNVANQPPSPGGKSAYASGTTAKITSVSTGNLCTEEQTPPPRPEAYPIPTQTYTREYFTFPASKSQDRMAPPQNQWPNYEEKPHMHTDSNHSSIAIQRVTRSQEELREDKAYQLERHRIEAAMDRKSDSDMWINQSSSLDSSTSSQEHLNHSSKSVTPASTLTKSGPGRWKTPAAIPATPVAVSQPIRTDLPPPPPPPPVHYAGDFDGMSMDLPLPPPPSANQIGLPSAQVAAAERRKREEHQRWYEKEKARLEEERERKRREQERKLGQMRTQSLNPAPFSPLTAQQMKPEKPSTLQRPQETVIRELQPQQQPRTIERRDLQYITVSKEELSSGDSLSPDPWKRDAKEKLEKQQQMHIVDMLSKEIQELQSKPDRSAEESDRLRKLMLEWQFQKRLQESKQKDEDDEEEEDDDVDTMLIMQRLEAERRARTAMPAISVLDLLQDEERRRQQQLEEMRKREAEDRARQEEERRRQEEERTKRDAEEKRRQEEGYYSRLEAERRRQHDEAARRLLEPEAPGLCRPPLPRDYEPPSPSPAPGAPPPPPQRNASYLKTQVLSPDSLFTAKFVAYNEEEEEEDCSLAGPNSYPGSTGAAVGAHDACRDAKEKRSKSQDADSPGSSGAPENLTFKERQRLFSQGQDVSNKVKASRKLTELENELNTK

SEQ ID NO: 840640 - protein, 1883 aa, Homo sapiens [sequence omitted]
